United States Patent 9,487,797 (GENOMIC PLANT SEQUENCES AND USES THEREOF) - sequence listing, part 35

SEQ ID NO: 61135 - DNA, 67656 bp, Oryza sativa
aattaattagctagtgaataattagttgaatgaaacatctggagctagccaaccaattaagctagctgagctaatttgttaggcaaattaatcttgattcgcttctggactgccggaagaggaagaagaagctagctaggcagactccaatcggtctgtacactgtagtcgacctaaagcgtagaaaaggaggtttcttgtcgtgttacacgatcataaactgaatatctgaactgacctttgaggcaaaaatggacaacagggttagatacgtgtgtcagggagtgtgcgccattcggaagtcaattgatctctccacttcgttttagttttccacgcaaagcatgcttatcggttttaaacgacggattcaacctgccttaagaaagataattgggggcagaaagagacaatagaatgatagaaacgattgaaaagagagatgcacctactgctagctgacgtgttcatcatctttttttttccatttctcccttttgacaaaaacctcacgtctgttgtgtagtcaattcgtcagaagttaattccactttactgatgatcttgcatcagaaaacaagaagatcacatagctataaaccacaactctgaaattataaatagcaggtggaaccacaaatctgaaacggcagaggtcatcttcttccattgaaaaaaaaaaggaaaaaaaaagatgaagtgcgatgaagacaaccatgtacgtaagcaagtgtactccattgctgaatgcttcaaagaggaaactctagcatcatgcatatgcatctgagcatctcgaagatgaccatttccaattactattagctagctcgttgtgaaagggcatatagtctagtggttgcggtgacctaaatagcaccctaaggtattgagttcaaatctctataggagtgaatttcagattgggttatttgagggctagcaccccaaagttctgagttcaaatctcgatagtagcgaatttcagattgggttatttgagggctagcacaccaaggttctgagttcaaatctccatagaagcgaatttcagattagattatttgaggactaggtttctatatttgataggctaagttcctaattaaaaatatatttgataggctaagtttctaattaaaaagaggctgtatatatctggttgaatatagagggctggtaaaaaaatacctcgtctactagaagggtgttcatatctgaactggcaaaaggaaaggacacgtcgcgactagcaaattgcgacgggagcaaagtagcaaacagttccatgaaagcaaagttaattaggtaactgatatatagtagcttgcagatcaggcataattcaggccggccgtcgattgacacgccaagtgtactagtggcgacaaagcatgatttctggtgcatctctatgattatatacgggacaggaatcttggtggaaatttctgggatggattgacttttccgggctcttcgtctatgatcgtctagaaatgttggcacttgttgtaccgtactcaacctgcacatgcaaagcatccagcgcagctaatctttgtttgcctttactcgtgttcgtgcttaatttgtggggtagaaagtttcttcagcgaacatgtcgtgtgtggtttctcctgtgcttgatcacaacatcacaggatcttggacctttggtgcatgaatactgacatgcatgttcatcagtactatagttatagttgtcaaagcgtcacgctaataacaacaagctatttatatcttcaaaagaaaaaaaaaacaagatcagctatctagctcagttctcagtactggttcttcaattgctgcaactggagtagatgagaatactccaaagtgtgaacgtctaatagtattgattagcagcgacgtctgacagagatgtataacaagtatcctgacgtctggtatattgaattcaatggaacagttgagttactctttccgttgtgattgattctgcacatcttgtggtgttgttcgaatttgacttctagtagaaatttgatcttaggatctgtcagtgagacagtgatatatccatcatgttttttttagatgacatccttcttgttttagcacccaacattcatgatatttgcttccctttgatatactgttcttcaagcgttaatccttgaatatactccctccgtttcatattataaatcgtttaacttttttctaatcaaactttattaagtttgacctagtttatagaaaaatttgatagtattatcagcacaaaacaaatatattatcaaaatatattcaagatttaatgagtattaagatggttttttgttccgatcaaacatttaatttagtttagtaagtcagatgcatggaaactacaaatataactaattggaaaaaacaaaaatataaaataagtctaacgcttttggatggagagagtagataatataaatgctgcagaatgactgcagagagtggaagttgtcacctatggcctcgtttagacgggccttaaatctgtccatctacgtatatggccgagtgtttgaactaaactagttgggtggcccgcgcaattgcgcagctagtatccatacaaaattatcttcttttatatatgattttacttaaaatttgttaaataactatctcgttgtcttaggactttaaaagaccgaaccttaaaatctccatgtttctaattttgtagttttaaaaagtcacaccactcactacctcttacctctttgtcaccccctttatttgtttgcttatctactacagcttctatttatcctccttggaactttaaaattgaaccttataaattttagagttaattaaatcgttggttttcattttttaattctcgtcaaatgccgctactctactcctctacggcccgtccaccgcttcctctctttattgttattgagattttaacaatcgaacacaattatcgccagtgttcatttttaactttctaaaagtcccgccaaactgtcagcagcattgccattatactcttgtacggcccgtcctatgcctttccttttaattatcattgagattttaaaaattgaacgtgattatcattgtggtttatttttttactttctagaagtcccgccgatcactctgattgtgcttcttaacgggttgcccgccatctctcctcttaatcgccattggaattttatttggggttttgtttatactttttacgcccattgccttccctcttttttattattgagattttacaaatcaaatatgattttcattggagtttattttttactttctagaagtcccaccaacccccgtgatcatgctattacaatggcctgtccattgtccctcgtcttaattgtcattggattctattttaggttttgtttatagtttttagatgtcccatcaaccactgccaccctactcctttacagtctcgttgcttctccgctctttattttcatttgccatcgttgtgtttttagatggattgtgttttatttccatattttttattcagatattatgttgtttataaattttattcctacttgaacgcctttaattgtttttaaatttttagaatttaatttattttttattccaaaatttaattaaactcgtgctctagatgatctcttctttcagtattgcttattttttattccgaattttagttattttaaattgtatgcccatatgaactcttatttttattttctaactttagaatttagtttggtgatgggttgctctttcaatattcctttttgttaatttcgaatttgagttatttctaaattgtaatcctacttataatatctttttttgtaatttcagaatttattttattttatttttcattccaacatttaattaatcttgtgttgtgttttgaatggcctattctttcaatatcctaacttattattccaaattgataattctaggcttatagagttctgaactgcatgttttcaaagtatggttcatggatggattgttgatttggttaggacatggtatttcttagtactctcagttttttttaactaaccaatatcatataaaaaaatataggagtatttttttataaaaatattgacatatataggctttctagcatttatgattagaaacttgagaggaaagagaacccatctatatatgtgtatttgaaaattagcatgtggtagtcaataaaaacttattgtaattatattagagaataggattactgctaaaagttttagcttttcatttgaatccgatggaggacttgtcctgtcctgtttttcctgtcctgttgctagaccttcatagctatgattccaaaaaaaacgtgtcatgttgttgtgtggctttgctcggttgggagtccgactgcaaacatgactatgagaaggacatgtatactgcgtagtattttttttctttatttatatacctatacaatcaatcttaaccgttataatatagatccactatgagaatatatttttctttttatttcaaattttaattaatctcgtattggatttatagatggactcttattttaattttacttatttttaattccgaatttcaattattcttagattgtacttctatttggactcttcttttctttttcttcgattaacgtggtaatttctaggcctctacggtgaacgtggtgcctctttttcgaactgttttaataatataatagataggtagatagatagattcttggcccacagatatagatgggccggattaaactgttttgcacgtagttgtctatgaacaaagaatatcccaaatctaagcatttatgccaaattttcattgttgattgtacatttgtacttgtgcattcaccgaattaacgatgtgtgataacaaacacgttcttagtgtctttctgccaaaaacatgtccttattgtcttgtgttgattaggacagaaacatgttacgattgcccctcaatacgttcacacgatctgaccggggctaacgagagatggcgactattcatgcagggtttccggaaggtggtgcccgatcggtgggagttcgccaacggcaacttccggcgaggagagcaaggcctcctctccggcatccgccgccgcaaggcgacgacgcctcagtcctccaaatcctgcggcagcggcgtcaacgtcgcgttccctccgccgctgccccctctgcccccggagccgtcggcgaccacgtccagcggcaacgaccgcagctcctcctccgcgtcctcgccgccgcgggcggacatcaccagcgagaacgagcagctcaggaaggacaaccaaacgctgacgatggagctggcgcgggctcggcggcactgcgaggagcttctgggcttcctgtcgcgcttcctcgacgtccggcagctcgatctccggctgctcatgcaggaagacatgcgagcggcggccggcggcgtcggcggcgagcagcgcgtgcaagagcacgcccgggaggagaagtgcgtgaagctgttcggcgtgctcctcgacgacacccatggcgccgccacgaggaagagggcgcggtgcgaggaggcggctgccagcgagcggccgatcaagatgatcaggatcggcgagccgtgggtcagcgttccatcgtcggggccggcgcggtgtggcggcgacaactgaagtccaaacttgtgcatgccacggccatgacctgatcgaccaggcgaacggcaagcagaaggcatgcatggtgaggttggtggcaagaatggtccgatcaaccaagtcattaggtaaaacgagacgaattaagcacgccaaatacgtgcggccctgtgttaatcacgggttgctaccatgctagtagtaaggtaggaacagtacgaggagtcaaggctgaccgaagcgaagcagccggctcttgtgtctggacgttgtttcagttaacactgaaagcttcaccttactatggattatacattttttagataatggaatataatatcccggtctttacttaaaagagctacaaccaattattacatagtagtttttatgaacatagtataaatctaaatgaatagaacacaccgaagagaaaaacaaagaaaccaacataacgtaaggagatcacaattattaaagtctatttgtaaatctccaaccataattggcaaatagttgcataaccgtggtctccaactttcggcatgcaactttcagaaactcttcatcttcatcacacctttgtagttgtgcccaaaaccggagccaatgagttgccctgaaaatgacctgcatataggaaaatgatggtgatttgtcaaaaaccatatcattcctactcagccatattgcccaacaaatggtagaagctccaacaagtatcagtttacccattttcttatcaactcccaaaagccacccattaaaaatatgagatatgctaactggaagattaaaaccaaaagagaactgaactgctctccatagaaacttcgcaaaatggcaatccataaagagatgttgaatagactcattcttcaaacaaaaagaacgtctcaagctgccattccagttacgccttgccaaattatccttagttaacacaacccctttaagcaggtaccacatgaaaattttaattttaagtggcaacttaagcttccaaatacacttgtttatctcgatatagccattattaattaaagctaggtacatagacctcaccgagaacaagccattctgatggaaattccatctaaatctatcagacgaatcattcaactgaatatgtactatagaggcacacaactcatgccaacaaacaagattctgaccaactaaagctttcctgaaagaaacattaagcggaaccgatcccataacagtggcaatagaagatgttttcctccgaacaattgcgtacaaagatggatatttatccttaaaagccaagttaccaatccatctatcttccccaaatctaatttgttccccattattgacaatccaagaacccatatttaagaaagtacttttgacattcataagaccagaccaaaaataggaatcaccttgtttcctgtcaacttgggttatagatttattataaagatattttctcttcaataaatcatgccaaaccccttcctcattaattaacttaaacaaccatttacttaaaatacatttattttgtatctccaaattatgaatcccaagaccccctggtccttgggttgacaaacaacatcccacctagtgagcctgtattttttcttatggtcatccccttgccaaaaaaaccgcgatctataataatcaattttatgaaaaacccctttcggcacctaaaaaaagatatcataaacatggctaaacttaaaagaacagaattaatcaacaccagtctaccaccaacagataaatgcttgcctttccaactactaagctttttctcaattctctcttcaataagtttccaatctttattagaaagcttcctaaaatgcatcggaattccaaggtatttaaaaggaaaggtacctaacttacaaccaaaaatatcaaaatattgttcataacattcctttgcctgaccaaagcaaaataatttactcttgtgaaaatttatttttaggccagataacttttcaaataccgataaaatcagtttcaaattatttgcctgttgcaagtcatgctccaaaaagatgatagtatcatctgcgtattgcaagatagacaaaccatcatcaacaagatgaggaataaccccattcaagagtcccgcctctttagccctcttaatgaatagagtaagcatgacatctactatattaaaaagaataggagataaaggatccccttgcctaagacctttgtaagtttgaaaacaattaccaatttgatcgttaacttttataccaacatgaccaccttgaacaaaagaagctatccattcacaccatctaggagaaaagcctttcattctcaaagtttgttgtacaaaacgccatttaactttatcataagctttctcaaaatcaatcttaaaaattacaccacttttatctttgcgatgtaattcatgtaaagtctcatgtaaaataaccaccccttccataatatttctcccaggaatgaacgctgtttgagtaggactaattaccttttgagcgacatccattattctatttgtagcaactttggtaaaaaaaacttaaagctaacattaagtaggcatataggtatatactgttgaatctttaaagcctcggcacacttaggcaaaagaatgatagtaccaaagttaagcaaatataaaggcaaactcccagaatgaaagtccttaaatagttctaaaaggtcaaatttaatgacattccagaaaacttgtaaaactcagcaggaaatccatctggacccggagctttgttatgttccatttggaaaatagcatccttaacctcattttcagaaaattccttagttaaggcttcattctctaaatatgaaacttgaggaatgtcagcaacataattctcatcaaactgaaggtcagactcatcaggagggccaaaaagacctttataataagtggtaatatgcgactttaaattggcatcaccacttattaaatgatcaccctcctgtagttgataaattctagttttcctatgttttccatttgccactaaatgaaaatactttgtattagagtcaccctccgaaatatccttagtcttagcccgctgataccatttaatttcttcttcccttagaatgacagataacctactcctgaaaaaccatctaatatcaacttcctcttgagaccggagaacagtctctgcctttttatccagcgcctctaacttatctaatatctgctttttctcttttttgtataaaccgctggtatgtttagcccatcccctaagatgttgtcttaggcggtgaattttcgcttgccaacgctccataggagtattgccctcatcaaccccagaccaaacttcttttaccatatcaacaaatccatcacgtaacagccaactaagttcaactatgttgatcgttactaaaagaggaagattttgtatttaggagcaaaggagtatggtctgaaatatctctattgagagcaacaacagaggataaagggtatttttgctcccattccgtcgacactaaaactctatccagtttctcataggttgggtgtgccagattatttgcccaagtaaaattcctaccagtcatttgtatctccctaaggcacaacccatcaataatagcattaaacaagaagggccatctatcatcataattattattatttttttcattaggactacgaataatgttaaaatcaccaccaataagaattggtaaggtctcatgactgcacatgttaactaattctgcaaggaattgttccttaaactcattttgtgcaggtccatacaccaacactaaggcccacttaaaattatcagctttatttcgcaaatgaaacttaatataaatatccccctcatcaatcaaaccaatgtcagaatttaataaattaatacccaatagaagaccaccagatctgcctctaggaggtttacaatgccacaaaaaatctttaccagcacaaagattattaagagcagctatagaaaattctttgttaacagtctcagataaagcaataaaatcaagttgatgttctttggttaaatcagaaacaaacttatgttttttcgggtccttgaacccatcacaattccaaaagattcctttcatttaaaattaatttttttattattcttcttttttttacccttcttaccattagaaatactattagtagaaggtaccatggaatccaaagtggactgaatattatcactactaggacttggggcgcgcgttgcggtgcctcaccgtctgaagaggagtgtgaactttgcataatttgaaccgaacatccagtagcacttaaaagcgaaagagattgtactgataaaatagacgaaaaggtagcctatatggtccacctgattgaattacatattaggaataacaaaaccacactgttctttgatattgctgcaaaatatagtcgcgcaggagcaggagaagcagctagttagataagtagtcattttttctggttcctatcaggatatataaaaggaaccttgttgttatgcaggttgattagattagtggtgcctaccaagctcagtaggcagacgacgtggtggcattgctggcgatccaccctcaagaggtccagtatcagtgtctatctggcgagatacccactggaatgtctttacaattggcaagcgagggttgtttctctcatattgttttagaatctctccatcggtctcactttcactgtcttcatcagtgtagtcaaagtgtttctcaatgtgaattaatatggttgataaatctgcattgtgtttccaagcatactccgatgattgctgatccttctcaactgcctcaatattccaatccattagcttggggataagattgcaatctgttgtccatgcagccaatttgaaaacagaaagatcttctatatggtgctctgcatatagctcctcaaccatacaactgccatcgagtaattctttcatagctgatttgttccatgattctggtggtactccttccaatgcaagtatgactctttgacgcagtgggtttggaacactatgtagattcatcttgaaaggttcaaatgctagccgagttgtttggaatgtgaagcttttctggctaaatgccttttgagatctttcgtactgtttatcagagtccatgaatatgacgatgtacattctatgtctgaatggcagtaacgcaaaatcatcgacttggcagtcacagacgaagcctaccatagctgataccttggttgtgttcggattgccagccccaagcaccttgacaactacagcatcttggtaaatgacatcggcaagcagctgtgaaatctcttcacggcttgagaactttgtcgctaacaacagacgtttagttccataggatgatggctctggctgtgttctgttagggcgtctaccttgctgggcttccattcttttctaaaaaacaaataagatagatggaagtgaatatctacagatttccagatgtaataggtgtgttgtttttttgttctagtaagttcatagttgccctgttcagtaatgtgggatctcgtctatttctatctatgaagagtagcgagacaacagatagaaggaaatcggtgaagaaaatatgccgtggttgttacctggagagggagacgaagaaggctgtagaacttgttcttgctcacaggaagaggaggaggggaatatgagttggggagaaatagaagtaaggcgttgttctccacgacgtctaagccaaagcctgtcttgtctcttcaaaggcagcaggtaaggctatgggttgatgtcagtatatggagtaaaacaacgtgtacgatgtggttccagtatggagtagttaggtgtgtgaattttgttggtctttaattcaatagcatattttggtgatggatagtataaaaccctggactatcgtgtacatacatgctgtgctattgtggttaagcgccggtgttgactaaatacagaagctgctgaagaggtagtagtaacgttcagtttttttttttaggattcgtgacgcctggtaagcaaaacagataacgtatatgcgttctaccttgagggacggtgattaaactggatgtatgaatgcgactgataattcggaggtaaattaatcgccgtgaaataacaaccagtattcaggattatcatagtataactatgataatgcagaatcctagttacatgatcagtgccagttcacattaagtctttttgcaaaagaataagtctagtggaaacggtgtcaaacacaggacaccagtataataataggacagtttgcaaaggcactacagaacggctgattttcttctcctctcactgaagagctgtctggtgtaggcagcaactgtggcatccaaaagtaagcttgtttggtccataacatatcaggcttggttgatggcactgcaacgatgtaaagaggataagcgaagttgcataaaagacatagactgtaaacctatagctcctgatcagtatataacaaaaacatcaaaactcataatacctgccaccagcatcgttgccaggattgtctttgaatagcttcttcgcagcacctgtgccaggagatggcctaggcctttttgtgggtaggttgtaaaaagaacagttagcatttgtgtactgcggaatattaatacttgggaaaaaagcatttacctttttttgtagctcttagaagtgctttgtttagtgctagaagaaggagctttctgtgtgaggctgaggtgatcgacatcctactccatagtaaaaaacctcagtttttagaaattcgaatatgtgtgtttaaaaggaatttatggaaaagcctaacctcatcttctatttcctcttcatcctgaacctctgtagtggtctttgaagcagactctatttccaggtctttgtgttttgatatagcagtggatgggctagctggtccagtctgtgcatcactaagcccaactgatggagttggtgatagagccatggaagctgggagagaagatgcttgagatgcagatggggattgtaacagggcaagggtgtgattgttagcacctccaagaatcctattcatctggaatgcaacagtaccagtagaagcagtgttctcagtgatgctgacattctaggtaaattctttctcaagtaggtcagtgatctcctttggtatgcaaccagtgttacttggattctgctgcaacagtgtctcaactgaacgaccaatgaggcgttgtgccaaacgcccaaagataatgaatgaagaatcagctgtgtcatcgcctgctatcacattgagcttgaatctggaaaatgcattataatggtaattttagtatagctacatgtattcattagcttgaacagtggagtttatgtcaactgacctaggcgaagccaaaacaactggtgggcatgttggatctgcacacctgtatccatttccaaaacgttttgctgttttgttgcatgtgtcacaagcagtgtaccaccaggagctatccacgttaaccttttttatgacgacagtaactaagaactgatgcttctgttcataaaaataggatcctaattagcactgtgtataacataaattgaaatgttagaatgagcatttatagtaccgaggatttaccttgaacttaaaagggtgtaggtctttaatctcaatgaccgtcttctgttctgcattgtttgcagcctgagatggggcgggtagatcagtatattttattggctcatagtttccttggatgctgcatagaacaaaaaagttcatgtctcaattggaaatagaaaagaaagatcagaggatatgatttgctaagacagtatatgtaacaaacctgtttttcaaggcagtcacctatggtttgtcaaggtttatgtaccatttgcaggcagagttacctgacaaagaaacattccctgcatccagagcatatgtaagcaccctagaacattttccaagagccattatagaacacatgtatggtgtttaatggacttactaccaaagcccctcacaagcgtgccaacaaagatcactatctgtggatttttttttgccagcttcaatcacctcatctgcagggaatgttgtggctcgatctccccatagcgcaacatttattgtcacattgctatgcagcagacatagtatcattacataaagagtttatggcatcgtgagcggttgttgggtgatgttagcaaaaaaataaatgtggaaagcatgtatattgaaagggggagtaatatttggtggtagttagttggtgttgctgatacactgttaatagaaatgttagagaactgaagtaaatatctttttgcatattaaaaaacagagaagaagggctaactcggcatcgcgaatgtagatgctcctcttcagactttcaccatccttggtgcgcgtttggataggtgtcactgatgttatctcagtaatgattccaatggcatctattatttaagagatcataataaaacacacattaagaatgcaataaaaagaatggtaatctatgaggatatgactgaatcacagtacctgtgaaagagtccttcctgttcactcgtccccttagctggtcatatggcgttagagagtaaacatagttagggaaattctctggcacatcagtacactcttccagtgtagaccactttgtgagggcaatcgactgcatattgccaactggcctatactggctggtacactgccttacacgatagaacgtgaggtcatacactttgccttcagtgattgcaggggcaaagagctcatccaatggaggcataatctgagctgcaatgctggccccctgtttagaaaatggtactgagtaagaaagcgaaatgtgatgacagattacaaagcaaggattctaaagaactaaccgtgccatcaaccagaaccaggccaagatgatacagaatattttcatcattttggtcgcggaattcccagaaccttgatacacgaagacgaatagttgggttgccaagaccaggctcaagcttactgattagcgtggttaccatctgccaataccgtaagcaattgttagcttgccatacagttatttaggatgttataaaaattggaagcagtgaacagacagacaaaaataaatgcaagaaaaggcagcactacatacacaaaagctgcatagtacagcaaacgggaaaaaggatagtatacaacagcacggcaaaaaatagtgctatagttggtacttaggtgccaaggtcctgcaattagaacagagaacatattagggtttgtcctaatatatctttcggtctgtagtatgatgcacataaagccaaattgtttaataataccatcaatctagctgcatccaacacttcttgataaaccatattcctagtctttgaactacagacctcatcctcatcctctataaggattctaaggcctgctcttgaagttgatctagaagcagcaacatatagttgcccatgtgtggagacaggttttttcaaataaaccccaacacgcgaaagagtttgtccctggcttttgttaattgtcattgcatagcatatacggacaggaaattgtcttctctgaagtgtaaaaggccacttagaactcgtggttgtaagcgcaatccgaggtatgaaagctgtctcaccaatattagatccagttaatatcacacattgtaacaatcgatggccaagagaaacaatcaatagccgtgtgccattgcaaagacccatagattgattcaaatttcgcaacaacataacggtgacaccttttttcaaaataagtttatgtgacgggaaattgttgacattaatagagtttaagaattcagttgggtatagtatatcaaagtcaggcatatggtcacatgatcttgaaattgtatcacaactaagatattcttttggcttagtgggtatcatacgaatgacagaatcatttatttcatcaaccgttcagttgttggggcaaacaatagcacggcatgctagataggaatggtctgtgtacttgttggggaaatctaggaaaacctcatctattattgcctttattttgtcgccggatgtttttattagtaaatcttcaggaatatcgacccatgttgcttcagtttcatcaattttttttgttgcaggtaccttaccatcaccaagacataggatccaattagcaaaagtttcaaggtcttgtcggttctgttcacaaaggtcactttgaaggagtctcatattaatgttcagcttcagaagagtaacatggtgccagagaggcaaatttgttatggacgcatcaactatggaagcacgcgagccttttcttatcactggtagtatttggcgaaaatcacctccaagtacaaccaccttaccaccgaatggtagtctgctgttagaaggtgtgtgctcggaaagcagatcacgcaaacttcgatctaaagcctcaaaacattttctatgagtcattggagcctcgtcccatataataagtgatgtcttttgaatgagctcagcaagcatggtacctcttttaatagtgcaaatactgttctcatcaatgtcaattggtattttaaacctcgaatgagcagtgcgtccccgaggaaggagaagggaagcaacccccgaggaggcaatagcaagaacaatctttttttcagaccttatttttgaaatcaatgcattccacaaaaatgttttccctgtgccaccatgcccatagacaaagaaaaaaccaggttttgagctattcacatgcttcataactgtatcgaaaatagttctctgatcagcgttcaattttggaattattgaattagcttcagtggccagtatggcgctgtcaagagcaagctcttcctcaatcattctattccgtactatgtcatctgagtaaatcgctgggcgcggtaaatcatagtcatctatgttaccgccgctatttgaaaaagtggtttgcatttctttcatcaatagcgacagtagcctatcatgaggaaccaaataagaagggtttgacaaagctgttctaagacgtcgctggatatcattagtgaaatacacccaatatttgtcaaagagggatcgaacgtttccaacagagcaaaacattacaacagtaacaaatagttgtcttagctaggtggatgatgcggatattatggcctcatcaaagagcaaataccactcgttatcactctcgagtaaacctcttaattcacacgcttctctaaatgtcgcataaacaatgccttcgtatgtcctaacatcaacatatgactgagcacctttcacaatcatcaacagcattcgtaaatagtaaagctctccactgattgggctcacatagtacattctacctatcttttcacatggtgttctaggacgccaactacgtgagctggtgtcccatgtccattcctttgggaaatcacagtatgtcagtgttcgtgcgttgctatgttttttattagcttcaaactattccgttaacattgttttttgggccgcagggcttgttaggagtgaattgagttcagcaccctttttgtatcgaacaaagttttgatttggaagatgcacagttagtcgctctactgaaggaactctatagtggatatcgaattcaaaagcacgccaaagagactcgcaggtagatagaaaccgtgcatcaatgtactcctgtatttcatttcgaggtgtgtgattagaattagttgttttgtttaacgtatcatctttggctgcaccattactatcagataattgaccagttggcttattattgacctcaaagtatgctttagatctatcagctccttttgtgacatacttgaaaaggtatttaatcatgttagacttgttgcaccatttgacattaatatgggcttggtattttttaaggagttccatattataaggcacaacccatcgattatcaagtttcactccatttttaagaacatatcgaccattgtttctgcgtttgtagatagtaaaaccaaaatcatccattattgtctcatcctgaaaagacttagggaaatgtttagaacactcccctttcttcatgcacgggcatgatttgttctggttgccacaagggccatggatcataaactcatcgaccaaagcataacccaatggatcagtaaaaacatcaggtatttcagcggatataaagccatcaacaataggagcgctaaattcagtgctgcctgcagcaagccagataaggcaatgtatatgagggagtccacgcttctgaaattctactgtgtagagcactacatggcaagtataaaatgttagaactaactaactgaatgtacaacaaactaaacacaggaagaaagtatcccaccagcaaggactgggccaaatgtttttccttccctaatgtctgagataaactcatttactttcatgttaaaaaccctcacaatcatatcagagcggtcacttggtacttggcctagttcaaacagcaaagcatcgtatatttcttgccactttgaattgcaagtgaaagtcacaaacaaatcaggcactccaaacacacgacatattgccatcgcatcttggtaattttgtaccatgtatcgcctgcctccagtaaaactggtaggcaagacatacttcttccctacagaatcccagtttcaagaccatgatcaatggcatcagatatcgcttggacagactctgagcgaagttcaggctggttgtcagcaatatacttcaaccttgacccttcaacagtcgagtatgagtcaacacatatggaatcactaagacgtccacaacaggtaaagggatttggtttattcaatcgataatggagacggtaacggtagtattcgagcattgtaacatagcgtcgtgaattaccagaaatgctagggaagtcagtgtacttgatacctaaatggaatccggcctccccatatgggaaaagcagcggatactgaagagccatataggatggatgtagagctgagacacgtcgtaacctggcatcagaagattagaccattacatcgtacgtatactcaccgtttgaatagtcacctacaactattcctgcgatctcaccactcgttggaagattgtactgaatttcatcccttgcatcacaccccagcaatctaagggaaattttctcatcaccatggtcttttaaccgatctctagcaaagcgaaatgctttgaccagatcattatggctgtcaagcatagaagtcagctcgataacaatttctgggtctggatcatccacggcattagaatctctctcaaatatattcattctatttgatgtctcattttcagggtcatatatatacaactgagcaaatttaggtgcagcaccatgtcgtggcaagaggctgccaatacggtggtgtacaaccccattgattttaaacacacaaggtgcagacctattatttatcgtcttatcaacattagctcctagcgaagtaaaagcaaacatagagttgtatgatcggatctgccttataaatcgcttcgatcgtgcatcaccatcaaattttaatagtctggctaggaaatcaggtggttttttcagctctggaaggctaatcttaccacttctacaacacaggttgtaaatgatctttcgctgtgacagcacggtcccttttttgaccctctcttggaacgaaaatacagctccacagtatgggcattcatgggatggcccgccatagtaggatcgttcagggtatagcgctgtagaattaaagcataagggaagactggaatatagattaaaggaacgctggctaaaggatgaacaaaaacaaaccttttaaggatgcaatataatccttaggcaaaggtaagatgtcctcaagagtaggttttgggcctatacaacgaatagaaatgaggctataagcagtaggaaacaaattttttctttgtattttttttggatctgaaaataccatcaagaacattcatcagagagtagtctgttcggtgggcagatctcttcatatgtcgtctctccctattgctcgtagcagcacttcgcggtatgtctagtaatgtcctcttccctaagggaaagtagttatactaagaaatgaatcgaaacaatggttcgttcttttctcgaatgaagcaaccaagtcagcttataggctatattagtgatgtacttacttttcacattgcctattgggtttccactgattgtgttgatttcaatgggcagttgcctattggcattagaacgatgggatgtggcttgctgggaaggacctgatggaacgcttccttgcgcgacatctgcatgtatgctacttggtccagtgtgcacagcatctgagctgaggcgcaaaggaacagaacctactgaaccaaataccggagcttgcagaaatcctaaggaagccaatttgctgtcttagttagctgagctaaataataaaaacaacatgtacaaatgtgtggcgcgaataacacaccctggcctaatgaagcatgacgccttaatcgactctcacgcgcccgttggacacacgattttgctttaccagacattgcaaagaaaatggggacacatacagggagccactctgcacagcgcatcacaaaatagaacacaattgaacatgcacagtgagtaacatagataatagcaggttttaaaaaaggcgaaaacagtaagcagctgcaaagatgggaacaaaagctgaacaaaaccaaatcaatagatcaagttggcagtttacatataggaccagaaacagagggcaataattaaagtacgaaaaaacaacgatcaccattaagaatactctttaactaccccgatactacagaggaacaatcctacgacctatgcgcaccgcagaaaaaatggtcctccctaacaaaggtgaaccatagagagttacactgctttagtacattctcacaaggcagatctgtaggaccatagcgcgcctctaacctagcaaggtgtgcagccgctgttatagctacgtcaaccgcagacgcggctatctttctgtatgaaagcaacatgtggaagttataattgtgcacagcgaaaccatacttgacttggagaaacctaacagcctgctgtgcaaccatttcatgggaaacggccgacggctgtactgcagcaacccaaaagaacttgcttactgtaccgcagcctaactgctcgtcaggaagactaagttcaacacctgctaacagcactccgtcaccatctacctcccaaaggtatgacacccaaggtaaacggcaatgggaagcaacagcgttcaacaaagaaacgtaggatacgccaaccgccaccatcccgccgagagcactgcgaatcgtagagacagctttcaaatagggggaaaagagggcttaaaatgttgaggagacaggggctgagggaaggtaagatatatactaagatagcaagaacaggaagatgctataaagtagctacactgtcgcgtggggccaaacacagatatatattctggaaccaacgttcacatgtcctgtacagagcacctcacactcgagaatcctctatgaaaaagggaaaaaaaacaaaggttgacatataaaacattgaccagacagcaacggtcccctcccaaacaaaccaaacgcaataaaggtggcaataaaagcacaaagaacaacacacagcaatctaggcgatataaagagaagaacactaccttggtggtaccggagacccaacaccgaaagaagctacgcatccgtcaagaaccagggaccaagcacgaagagagagagcagcagaccaacgtgcggtggccgttctcctacagaatggaacaaaattagagccggcatgaaacctcaccgatgaacagaagcagccaacggggctgtacctcctccgcaacagccgatccggagctggcgtcaaactctactatccctagatggagatgcccctggatcctgaaagggatttgctggaaagaacacaccgaatatgaggaacaccgccaatcctagaaaaacaatgcaacaccatgctgagcaagggcaatcaccttgccatcgccatcagagcggaaggtcgcaaccagccactgggcagactgaaggaaagggaagaaccgaggagaggggaaaacgggatggaaggtaaaaaggaggacatcacggggaaacttgtgagccgctgtcgatttcctattggccatgcagaacacacatggtaaacccacccaccagccaaaggcacgcaccaactgatatgtgggaccataaaggcgtcgacgcccacgcctgaacagcaacgacccctacgtcaacaaaagggccctcgatcagatccatcagaggagcaagcagcagcatggaccaagcccataggcaacacgtggcaacaagtatgtatgttctctccttccctacccatagaccatagaccaagcccatccaaacaattcaaacaaagcaacaatccctcggttagatcgatcagtgcaccaagcagcaccatgaacctagcccacgcgcaacatacatgtacgttctctgcttctccaaaggcagaccaaggaccaagcccattggaacaaaccaacactgcacgcactacctttttgactttttggacaagagatgacggggcggcataacagccattcttcacacgccgtcgcctctgtctatcggacccaccggtcagctacagcggtaaaaccgcagcacggcacagtaaaaaaaagcccgcttccgtgctctcccgtgccccaccgagacaggctaaacccacgatacaaaaaccgacgacgtggatagtggcgggagcgaacacatcacccctaaagccgcgtaaaacgctctggtgcgagcacattgcccctctctttaactaccctgattcccacttaaatccatcacctcctccataatttcaccacataaatgttgtagtagagtattatcatcgaactgatcgtctagctcaccttcaacaattacatcaggaaacaattacatggtaacttgaaaatttatcgtgaaaaatacaaactggattttcccaattttttttagttaagtgcacccccttccccaaagaaaatcatgacaccttttcttttcacattctctgttccacatgttacatgtcaaatgaaatcagtcggccaggttagtaagggcaagtactataatatctcatatgttgcctctaagaatgccacattggattgggtgatgaggtggaggagagaaatggagagagaagatgaaccacccctaaatcaagaggcaacctccacataaatttcaagaaatgtgtgggagtattagagatattggtatttgtgtgttagaggtaatacattgtatggattgcctcttagttcatgagtgaataaaatagataaatttggaggtggtagtcacatctaccatagcacttgccctaagttctaatcttgagatctgcgtggagattgatgattttagaatttatggacaaattaagtcgcaatcacttgttctcattcaaacatgagttcattcaaaggtatgacgtggtgtattggcgttggtgtggaatgtaacagtcacaaaaagtcagctccatcgtcagcgtagtgttcaaacaggtgttggtggcgttggtctagagtcatgtttggttggctgctaaagtttatgacgtcaaatattagatatgacatactccctccgtttcaaaatgtttgataccgttaactttttagtacgtatatgaccattcgtcttattcaaaaaatttaagtaattatttattatttttatatcatttgattcattgttaaatataatttcatgtacacatatagttttacatatttcataaattttttttgaataagacgaacggtcaaacgtatgctaaaaagtcaacggtgtcaaacattttgaaatggagggagtaatttgttagccaagctctatagttaacgctagatcgctagccacagtttcttactttattactccctttgaattaataatacttgttgttttgaaaaaaaaataaacaactttaaccattgtcttctgtcttctgctagaggtgtgaaagcatagttggttagggtgtggtctcaactctcaacaatcaattgttgccggtttgattcccatggatctttcgctttgtctttcctttttcttccaatatttttattttcgaaacacatccattatctttagcaaatatgataattatatgcaagcggcattccctaaaggcgttttagttctctgacaacattatttccaaaaagtcttgaatactcatactgaaaatcttgcgtccaccagccactgcctgtctgagttggcactctagttggtactaggtgacttaaggcctgttaggcatacctccagctctagctccacctcttctaaagctggagcccaacaaaaaaatttcagctctatctagaatgaaagcgaaattcggtggagcgctctcacaaaatgaacttcagttagatggccagtggtcttcgtgaggggcggcgccatgccctgttagaaacccgtttggcactgtgaccgatcacccacatgcatatctctactaaggtaaaagcacacagtcgttctccttccatctccatctctcacgcatgtacactctacgcgattaaacaccagattctattgctttatccttaatcacctttttagtccatgtttaattatataggcttggtccgttataacgtacgagcatgttattagtatgcaacaaatgcggaagtgctaatgggcgatcgatcgcccggcgacaagggtagcgatcgatcccccttccccctccctccctccacctggtttctttttttggcaccgcattactttcctattttagtaaatttatacacctaaagtttatacaccttaagtttacacatctaaagtttatacacctcaaatttacacatctaaagtttagagactaaaagtttataagtcaaaagtttatatatccgattcaaatttgaatttgaattcaaatattttatatatatatagtatttctataaatctaaagttcataaacctgaagtttatagacccaaagtttataagtcaaaagtttacatacccgattcaaatttgaatttgaattcaaatattttcaatatatagtatttttatgcatctaaagtctatacacctaaagtttatagacccaaagtttataagtcagaagtttacatatccgattcaaatttgaatttgaattatatccgttcaaatttgaatttgaattcaaatattttctatatatagtatttctatacatctaaagtgtttatacacctaaagtttatagacacaaagtttataagtcaaaagtttatatactcgattcaaatttgaatttaaattcaaatttgtatggtgtagtagtaagagaagaaggggaggtaaggtagtaaggggaggggcgggcgatcgaccgcccgttaggagtatcccaacaaatgcaccaacaaagaaaaaaccgtgtccttgccagtcgcatcttacccggcatcagagccttaaaggccagctaattctcaatgggccatgcacccatgccacgcaggcccgtcgatggctatgtgccaagtaggcgaccgcacagggcctctgtttttttggcccccatataaacaatgaaggttcacttccaattgcccagctatagcatgcaacaaccaaatagactaataggcaaatcaatcaataagaccaagccaggatggggcgctgcaagtctgcaaggctctgctattacctaccttttgcatggctgtcgtgcgatcctaattctgtgctgcgccaactgccgggatgtcgtaacgtgatctcaattccacgcgcaacgactaacgaggcggcgacacaacttgatgctttcaacttcgaggctccaagcagcatcgacgatcgcgacgaccttgcagctctgccttcggctgggctcctgggtccagccttcttcctccttgtttgctcgtcgtcctcgactcaaccctcgatggttcgactcggactggtaaggttagcctggatgatagatcgtaaatatgtaatatgcatcaaattgtcgtgagttcatgactgtaatctatctatctatctattaagacagctcgaaacgaaggcaccacgttcgtcgtgggggctagaaattcccacattaatcggagaaaaagaaaagaatagtcaaagtaaaaatacaattaaaaatagctaaaattcggaattaaaaatgtgcaatatggaaagaggagtccatataggaacctagtacgtgattaatcaaaattcaaaataaaaataaaataaaatccaaaattagaaaaggaaaggagaatagaaatacaatttaaaaatagctgaaattcggaattaaaaataagaaatattgaaagaagtttccatataagtacccaatacgagattaatcaaaattcaaaataaaaataaaataaaattcaaaattagaaaaggaaataagagtccaagtaggaatacaatttaaaaatagctgaaattcggaattaaaaataaggaatattaaaagaagagtccatataagaacccaatacgagattaagtaaaattcggaataaaaataaataaatctaaaattagaaaaagaaaataaaagaaaagtttaagtaggaatacaatttaaaattagctgaaattcggaattaaaaataagcacactgaaaaaagaatccatataagaacccaatacgagattaattaaaatttagaataaaaaataaaataatatccaaagttagaaaacaataaaagagagttcaagtaggaatacaatttcgaaacaactgaaattgaaaataaaaaataaaaacattaaaataacacaatacggtattaaataattttttaaaaaaattctaaaattagaacaagaaaaataagatttcaattaggaatacaatttataaataacaaaaaattttgataaaaataaatattattaaaataaaagaccatctaaaacacatgacgagatatattaagtaacatgcctataaagagtggtggtggttgatatgacatataaaaattgttaataaaacaccaaatagaatcctaatgacgattaaaaggagagacgtcagggaggccgtgaagcaaacaagtaaggcagttgccgggacttctagaaagtaaaaaaaaaacaatttttagaatcacaatgacaataaagagtaggtggcggacgggctgtagatcagggacatagtgacatcgtttgatggcacttctaaaaattattaaaaataaaactacaagtccaatttttaaaggttcggaacttctgaaaagtaaaaaaaccaatgataatcatgttcgattttaaaatcaaaatgaaataaagaagggaggcagcgggcgagccgtagagaattacaatggcaaagccgctaatggtttggcgggacttctaaaaagtaaaaatgaacttaaacgataattatgttcgatttttaaattctcaatgacaataaagagataagatagtggacgtgttgtagagaagtataatagcaacatttgacgggacatctagaaattataaaaatgaaacccaacatgacaataaactctaaaaactataaaatccaatttttaaaggttccaataagaatgaatagaaatagtggtaaatcgagcaagcaaataaagaaggagatgagacataaggggtagcaactggtgtgacttttaaagcctatataattagaaacacgatgatgataagatttagtctttcaaagtcttaagacaatgagatagctatttaataaatttgaagtaaaatcatacttaaaaaaatatatgattttgtttgggtgctagccgcgtaattgcgcgggccacccagctagtttataattgaaatgatcgattatatcaaattatcgttttgattaaaattactgctcctatttgtttgtgaaacataaaggcatatatttcgaaatatcatacattataacacatattacatatatataattgagtgaaaatatattttatttattttatatatgatttttttaaaaaattatatgatctcaatttgcattttaccctgggcccaaatttaattcctggagacggccctgatgccacgaaaccgatgccctctctaagccaggcacacgtgagcaaacgaagccgcccgtgcatgcgcaacgaaacaacgaaacatcatatcatgccaccaccgtctctacgtgtcggcctccgcgcgcggcgtgcccccacactcggacgtgacgaggcacggttcgcccggcgcccccatgtgcgtgggagagagctagctcagccggccggttatgcacgcggaccaccatggcaccatcgcgcggcgaggagtaaggagacagccagctcgatcgatctccgcgagtacgcctactacgtactactgtactagctagcgtggtactagtagtaggccaacgagcgacgtcgcgtcgtacggggtcgtctgccggtgcgacgacgtgcgcgggacggggacggacgggggaatgtggctgaaagggggaagccgaaccacctcgcgctcgctgcctgccgtgccgggcccgtgcgggcgtccgacgtgtgcggccgatggtatgatacttcgatcggaacaggtagtgcgtacagagccgtacaatctcggtcggtcacgcgctcacgcgtcgtgagctggactccaacggccggcttgtgtggccttgtgccgggcgccaactcactcgacagcagtggcaagcagcgtcgtaataaacgtacgtgtacgtaccgtccgaactggggccgggcctgtggggatcggtgatcttttggttggtggcggatcgcgcgttccgcggggcgcgtggcgcgtgggcgctgatcgatcgagcgcgagccaggctgccaccgtcagcgtcttgggctcgatcgtggcgttggtgggggacgcgacgcgagggagttgggaaccagccaacggacggacgggctcgttcgatccccttcgcctgttaatccgttgcatctcgtgcgctgcgcgtctctgcgccttgcgcgcggtgcgtgcgacggtgcgagctgctttgtctgaccgatcgggaggattatggcaagaactcattgtgtgagcctactatatatgagttcaggccggctctcgcatcagttttttttttaagcccggcctgaaaccggggccaacccgggggtctgcacccaggtgtaccgtgtacggggaaaacgcatatggcaacacgcgttggtgccttggtgtaatgaaagggagccgaaatgcagcagcattaactgctgaagccatttaatttgggtcaatgtcaatgatattacacattatcatttgtttttcctccgagaacccattctcatcatcattaccttcttatgatcaagttaaaaaagaagaaaactccattttttctccccggacttcccttgaggaaatagaagggcaatgaaagaaagaaaaatatctccctagctagcttatctacattaaacgcctaatcaaaccattgctacgccattgtcgtcattatcaccgttctggcaaccatctgtttccacactgacactatcatccctccataatttcgcgagaaggccatgcttgggcacagggaatgggctgtactcaacctcgtcgctggaaccaacaatctcccacctgcaaatcaagaacgcagacgtcaatcagcacaccgttccacaacgaaatttgaggaaccaactcgtctccaatgacatgcatgtgactgctcatatgtggtactaggatgctgagtaggcgctgtgcgatctgagcagtgaatgaccccacaggttggagcatgcgtgtactagcagctgtggtatgtgtatgcggaatctggcagctgggaggaaggggccaatggagtggcagcagccatggcacggtgtggtccacaacgacaaggggagaatatatggcgaatctgtgtggaggggcacgcacctgtagccagtgaccaggtggtggatgaggacgagcatctcgagcttggccagctcgttcccggggcacgcgtgcacgccgttcccaaatggcatgaaggtgttcggcctcggcgacacctgcatagacattgttccacacacaaccagaaaaaaagagaaggttcagaaaaaagaagtttcactcgtggtacttcagttttgaggctctatctatctgcagattggtagcaccactagtatttgctgcggctgctatgcaaagataaattaagtcatttacaaatgttctagataagggtttgactcagcagcaagttgattaatggttggttggatttccatggtatacatctgatccgagtgtgaattctggcctatttgtgggcttgtcgaatggccgaaaaccctgacatattctgacgagaaaaggtacaaattatttctgaaactgaatatacctattcgcacctgacgtattacaactatgtcttattataatttcattccacgaacagtatcacaaagagctgccgttgactagagaagagggaatttaatgctatcgaaaggaacagtgttcagtttgttcagagatgcatgcatcgacatcaaaagcactgcggcgaggatcgatcgatcgatcgaggcccataccttgaatctagaagggtcgaacttctgtggatcctggaagtagtctgggttgtgatggatgttcctgaagagcggcatcaccttccatcccttggggataaggaaccctacacgccaaggaaaaatacacggtcccgtcagcaaaactaaaaaaaaaaaatctacactgtttttttcacacgatgcatggagtaacggacgtggctcccctacggccacgttgtagcgtagggctgcgcacgtgcgtacctttgtactccacgtcagccacggcctccctgaacgtgaacgagatgatgctggccatccttaagctctccaaaatcacctgaaccgaaggatgggagggagatggcaacaaaggaattagcagatggcgccgtcagtaatttaaccgcaaaaatacacgggaatcgaatgaaaactcgggaaatgggtgtatttttcgcgcatacgtaccttgtgggttagggccatgctccgcgtctgcgcccacgtcagcggcagccggccgccgtcgttggcggcgcggatcgccgcctgctccgccctgacggcctcgagcagcttgggatggtcgtggaggtacttgacgatccaggtgagcacgctggccgtcgtgtcctgcgccgcgaacagcacgccgatgatgttgtcggcgacctgctcgtcggtgaggagcgcgccgtcgtcgcccgcccgcgactgcatgaggcagccgaggaggtcgctgccgggctccccccgcgcccgccgctcccgcatgatgtcgctcagcacgccgtgcagccgccgcctcgcctgcagatttagtaagatgcagaaaggaactcgatcggttatcacctactgttgctgcaaacaggacgtacaagaacgacgtgaggaaggcactagaatatgctacagctcgtgccatctagtgcctggcttctgctgcgtacctggatcgccttgtagtacagcgtcccggggaagctgttggggaaggagttgtagcccttctccacgatggcgtagttctgcctcagctccgctttccgccgctcgtccagccgcccgccgaagatggtcacgatgccgacatcgaacgagagctgaaaggaacaaaaaaacaaacacgttacatgcatcctcgtggcgagcagcactgcttttccggcacattcctcttcatgctctggctggcaattcttaccctcttcatggcgtggaaggtgctggagacgttgccgtcccaggaggcgagcgtggagcggacggcggcctcgacgtccggcacgagcgcgcgcagggcgtcggggccgagagggccctggacgagcttgcgaaggcggaggtggtagtcgccctggtggaagaagagcgccgacgggccgatcatccgctccttgctccgcgggtacgtcggcttgaacaggtgcgcctgcgtcaccagcacgaaccgcgccgcctccgggctcgccagcatcacgcacgggcaacccagaatgtgcgtcttgaagatctcgccgtacctgcacgcacacacaagccatacatcagcaataacgccgaaagctacaagcccacaactatggcatgcagtatttgtgttggcagcttggcattatcttgccatccatgtccttcaaaagcatgcgtccatgctttcaggttgcagagattagcagcatgtttgggtttttaattaattggcaactaacctcttctgtttggaggcgaagaagacgttggggtcttgggagtagagctgaagggtctcgccgatgtaaggccaacccatggagcccggcggcagcctgacggctttctcatggccgtagccatggagtttcctcctctgccggctcgtgtagtggacatagcacataaaagcaagagaaatgaagaaggagatgacgatgacgatgacgaaggaggctgccatccaaatgaccctggagaattaaggatcacttggacaccacagctgttttgagagttctgaaccagctgtcttcttcttgctagctagtcgtgtgttattgtctttgcgctatatatgctgttgctaggagagagggagagagctgtgaggagagggagagagggaggagaaaaatcttcgagggatctttcgaatggtggtgggcgtgggaaggccttgcgtggtatttatagaggcagagcgcgagagagaaagtgagaggccagtttggaagctcatatggtgtccgcgagctagggaggggagggagtaaggcctgtttttcccagcttaggattattataatctagattattgagtcagattaccataagctagattgttataatctgtagtagaataaacggttagttgtttctttcctagattattacatcctaaattattgggtttacaagtctaaagagaaagtggtgtggtatgacgggtaattttttacccaataatctggaaaaagctcacctaaatgagcttatcatattataataagccctctttgtttaggcttataagccaacttataagtcgaaaagtctgagcctaaacaagcaagcagcttttccgtttggtttttttgaagccataagccactctaacactattaagccaaaagctaggttggagaagcttttttggcttatgtgagttagatgtatgactcaactactaaacttaggacattaaatccaccggcttataaatcatataagctgacttaaaagtctaggctaataaacctaagcctaaataaagagggcctaagctaggctccagattataataagctacttcaataagttgtttgtttctttcagtttactcctaataatttggattataataatcctaagctgaaagaagcagcgcctaaatgtacatacatcaaggaagtttcaacttatcctgtggatttctaatgatagcatatatatatcgtggtatttatttcttatcaagattttcttaagagggtgaaacgtacatgcagcaagataagttcagtataccactataccctgttgatttgctaccctgtgctgattagtttcaatcgtgtattggccaatctggtcgtaagaatagcattgcattgcatttattatgttcttatcatgtgttttttggggatgaaacgtacatgcagcaagataagttcaacttatccagttttatcgtcgttctgtacatattaaaatgtagtttaatacagtatagtttactcctacttatactttaagtatgtgccacatcatctaaaagtatacatagagataggacatactaggactactagaatacagtggcggagccaggataaaaatatagcggggctaaaccaaaatgaccaacagcaactaagagagatttaggattaggttaggaatttttgggccttcttaacgttttgggccttctaacaacctcaaacaaagtttatattagcccctcatttataaatatatggattagaattttagggggggtattatgagggctctaatggtctattagagggtacgggggtctaaaaacacctccacccccacgctgtctccgcctctgctagaatacaataatacaatagtagttacattcttccattccctcagccatggacgaagctacaagtatccagggatgcctagggaaccgatacataatttttttttagttatagtttacctattttcatcatatatacgtctcctcaattcaaacttagacatccgtatcaagctaaaatcgattcaaagtagagtaaaatatgtgagtggaacccctctattttgttttagctttgtcaccgttttcagtgtacgtaggtaaccaccgtatctaatgctttgtcccataatcacatttatgtagcacatccctacttatataggtccgacacgttacaaataaggctccgttattggtactttgaaaggggagtcttccgtccaccccctcccagtccttcacatcatgcacagtgtgcaaccatcacactcgcaagaaaacaaaccaataatgttcctaacccgttcccaatcacacctcatttccaattacatggtccaaaaaaaattaatctccattgaaagagacaagtatattattatccattgcaacacacagacgtgttactactattaaaacaaataaattggtagtaaagatatgcacacgtgtgtatcccaccaagtaaaatagaattgtccatcgaatgtagataaaaggatgcacacactctttcttatgcataatttgttaactcactacaagaaaacagaatgtccttggcggccatataatttctttagcggtatttacttagcgatcggccgatggaataattaagaccgccaagtacattccgttttcttgtagtgacttgggaataatgtttacaatatacccaagtgtcatgccccgaactagtcccgaccgagactagcccgtgacgctccaatttaacctgttaatcgataccagtcccaggaaacagtgctggtatcacagggagacagaatatcacagcaacagaggtctctttattatagagtaggagtacagtcatgttgagctgcggacagatcccgagctcacaactgcattacaaaaggaaaacggaagccaggacttggaccattcatcacaggcgcgacttgggaactaggccgaaaccctaaaactcatcgtagccggcttgctcctggaagaactcctcatcagcaggatccgcttcatcttcttcagcaactggggggggatatttatatagagcaagggtgagtacgggagtactcagcaagccaggggaaataagtgtttaatgcaggcttcaagggaaggctgttgtttttgcaattggttttatttgaactatttttctaaaacaactaggtgagtgcttctcaaacgacacggatgggacagtgcgtctcgtccggtcggagtatgtgcaatgtatcagtctttgggattgcaacaaggttggcacccggccaacagcttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcccttgaccgtgggcacggctgttcgaacagttcaatgacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccgtgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggtttttccaagtcttttgtaaaactccagttttacccaagttgttactcagattttaaatttgaaggcgaccgtcgatactcgcacagagtgcgcgagtatcgaggcgcaactgggtggttacaaggggacatggtatagcaattaacaaaggaaggatcaaatgcgacaaattaggtaggtccgccaatctgccttgcagacgggacaaacagattaagtgtgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactacacgcgaaacgggacaactcaacaaacggcaaaaataaagccctattaacgacctctaagcgtgccataagatagatctcgagatttggggaattttggaagttgaacggagtcaaacggatttacggttgggaagatattgaatttctaagattattgaatttttgatctaaaggaaaaggatttaattaaatcctttttggaaaaaaaaagaaaagaagggagggaggaaatatagacttttctcggacagctagggcgcggcccaagagaaatggagcggtccggccgagctaaatgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggggcatgcgacgcacgcgcgcgggcggggacggaacgcggtgcatgcgcgcggtccgcggtggacgcaggtgcggcgggcccacgcgcagcctcacggctcgcggtggatcgcgcgcacgcggagggaccgaccggggtcggcccgaccaggtctggctgagctggcgccgacgtggcgcctacgtggctgccacgcgggccggcgggaggtagacgacgacccggcctcgaatggacggcgggcggcggcggcaagcggcggagcgaaccacggcgatacgggcaacagcgagcacaccgggcggttgcacgtgacaagggaaggcgagccatcggctcggattcgccggaggttgctcgacggcggcggattgcggcggcggcaaccggcggcgggagaagagggaaacggcgacgaggtcgcgagaggtcgattcccggcggtgagaacatctacgcggcttcgggaactcgacgctagcgtcggattgggaggaactacgccgagcgaggccggcgacgagcgggtgctacggagctcgggcggcgacggcggcgagcacacggcgagcgatggcaacggtcggggcggcgccggctaactacggggagtctactcaagctactaccgaaagctagggggaggagatggagcgaggaggaagaacggagagagactaccgtgtgggacggggcgcagtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgaggcagagcacgggagcggcggcaacggtgaggaggcgaatgggagaggaaaggaaaggagggggaagacgggtttaaatgggcggcaatgtcggtttgagagaggggaaccgacatgggcggtcaagccggcgagctggcgctccggctagcgtccaaagcggcgacaggaggtgacgccggcgagaggggaaaaaggggagaaaaataggaaaaggagggagagaaagggggctcgcccctttgccgattcgggaaaaggaggagggagtggggcaactcggcagagggagaggggctctctgcctccgtcccttggaggctagcgcgcggagtggcgggggccgggcgatgacgacggcgatgacggtgggatggtttggagcggcgcgacgacactagtgacaggcgcggctggcgcggcagagggtgacggcggcggcgaccaggcggtcggccactcggcacgcgcgcgcgggaagcaacgggcggcgcggctgggcagcgggaccgggcgacgcggacggcgcagacgacgcggctcgggcgggaaaccacgcgggcgcgcggggccggctttgcgagcggggagctcgcgcaagagatgggggcgctcggcgcggctctcgcacgcgcgagcagcgaacggggggggggaacgcgccggggtggggagggagcgagagagagagagagagagagagagagagagagagagggggggagacgcccgggagagagggggccggggaagagatgggccgagcggaattcggcccatcgaacctggggaggcaaactagacttttgcggagggattcgatttggaaggaattggattcggagttgaactcgacgatagatcggggattgagatcttgagatggcacggacactagacaacaatcaaagaaacaaatttcgcaattagggtttttcggagataattttcccgctaggcgccacgacggaacgggcgctacaccaagttaacaggtctttattttgcgaatatagaaaagaaaaggataggagaaattgtgttaaagtatctcttagggggaaattgcttaatacttgaagaattgagacgtacagttcgctctccattaatatgtaaaaatttaatgattttcagtgatgtttgacgtaatagtaaggctttgtttaaggaagtttaagattataagaaacatttgatgactatttagtctttgagaatttggaaaaccgaagttccgaaccttttgtttctaattcattttctatattttatagctacatatttatagaatttagatgaaaacctgaattgtttggtactaggagattttagaataaacagcgtgtgtcatatcagagagtggttggtttcactgtcatatatatccgtcgttacatgcactggttgaagctattgtcagcgcgtagaccctatcgttttcacagtggcaaaagtaaaacattcaagaaactacgagcgggttcgtttcaacagttggagagtagaatttggaggccatcctactgcttcgagaaaattataggtttggaacatctgatgtttattgatagttcactactcctaatacacatgttgctctataccagtctactaggagaagacaagcaatgcttttccgatcgtgatacttgcttctcgacatgcctgctttcctgactatgaagatagcaatatctagagttctgttaagaaaaaagatcagtaatatctagagccaatacgtagttacgtactctgctccatatctgatcatggattatgtctcagatctgtatgtttcttcttattattattatcgatgtgttctggtattctccggcatcacaattcagaagctagtctgtactcatttactagtcatctctatagtctgtagaattcgctgttatattccttagcagaattctttgattattaattatctaccaattcgtagttttcttcgcgttgtgaagcatagagaatacagagtaaaacatgttctacacttctacatgatctgtattcctgcatgtttcttcagtataacgtgtctacatgcatcaccacatgataaaaaacgggatcatttatgatcggtttctatctcaaataatttctgaaagaacggcattcattcaggatcgattggaacctcacaatatctacctcacttatttacatcctcattattcaagcttgattcgtctaaataatgttttgcttcacgtgaatgaagctttaattctgaaaagcgaaatatgtggggaagggtgatgagaacaacagagcaaatcggagcatttaatcctccaaatccagccacttccaaattaacctggactgagctgagttctagaccatatatatatcgcgctctcgtcattagtcacgaaactactgttcgtggagtcatcttagaccaactgaacgtttcttgcaaactcgaccaactgaacaagctagtttaatcaagaagcctaccatggaaagagtaaaatatagatagatcaagatcaatctcgggacccaattaagcttggctaatagtgctcccttttctccggaaagctcagtgcacagcacctgcgatttcgacgtgtcatggccgtgagatctgccgtgccggccgcctcacgctgacgacaccagctctagagctcgatgtggctctttcgtgccattacgcaagtactgatcgtccctgtagcgagataattaccatggcgccttgatttgtctcccgcttcgtcctgggccagtggttccacggccggtcgctgtcgcgtagatccgctcgccgctcggtcggacagtttgaggttgctctagaaccggccgtgcctgctcgatcgcgagctccgtgcgtcacggtgttaattgcggattgcgcggggcctctgcattggcgggctcccgaccacacgtcgcgggaccgcgcgcgcgcgcgcggtggtgaacgcgaagacgccctggtcgtcatgccatggcactatggcaggcagacgttgcgggtgatcgggcaaccgcgatcgaaccaggtgaggcggcgagcgcgcgtatcacatggacgcgatcgcgaccacacgggaagccgtcgccatcagccgctgcatggagcgcgcgcgcgcagcgttatccccagcgcaacttgcagctagcgtacgtggcggccggggcgagccgggaacaagtggtggccgcgggcgaagcggtgcaccgaccgagccgcgcgggttcgcgtcgtgcgcgtcacgtacgctgcgcgcgacactacgggatggacccacgggagagcggcgccaatatgatgtcggtggctggacagccggatgatgggcatcttccccggccccgtcgccgtccgcgtgtttccctctgagcgccggccgtcgctgtcaaggaggagcagagctaggcgtcgtacaagatggctccgaaatttctcttttcgcgcacgcgggcttgtggctccgcaggtgatgcccgatgcaagttgccaatggcgatcgagcgtgatggggattgatcggtttaggatcaggggctccgcatcaatcatccgcaccgacttttgtgcaagttggtacgatcgaactacttccgcctgtcgtgtttagggagagaaggtccaggtgaaaatagttggaactgtttcgtgcaggtagcctcttgtgcgtgtacgtacttgcttattagcttgccaatcgtatggactacggatcaagttaagttgtgtgacgtacagctcattcaaactttgcccacattttatacacatggatgaaaaattatattcatggtttagttcaactcttcttagaacactttgacctggtcaggcaataagctacggtctgtgttggagacatgtcatgagtgccttcgcccgaacccgccgaaaccattgggaacctgaaaaaacgaccggaagccaagtcgatggaaggcgaagcccatggtgaagcttgaaggcaaggcgcatggtgaagcttggaggcaaagcccgtggcatagcatgaaggcaaagcccacggcgaagcataagggtgaagcctgctggcagagggggatgtagcctcccttggattcggcccaagaaggctgttcatcacctttgtgggccgggccgaggaggctgttagaaggcccacgacttaatagacatcggttacccctgtagttgtcaccatcataagggcatctatctatctatctatctatctatctatctatctatctatctatctatctatctatctatctatctatctatctatctatctattatattattaagatagctcgaaaaggagacaccacgttcgctgtggaggctagaaattcccacattaatcggagaaaaagaaaaaaaaagaaaaggagagtccaagtagaaatacaatctaaaatagctgaaatttggaattaaaaatcagcaatattgaaagaaatttccatataagaacccaatacgagattaatcaaaattcaaaataaaaatgaaataaaatccaaaattagaaaaggaaagaagagtccaagtaggaatacaatttaaaaatagctgaaattcgaaattaaaaataagcaatattgaaagaagtttccatataagagcccaatacgagattaatcaaaattcgaaataaaaataaaaaaaatccaaaattagaaaaggaaatgagagtccaagtaggaatacaatttaaaaataactgaaattcggaattaaaaataagcaatattgaaagaagtttccatataagaagcgccaatacgagattaattaaaatttgaaataaaaataaaataaaatccaaaattagaaaaggaaaagagagtccatataggaatacaatttaaaaatagcctaaattcggaattaaaaataaagaatattaaaagaagagttgaacccaatacgagattaattaaaatttgaaataaaaataaaaataaattcgaaattagcaaaagaaaataaaagaagagttaagtaggaatacaatttaattaaaaataagcaatattgaaagaacaatccatataagaacccaatacgagattaattaaaatttcgaataaaaaataaaataatatccaaaattagaaaaattaaaagagagttcagataggaatacaattttgaaacgactgaaattgaaaataaaaaatacaaatattaaaagaaatacggtattaactaaatttttttaaatagagtaaatttcacaaaactgcagatactataaccaaattattacaaaactacagatttaactcggtgtatcacaaaactacacatttaataccaaatttatcagaaaactacacatttaagatgaagtgtcacaaaactacatatttagtaactaaattatcacaaaactacaggtttagaatcaatttaatcacaaagtattgatgtttatagctccaccataaaaatggtgctagggatttaaactccaaaagttatagttttgtgataagttcaatattaaatatgcatttttatgatacttaatctaaaatctgtagtttttgtgataaatttggtgctaaatatgtagttttgtgatacaactccttaaatctgtagttttgtgataacttggtcaaaatacctatagttttgtgaaattcactcaaaaaataaattctgaaattagaaaaagaaaaataatacttcaattaggaatacaatttataaataactaaaatttgtggtaaaaataaagactattagaagaaaagaccatctaaaacattatgacgagataaattaagtaacaggtctataaaggagtagagtggtggcggttgatatgacatataaaaaatattaataaaacaccaaatagaatcctaacgacgattaaaaggagggacgtcaggcaggccgtgaagcaaacaagtaaggcagttgctgggacttctagaaagtaaaaaaaataaccccattgataatcatattcgatttttaaaatcttaatgacaataaaaaggagaagcagagccgccgacggctgacgggacttctagaaaataaaaaatgaattccaacgatagttatgttagatttttagaatcacaatgacaataaagagtatgcgacggacgggtcgtagaggggtatagtggcatcgtttgatgggacttctaaaaattataaaaaatgaaactgcaagtccaatttttaaaggttcggaacttccaaaaagtaaaaaacccaatgataatcatgttcgatttcaaaatctcaatgacaataaaaaagggaggcagcgggcgagccgtagagaagtataatggcaaagccgctgatggtttagccggacttctagaaagtaaaaatgaacccaaacgataattatgttcgatttttaaaatctaaatgacaataaagagaagaaacagtggacgagccgtagaggagtataatggcaacgtttgacgggacatctagaaattataaaaacgaaacccatcgtgacaataaactctaaaaactataaaatccaatttttaaaggttccaagaagaatgaatagaaatagtggtagatcgagcaagcaaataaaaaaaagatgatgtaaggagtagcaactggtgtgaatttttaaaactatatagttagaaacacgaggatgataaggtttggtcttttaaagtcttaagacaatgagatagctatttaataaattttaagtaaaatcgtacttaaaaaaatatatgattttgtttgggtgctagccgcgcaattgcgcggaccatctagccggttcatgtaaaattccctgcaaacaataaactctagagagtaacatgttgtataaatagccccctagagccatataatggggatgtcgaaaactttattaagtcaatactactttattgttcaaacacacccaactcaatctctcgtcctgcgtgatatgacgcagttgtcctttgacaacagtctgcatgcgtgcagacttggtaatctgccacatcacacccaacacgccggtcgggtcaaggaaaaacgtggtgaggatcctctgcactgcagtattgcccttatcagtgacgatccatgccaagtaagaacggtcatcggtattaaacatgatgtgactacggtgaaatcgaaactgctggcacgcacatgactacaggccccgatgatgcaccaggagtgagaaacgctcaggggtctttcggctagctccacaagatggtgggctagacgatctgggttcgaagcctcatcctttctaattatttgatattaggtcattctctaatttttgcgtcttttatggtgcaccacgagtgatcccatagcgcactggtggagataagaatcttctacttttaaagtcacattattttatcactgatatgtaagcttgatgaatcctatacccacatgtaaataggcacgatgattttgataatagatcatcgtaatcctcagtgaagtgtcaatgtgtcattggcatcgtacgatgtgtttgtggtagtattgttggtgcttggctcaattttgcttgagggacttggtagttcactttagtgagttgagagagctgatataagttaaagtccataagttgaacactcataatttcctgagagatgggatgtttgtgaaataagtaaatactagtattgacaagataccatacacatgtttataagcttagtccactagtattgacaagataccatacacatgtttataagcttagtccctgtcacatcagatttttgacactaatttagagtattaacatagactacttacaaaactaattgcataaatgagagctaatctgcgagacaaattttttaagcctaattaatctgtaattagagaatgtttactgtagcatcacataggctaatcgtggattagttaggctcaatagattcatctcatgaattaatccagggttatgaaatgggttttgtctttagtctacgtttaatacttctaatagtgtccaaacatccgatgtgacatgtactaaaattttttagccccatctaaactccccttaggatggtctgtttgattgtccgacctagccaatagtccaggagatttttgttgatcgactgaacttgctaattgaaaaaaaaaaggatcggttaagacatttacaatatcatgtcatggcgaccgacctcgcgtgttcacatcagagccaaagccgccaccttgactgggagagatgtcttgcgggggcacgtgtgctcggtaaaaggcatttgagtctcaatgtaggagatgctctgtagttgtatagccattgcccgagaaaactttctctggacatattcaacctactgtgcattgagaaagggtgtcctcgatggcggttccaacctatgtgacattttctctttatatcacacaataatatttttatagtgtaaatatccttataggcacggacaatcttactcatgatcttgtccaaaaccaaacaagaaaagcttcacatcttctctttttccattaacctttatattccactatgccaagtgagcaagtcatataacatgccctgaagaggaggaatcaaaggtaccagtttaggaactggcataggctcgattcaagcgatgcaccgagcacatccacctcgagtcgtccacaaaatcaatccacaacaatcacagaatcgacatctcatatactcaacatataagatgtggatatcatacagaatcgtcatcgtccaaaaacatccatgaacaaaaccgacaaaaaaaaacatatacaggttaaaaataaaagggtatagaggaggacgcagaaggagagaaggttgacgccgctgcagctcaccatcgccgtctacccgcccgcctaccaccgtcgaggccggatttggctgcccttaagctcgtggcaaatagatccggtagcttccgaactcatggcgtcctactagcccatggagatgtcgaggaggggtgtccggtcaggaattccatgcgacgagtagggtggtggcacccagccgtccaccaacgtcgaggcctggtctaggccgtcgctcgccagctaggaagagagaagaggcgagggctgcactgctcgctggttggggagagagtagacaacaaccgcaggtgataggggagagaggagacagcggcgaggatgctcgatggggaggagaagaaaggagaagagatcgaggacgtggagattgaattaatgaataagatcgaggggtgggaataaaaaccaaaggtgctccatgcggttcgtctctgctcggctcataataagtggtgttgggttatttaaaaaaccagcacatataaccttttataggtaccggtttattataaaatccggtacaaatatttaatgtgccggatttttaaataaattgacaactatgaaatgttataagtgttagattttaattttagacttatgtgagagaggttaggaggatgggaaaatgcatataaccgggtttagagtttttggcatctataaagcctagtcgttccgtattatgttttacagtactgtaagaaagatggttcaagataacctaggatatattacattattaaaacaactttgaaaggaggcaccatgttcgctgtgggggctagaaattcccacattaatcgggaaaaaagaaaaaaaaagaagagtccaagtagaaatacaatttaaaaatagcggaaattcggaatttaaaataagcaatattgaaaagaagtttccatataagaacctgacacgagattaatgaaattcaaaataaaaataaaatacaatccaaaattagaaaaaaaggagagtccaagtagaaatacaatttaaaaattgctgaaatttggaattaaaaataagcgatattgaaagaagtttccattaagaacccaatacgagattaatcaaaattcaaaataaaaataaaataaaatccaaaattacaaaagaaaaggatagtccaagtaggaatacaatttaaaaatagctgaaattcggaattaaaaataaagaatattaaaaaaagagtccatataagaatccaatgcaagattaattaaaactcgaaataaaaataaaaattaaatctgaaattagcaaaaacgaaataaaagaagagttcaggtaggaatacaatttaaaattagctgaaattcggaattaaaaataatcaatattgaagaagaatccatataagaacccaatacgagagtaattaaaattcagaataaaaaaataatatccaaaattataaaaattaaaagagagttcaagtaggaatacaattttgaaacaactaaaatttaaaataaaaaataaaatatattaaaagaacacaatacgatattaattaaattttgaaaaaaaaattctgaaattagaaaaagaaaaataagatttcaattaggaatacaatttataaataattaaaatttttgataaaaataaagactagtgaaagaaaagaccatctaaaacacttgaggagataaattaagtaatatgctgtcacaccccgaagttctttcccaagcctaaattgaatttataattcacctgagaaaataccggtgtaaaagcaagagaaaaccctaataaattaatgcaaataataatcggatttggcatgtggaatttttcttgagttctacatgtcgaaatacactaacaagatttttagtggaattttcaaagctctcgaaataattttaatcaattaaaattgagcacaggcaatatttaaatcctggaaattcctttcttcctttttcttttttctttttccttttcccttagtgggccgccggcccattccccctcatctctccccgcgccttgctgggccggccggaggccacggcctggctcagcctgcgccccttcctctctctcggggtcaccgacaggtggggcccacctgtcgggtcctcccccaacctccagccgctcgccgccgcgcccgcaaccgccgccgcgcccacgtccccgcctcctccgggccacgtcggccacgcccgcgcatgcgccgcgtctcccgcacccacttccccctctctcccgctcgcgcccgcgcccgagatggccgggattcgaatttcgaatcccgcctctctttccacctccacctcccccatgtcggccggcgaatcccgcccctaccggccacgtccgagttccccctcctctatttaagctctgccgccaccccctctctctttttccccatctcgccgaactctcccgagctctccatcgctcccgtgccgtgcacccatccgccgccgccgctcccgctactccggccgccgctaggcgccgctagactcgccgccgcaccgcgccgtcgctgccgttgggttcgtgtgatcgaggtccatcccgtccgcacctcctccatcgaggtccgtcgccggaacccgcatcccctcgcactccagtgagcaccacctacaccgccgccttcggccatggtttccgatcgccgtggtccacccctctccctctaatctctctcttttcctctcttatggcatctcggagctcgtccgtccgtcgccaccgttgtcctcccgtggctcgtcgtcgctgttcgccgtcgtcctcctccgcgccggccactctcggtgaggcatccctcctcctctattcccctccctctccttcctagccgcgccgggtcgagccgccgccccggtcatgcgccgccgcctttgcgccaccgtctcccgccgccggttgccgtcaccggcaacgcgcgcgcgccgccgcccttgccatggccggccggccggctttgtgccgagccgagccgagccaggacgccgccgcaccgtccgatcggccccgggccgatccgggtcgtcgatcccgtggaccacccgcgtggtcccagtccatggtagactgaccacccgtgcgccgctgccatgtggggcccgcttgtcggcgccaccccctctctctctccgggatttatttattgcgcaataaatcaattaaggatttttccgtttatagtaaaaacatagtgaatcttctaaaattcataactaattcatctgtgctccgtttaagcccattcaagtctgagtaaatcaagaaaaatgtgtagaatccattaaaaatggttttgttatctgtttcagtagtcttatagcctgtttgtattgtttgccttgtatgtcgcttagattttggttcttccgacactccggtgtacttcgagatagtcgccgaggttcctccagcagcagagcaaggcaagtcatgcctgtcacttgaacatgttgatcctatattgcaaatgctctattgtttttcttcaaatactgcattgttttataatgttactatgggatgtttacctatcgttacagccatgctatttcgtaccatgttcctttgttagcttgggatataacatgactagagattggacttggaattgcttagccatgcttagttcaactagcacacaatgagggagatcctattaatgtttagactgtaggttctaatggtaatgttggattagtgccaccgttctggtgctgtttaattaaaatatattaaatggtgggctgtgggtgcatggtgttgctagtcgcgcccatggcacttaaggaccggttcgcgggaaaccctagaagaattcctcgtacttaccacaagccagcgtggtcaacggctgggcttgtagtgtagctttcctctagctgacgcatccaggcaagggtgggcgtgatggagcggggcgggccttgcgacggcctctgtcgcttccagattcacctaggcacgagaggggactgcccgtcgaccgctggggacgggggtgaaacctgaggtgtggtgtgcttggttagagggggtcatgcgaagggtcctgtcacggcctctttccggtatgtcgtggtggcatgtcggcgcacggaaacgtgtcgtggggctgtgtcttgtgggtacagttgtacgcctctgatcagagtaaaactattcgaatagccgtgcccgcggttatgggcggtcaaccagattcaccgtgattagtctcaccctagtgtagtctaatgaaattggatagtttaggtggatggttgggcctgttgcaacgtgggatagcgttggacagtggatgattaatattaattaattactacaactgtttacttctttcaacttctgtttataaatgctcgctttatgcaaatgaaccactctagttctcctttgataattctctgcatcatatccctattccggtatgacttgctgagtacagtgggtagtactcagtcttgctctattttccccaaccctagagtacgagtatgtgtcagatggtggtttctctgaggagtaggcttcatccgtgccgtcgaggatgcctgtggagtggtgttcccgctgcagatcgagtcaaggcttagctccagttatcttttgttttccgctgcatttatgtatgactctttatgatgtttgtaagacgtggatctgaatgtcaacattgtcgtttgtgtaccccggctggtcctggacggggattttaatgcacattctgcttgggattccattcgggaatttctgggcgtgacatatgcctataaagtagtaaagtggtggcgattgatacgacttataaaaactgttaataaaacaccatatagaatcctaatgacgattaaaaggagggatgacaggccgcccgtgaagcaaacgggtaaggtgattgccgggacttctagaaagtaaaaaaaataaaccccatcgataatcatattcgatttttaaaatctcaatgacaataaacaggagaagcagcgggcgggtgtataggactatagttgcagagccgccgccggttgacgggacttctagaaaataaaaaatgaattccaacgacagttatgttcgatttttagaatcacaatgacaataaaaagtaggcggcggacaggccgtagaggagcatagtggcatcatttgacggaacttctaaaaattataaaaaataaaacccaacaagacaataaactctaaaactacaaggtccaatttttaaaggttcggaacttctaaaaagtaaaaaaacaatgataatcatattcgattttaaaatcttaatgacaataaagaagagaggcagcgggcaagctgtagagaagtacaatggcaaagccgctgacgatttggtgggacttccagaaagtaaaaatgaacccaatcgataattatgttcaatttttaaaatctcaatgacaatagagaaaagagacagtggacgggccgtagaagtgtataatggcaacatttgacgagacatctggaaattataaaaacgaaacccaacatgacaataaactctaaaaactataagatccaatttttaaaggtcccaagaagaatgaatagaaatagtggtagatcgagcaagcaaataaagaataaagaaggagatgacataagggataacaactggtgtgacttttaaaaacatataattagaaacacagggaggataaggtttggtatttcatcaaagtcttaagacaatgagatagctatttaataatttttaagtaaaatcatactaaaaaatatatgattttgttggggtgctagccgcgtaattgcgcgggccacccagctagttaaacatatatatccatgatgatcgttgctgcggcagtgctaatttagctgtctcttgcaaacgccattcattttttttctgttttgtccatgttgatgcatcttaagcacgatatcaaaagatcgtactagctgcttagttattttggtaggttcattccgattacacgttggacatcaaaaggtagcaccgtcatcatcccatacgtacgcgcaccaggttgtccggttcatgccatttgttcatgtccgttgctaagaatgtgcaatcttcagaaatagcaccaaacgcgctcagtttgaacgcatatcttggtagatatacatgcatacagctagcacacgaatggcctaagttcgtacacgacgcaccgtgccgctcgtgtggagacggcgccgcgaccaaatccccatccacccatcgaatccacgtacgacttccattcgcatcgcccgtcaagaaaggaggatgcgtgtatctcccgcttccacagtgcacacacgaccgaaagccgtgcatatccatctcgatcgatctccctttcaccgcggcgcggccggccggcgcggtagctagccgccgaatcaagaggagcccgttcgtcgcgtccggcgagctaagcacgccatcgcagtgccgccacgtacgcgctcacggagagagaaaaaaaacggctgcaatgccgatggcaacgctgatatttccgctctcgattcggtcaagccaaattgccaaatacagacatggccaacctccccacaactctaaaaacatcaccgtaaaaggaggagcatagacaccggcccgatggataggcctgcccctaagtgacagggaataaactaaaaatccagagacttttcgacagcttcgtgacttgtctgtgtggtctagctgagctgggagatgtgatctggttttgggcctaattaacgacgatatgtgctatggctgcctaggcatatgctacgtcgaccacgtcccagtcggtcggcgctcggtggccggctcccattggcgccctcccgagattgccggagcttgtgccccggccggccgtggatgttaccggccgttcggcgcacgacgcgacgtgtggaactgaatcttgcgtgcctgcgaggacccggctcgcccggccagaccggcggcgagggcgccaccacataggtggtcgctgaatgctggtaagaactaaaagtgatcgagagcgacgtcggtcgcgtgcagaatcacggcgatcagggttcgtcttggcttcgtctacgtacagctgccgtaaatcctagatgcaaggatatcatccgatcgatcaacgaaactgcggccgatcaattgaaagccatgcatacatttaatttcgttgtttgcgtgcataggaacatgcagcgttgtatggatggagtagttgcatggctagctctctctgacatcctacatgattgggcagattcgatcgatcgagatgatctatgtcactgttacacagtgcagtaccaaagatcacgtaaatatcaccgcacgcgatcgatcgatggcgccaaatgaacagttaattaattgcagatgagatgatataatgtggccaccaaaccttggcggatttaatattcatcgtatcacgccgcctggataacgatatcctcattggcatggtctgaaaattctgaatttgacagccaaaatgcatatagccaagaacgcaaaagctgtgaggtatgggggaggagaagaaaagcagtgatggacagcacgtcagataagtagataaccactccgaccgaagaatccaacaaaacaaaaaccgggtcgaatccggaaaaggacactgttctgatcgatcgaatccttgttgccggcggcgttgcgcagcacaggatcaggcgatcagcggcgttttctagaaatccatctgcgtggctacactatacagctcagtttagctattgctccctttctcaccaaagttcaatttcttcttcttttctgtttacggtccacagtgccccagaatttttccacggtccagaaaattgctgcacgtacaggagtagagtagtaggtgagttgttgctctgtcgcgaccacatttccatggcattgctactttgctatagctgcatcgtaagcttgcactagaacattactgccaatctgccatgtgccaagaggccaagacgaataggcactggccggggtggtaggcttccccacgtatagcaaaagccaggccacattgcgggttggaacttgtgctcgttttgatccggacgtggagtcgccatcgcagaggatcccgaggaggatgccgcgaagatccgcgtgcgtctgacacagattgtcccggcctcgccgtggcgccccgtgttcgttcaatcattctgacgctcttggtggccgacgcaccactgcttcaacctgctccgttgctgcaggcagtgccctgtgaaggaggccagaataccggttgctgatgcgtgaaatgatttgcgaggtttttgtgtgtttgcattttgcagggaaaaggattagggcatttggtggtgactggtgtgatccaatgagtacgttggggggaatcagatgacggatcggttgtgtgttcctgcttttgacggccaaagtggttggtatagaaaggacgggggtgatagggaatcagggatccagcacttaccaagtagctagcgatggcatgcagtaagaacatgccatttggttatctacggtcaggagcgaggtatggcttgcgccaccctcgccctacgagtcctccatcactgacatatttggactgaaattaactgagtgaaatgcaattttcattcattgatactgctcgtctaaaccgatatgacgctagataagcaaggataaaacaactaatatgtttagactgtaaggagtgaaaagtaattttcattctttacctctagtctaaactgatatgtgccgtctactcttatgagaaaacgttgaataactaaggaaacttgatatctttttttatgctggacaaacaaagagaggtttggattgaaaggactgaaaatgcttttttttttacctctttacctctagagtaaattgatgtgccctcttcctttctaagaaaatgttgggcaataaagaaaaaaacttgatattattttcttcatgctggacaaccaaggagaaacttggtatcatcctaatgacaaaattggtgtcatgcactctcaagtaattaagaaaaaaaatgagtgtcgaaagccaaacattgcaccatgaagttataaggtcacacaaccctactaggggtggataatgatatcatctagtttggatcgttatctttgcaagatatcttggcttgtttcgttaaccttaacaagctaaatgtctagctcggcttaaatcacaggctgactcattaaactcgttaggctagcttgtttacgagctttatctaatttaataaatccatgccaccctgctagtataggtgtttagcctcggtccagttatgatataagaccattcattcacacattcatattgttttgagcacctgcactattgcatcgaacaaggagtagttgaatcgtcagccctattaagcgcctatcgagcgaatggatatcctctattgtaatgcacatgcagtatatgtcattgacatgtgggcccgaagcatgtgagacccacatgtcagtgacatctactggaggtgcactacagcagatgatttgcgctgctaccgagccgctagtaagttcatctcaattatagtttaaaaaacttaaccagaccgatggttcaatcgtgaaatttaaaccaaaatcagtgcttgccttggtccagttgtgctctactaccgttcatgcattcattgagcgcctatacggctataccattgtgtcgtacctaatacaattgaaccatctgcactatttatcatagtatgagcgtctgtactattggcgttgtacctagagcgattgaaccatttgcactattgaatgggccagtaggaaagcacaacatgcatccaacatatttttaaggctagttgtgtccatgctagaaggttgtaatagttagtgaaccccagtccaaccaattagttcaccgattgaaccactagaacaatgaaccaatatatcgactggatcactcatcagtcggtttaaacttttattttccagaggcaatccggtttgaacttatcctcttcttggttgtgttcttctctcaactttcccaaactactaaatggtgtgttttcaaaaaatttctatataaaagttgtatttaaaaattatattaatcaatttttaaatctttttagtaatacttaaattaattatacgctaattcttagtttgatttttcgtgtcagaggtaaggttgggaactcagccttagccttattctagatgcggattctctttattgaggcggacgggaaaggaagcccactaccgaaacaacgcaacttttgatctgggcctaattccagaacatatctgggcctaactcccgtcagaagcggtgatcaaattaggatctgcggctcattttttagctcaatacaactagcacaatttcccatgagtaacgaattctacagataaggtacatttcatgggcctgcgggcctagctacgtacgtctaagttgcaccctcagggctgtcgagaaatacagtgccacacgtcgagcaataacttaatttgtttttttgtttgttttttttccccggagagcaataactttgtgtaaatccggttatatcgaattcaagtcctcgatcagaaacatgacgccacttatattcggataagagccaacgagtctgttggtaattttttgtgacaagtcgacaagcacgatcgcaacacctaaacgccttgcggtgatatgtagtcgccaaccacctcgatctagccaaagggccaatgaaccggccttgtcccttaaataggggttggtcttgccctctacagacccttctccacgtccaattcaggatagaaaccaaaggagacacgaaacatgtcttcccgagcaaggaaacccgtcactttccaaactttggcaattttccactattttgttcataggtgtcaaatttgggtgtaaacagagtcatcacaaacgggtagacgccagccgtgtagaaacgaaacagctgggtatacgtaacatagagctaattctgagctcgatcgacccatgcatcgccgtttgatctacccgcgtacgattcacggccgttcgattggatgcacccacccccatatagccgaccctatcatagtttctgtagccggtcagagcaaggaagcatgcagaagctcgaccatgcatccgcgaactaggacaagcattacgtgtcggctggatctgtacatggatcagatgctattgaatggcaacggtatatatgatgtgcatcacattggaacgaagggagaaacctgcattgtttttttatcaagcacggctgcacatatattgacaacgaaggagtagataaacctgacgacggtcaatggatcggatggacttgcgcagcaggcccaaggccgatataagagacggcttaatttgctttcgttttggatgagaccaagcagtttcatgctggagaagcccagctccaatggggcaatccggaactctttatccagtccgctcttcgtcatctccaacatacgagctaggtacaatgcaaactgcctaatgttctattcattttctgatctgagcgatctatatatatgacaagtctgaaaatccacatacgtacgtacgcgcgcgtggacgatcgatggacttatccacgcaaaaatgagattgaggtttgcaattttgcatgcatgcatgcacgcgtcgttacgtcggtactactactacatattgcccagatctttccaacgtacgtgcggcagccttcgttgactcctattatttgtttcattgtttggtgtacgtgtctgtgttgcaatgcattatatacggatttgcatgcagttgatcgccggcgggcggcggcgagatcaggctgaatggtgaacccaaccgccccaacgacaggccgccaccgtagtatatatgtccgtattgtttgattactccctccatactcaataaagaaagtcatttaggagaacgatacggtctccaaaacataactttacttcttatttctataaaaatatttattaaaaagtgatatatgtatatttttataaaagtatttttcaagacaaatctatacatatactttttatatttttaaactcaataatttgagatttatttatgatttatatttttaaggtttaatttaaatattgttttaaacgattttctttacgagtatggagggagtatacgatacgtaggtgcgggcgaaacattgagggagagggcaagctgtgcctgtgcgtacgtcctcagcatgtaggcagactactgtgtacgtgttctcgttgtccgcgtggctagctagacgtccgccattcaccgcttctcgacctcgatccccacctgcatttactccgaatgattcagggatcggtacacgcagctagctagtctagtacacaagcctggaaagaacacagtagctagctagccgcttgggtaccatggtgtaaatcagaatgaattattagcatataattaattaagtattagtttaaaaaatttaaaaatatatgttaatacgatttttcgaagtagcttttctataaaaactttttgcaaaaaatacaccgtttaatagtttccaaacatgcgtacggaaaacgagcaggtaaagttggaaaagtgtttcaaagaacacacaaacttaaggccttgtttagttcccacacaaagaaatttactgtcacgccatgaactagccccgagcggaactagcccgtgacgctccaaattaacctgttaatcgataccagtcccaggaaacagtgctggtatcacaggaagacagtatatcacagcaacagaggtctctttattatagagtaggagtacagtcatgttgggctgcggacagatcccgagctcacaactacattacaaaagggaaagcggaagccaagacttggaccaaacatcacaggcgcgacttgggaactaggcagaaaccctaaaactcatcgtagccgacttgctcctggaagaactcctcgtcagcgggatccgcttcatcttcttcagcaactgggggggggaattatttatatagagcaagggtgagtacgggagtactcagcaagccatggggattaagtgtttaatgcaggcttcaaggaaaggctgttgtttttgcaattgattttatttaaactcttttctgaaacaactaagtgagtgcttctcaaacgacacggataagacagtgcgtctcgtccgatcggagtatgtgcaaggtatcagtcttttgaattgatcaaggttggcatccggccaacagctttcaaacggccacccgggcctggctgatcccatcagccgcagattttccaaacatcgaacccaatccacaacagcaaatttcacaaagcagtagtcaaacaaaactacgctaggaatcacctcacatccgcccatgaccgtgggcacgactgttcgaacagtttaataacctctgcagagggggtacactttacccacacaacattactgacccgaatcacccagcccgtgcagaacggccacgtctggtgacctaaaggttttcatgacaaggcatttcgaaagccgacacagggttgccatatgccgacgagaggggttccagaccaacaacaggttaggtcccagaccatactgtgccaggaagcccgggggttctccccgacaccaccctgttgaatccacatgtctctcggcatcaaggctcccccgcttagcaatttactcagccaggggtgtcccattccatccatgtggtcgcacttgtcttatgttcggatgaaattccaaggaaacggtccttaagtgcaagagcgggaaaccgtacacccggtacgttccccggtccgcgattttagaaattcatttagttcgcgagcaccgacctagatgtcgggttttccaagtcttttgtaaaacccaagttttacccaagatgtttctcagattttaagtttgaaggcgaccgtcgatactcgtgcagagtgcacgattaccgaggcgcaactaggtggttacaagggaacatggtataacaattaacaaaggaataatcagatgcaataagttaggtaggcccaccggtctgccttgcagacggagcaaacagattaagtgcaatcctatcaatgcataatattttgcaagcaatataattaagttcaaatataggctcaatattttcaaaggtggcttgccttgctcgagatcttgagcttgatcctcgaaatcctcgcactgcgagtcttcgggctccgaaactacacgtgaaacgggacaactcaacaaacggcgaaaataaagccctattattgacctctaagtgggccattagatagatctcgagatttgaggaattttggaagttgaatggagtcaaacggtcttacggttgggaagatattgaatttctaagatttttggatttttggtctaaaggaaaagggatttatttaaatcctttttgaaaagaaaagaaaagaaaagaaggagggaggggaattagacttccctcgggaggctatggcgcggcccgagggaaaggggcggctcgggcgagcttaatgggccggccagcccagcaaggcggcccaaggcgcgcgcgggcggggaggagagagagagagagccggtgggccaggtccatcccgcgtggtcccaagtgggacccgcttgtcaacgactcggctcaccgtgagcgaggtgcacgcggggcgtgctagggtttggggaggggggcgtggcgcacgcacgcggctcgcgggggacgcgggtgcggcgggcccacgcgcagcctcgcggctcaccgtggaccacgcacacggggagggcagaggggagcggcggaccggggtcggctcgacccggtcgcggccgaggtggcaccgaaatggcgtgttcgtggcagccacgtgggccggcgagaggaagacgaaggcgccagccgcgaatggacggtgggcggcggcggtttctccgggacgccgtgcgacgacgaggggcgacggggtgtacaccggaatgacaaggggggacgagagggagcgggccaacggcttggattcgtcggaggatgctcaacggcggcgaattgcggtggcggcaaccggcggcgtgaaaagggggaaacggcgacgaggtcacgaggggctgattcccggcggtgagagcatctacacggctacagaaatccatcccttgagccggattaggggggaaacgcaccgagggaggctggcgacgagaggcgcttcagagctcgggcggcgacggtggcgagcacacggcgagcgacggcagcagtcggggcggcgcgagctagctactggggtactacacacactactaactgagtctaatgggaggagatggatcgaggagggagaacgggggaatgcactaccgagacgaggcggggcgctgtgacgagaggccgacggcacgggagtgatctctccggcctcgggccggggaagaggaagaagagggcgcgcccgaagtccccttccgcgtcctcgttcgtgccggctcctctgacacgcgcgacgacaaacggcgacggcgaacagagcacgggaggcggcgacaatggagtggaggcgatgggacaacgagaggagaagagagggagggcgcctgggctttataggatggcaatgtcagtttgggaaccgacctagggcggtcaaaggagagggctagcgctcggcggtcgcggccaaaacgccgacagggagggatgacaccggcaggagagaaaagggaaaaaggaggagagaaagggggcttgcccccttgccactttggggaaaaggaggagggagagagggcgacgcggcagagggaggaggagctctgcctctgtcccttggaggctagcgcgcggagtggcggggtcgggttgatgacgacggcgatgacggccgggcggtgtggagcggagcagcgacacgggcggcaggcgcggcagaggctgacggcggcggcgaccaggcggtcggccaccacggcgtgcgcgcgcgggaagcaacgggcggcgcggctcaggcacgcgtgctggctcgcggggccgagcggctgcgcggtagggcaacggggccgggcggcgcagacggcacaggcgcggcacgggcggcgaccacgcgggcgcgcgcgcgcgaacaacggcgcgcgggggccgatttcgcgggcggggagctcgccagggatggaggcggggagagggagagcgagggggggcgctcggcgcggctctcgcgcacgcgcgggcagagcgagggagagagggagagatggggagggagggagagatgggccgagaggaattcggcccatcgaacccgagggaggcaaaatagacttttgcggagggatttgatttgggaaggatttggattcgggattgatcttgacgatagatcggggattgagatccggaaaggcacggagactgacagcaagcgaagaaacaattttcgcaattagggtttttaggaaatacaatttcccgctaggcgccacgacggaacgggcgctacatttacactatatcacatcgaacatttgaacacctgcatgaagttaaatatagactaaaaatataactaattgcatagattgcgactaatttgcgagacgaatattttaagcccaattgcttcatgatttgacaatgtggtgctacattaacttttgctaatgacggattagttaggattaataaattcgtctcgttgtttactgacggattctgtaattagttttcttattagtacccgaacacaccatgcgacaccctatataacacccgatgtgacacgtcaaaactttacacccctgtatctaaacacccgctaatttagtagccccaacatcttcagcttttctaggttctcgctagctagttactcaccgactatttgttagaatccttccctagctacgatctctgtgtgacacttgcctagcagttgatatatgttttctgggatttgaaaaatgtcaaccgcgcaaaatgtcaagcactgttgaagcaggaatatacatgcctagggggaaaaaggagaaattttagaaaattcatgcaaaagtcccgaagctttttttttctaaaagaatgtataattttgggggaacgaaaattgaaatcttcaaaattttgtgaagcgccaacaatgtggtggttagggtgggacattcggtcagaccaactatccaatctttgttctcaatcttttgagaaatttcggtaatctaaaaagtaaaagatcgaattaactaattcgttatcggtatccaatatgaccgaaatttcaaaagagatccaaaaccgcacaaatccagaaattcacgcaaatccaaaaaaatcacacaaattgccattggagtagatgatccgaggaggtagacagagagtacgtaggctgtcagcgcagcgaccattggcggcggcggcggcggtgcccatgacccaaccctcaccgtgcgccgcttagcattggccagtgtggtggcgtaacatggaggaggagctgtaggcggctcggcacgctggtcatggccatgggcggcgaagtgggagatcgatcatttcaagtaagaatctatagcaaggcaaggatatactcacttgaaatgatatgtgagttaggtttgcatatatacatcctataggatcgaacacaagcaaccaacccaaaaacttttagcggaaataaaagttacccttaaattgatggaaatctcgacgtagttttatcgccgccggtcggaccgctcggacgccgccggttagaccgccggtatgtcgtcggttagaccaccgaacccgataaaacataaatcgaagaactctcaaaatagatgacaactttattgcttctctgtgtttacaaagtgcaacaacagcactccttacaaaaatctcgactaaactcgaaaccctaactaaactatcaactccatgctctgaaaagcgatacagggaagtcacacgctccctctctatttataccaaaaaacctcctacttaaagtaggagtagaactcctagttccaaaacctgcagccacaccggccacagacaagtcggactctcctcgccgtcacagcagcgacacgtcctcctgttctcctgagccgactcggcttgccatagccccgagccaacctatcagatcaacacaaatgcatgcagccacatgcacgtgtacatgcatccacatacacgcatacacgccactgtgtacacatatatgcacaatacagtaacaccgctacagtacctcgagtactgtagcaaccatataatactccacaattttcctccgcgaacaccgacgcttgcacgcacacctcgtgaagcccgctgcgaagatctcttccacacgatgtccatccatcatgtaccatctcatatccaacttcgtcacccggtatccttaaccgtctggaccttaactcctccctgagtctagtcccgatccccaccgttgaccgaagttgaccttcaagaatcctgactttagtcaccttctcacatggtatcccgaccacactagacatctgttcctccctgaacatagtctcggtcctcaccattaaccaaggctgacctcaagtcacctgcacacaatcagacaaaacaaccgtttctgagcacaaatatcacaacctgacccacattagtcacacgcacacacaccaacatccacacatcttttcaaaccaattcatcgaataaatcatttgtaaagccaattgttcatcacaaatattaatcatgacaatgatttcacaattggtatcagagccaggctaggttaacatctctggcccgatggacatgtgtgaaggcctgatgaaccgtgggtgcctgcggggcccgtatacctgatggaccgtgggccggtgggggcccggatacagtgaaagggcggtgaagggctgagggacactaatgtgtgaaggaggagattgttgaatagtcccacattggttgtagaagggcaaatgacctaagatataagtggggagcccctcatctcaatggctagtttctgaggtgggaaaggccctttacgacttctgtataaccgtgaaagaaaatctcaggattttaagaattctgttccgaaattctgagtcgttggtctccatctgtgtttgagtggatatgtgaatgaggtttgcatacatcctgtgttagcttctgtataaccgtgaaagaaaatctcaggattttaagaattatgttccgaaattctgaaccatgcatgctgacaggtttggcatgcccctatggcggcgaaattaagacagtgttgcgcgcccttatccgtttgattcgagccaatccagaaaaccaggagcatcccggccgtctatccccgcactactataaatacttgcccggagacgatttcttctccacgcagcaagagccgatcgatcattgtccaagtctccaagcgatcagctagctgacttgacgacgctgcgagcagcggcagcaagagagcagcagcacaaagggttcccctttcacaagtgtccggccggctgcacgtaggccatggggaagcaaatggccgccctgtgtggctttctcctcgtggcgttgctctggctcacgcccgacgtcgcgcacgcgcagacgcagatcctcttccaggtgctttattcatttcacccataaacgggcaagggggttcacctgtgtaaaattatcgacagcaagtcagaacggctaatataattcacgtacaaccgaatacgtgtctgtaacatttttgtgcagggttttaactgggactcgtggaagaagcagggtggttggtacaacatgctcaaggaccaggtgggcgacatcgccagcgccggcgtcacgcacgtctggctcccacctcccacgcactccgtctcgcctcaaggccagcaagccatgcatctccttcatctcgttacgcttctctttgtagcatgtccgtttctaaatatttgacaccattgactttttagcatatgtttaaccgtttactttatttaaatttttttgtgaaatatgtaacactatatgtatacatataagtatatttaacaataaattaaatgataggaaaagaattaataattatttaaattttttaaataagatgaacggtcgaacatatttaaaaatataacggtatgaaatatttagaaagggagggagtatattacgtgacgtaaagtgtgttacggccagtgtcttactgcaattatcagctgatctagctcatcaggcaattgacatgtatgcatgcatgtgtttaaatcgatttttcccgtgcatgcacgcaggctacatgccgggacggctctacgacctgaacgcgtccaagtacggcaccaaggcggagctcaagtcgctcatcgccgccttccacgccaagggcatcaagtgcgtcgcggacatcgtcgtcaaccaccgctgcgccgacgacaaggacggccgcggcgtctactgcatcttcaagggcggcggcccgcgcggctgcctggactggggcccctccatgatctgctgcgacgacacgcagtactccgacggcacgggccaccgcgacaccggcgccgacttcgccgcggcgcccgatatcgaccacctcaacccgctcgtccagcgggagctctccgactggctcaggtggctcaggagggatgtcggcttcgacggctggcgcctcgacttcgccaagggctactcggcggccgtcgccaggacgtatgtccagaacgccaggccgagcttcgtcgtggcggagatatggaactccctgagctacgacggcgacgggaagccggcggccaaccaggacggccagcggcaggagctcgtgaactgggtgaagcaggttggcggcccggcgacggcgttcgacttcacgaccaagggcatcctgcagtcggcggtgcagggcgagctgtggcggatgcgggacaaggacggcaaggcgccgggcatgataggctggtatcccgagaagg

SEQ ID NO: 61136 - DNA, 557 bp, Oryza sativa
aagaggagcttgaagaagtggtcgacggaaaggaagtgaaaactcccaaagcgaaaacgaagtcggcgactcatgaaattgattccatcgcgcttgttgataagaaactcgacgcaacccctacctggcgcgccaactgtcgaaacatgatttcggcaataataaaagggggtagcgcacgagaactaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggatggggggcaggattacaagatagaaaccttaaccaatacggtatcggtttcctaaatctggactttaggctgttccgtaatatacaaggaaacgtaacacccaagccatgatctgttacatattacatagatataagttatcccctataactagtcggataaccatgccgtgtgggtatggggtacccataatctccacag

SEQ ID NO: 61137 - DNA, 529 bp, Oryza sativa
tcctgcagcccgccgatcagctgtaggaatttggactggagtggatgggtacgacttatctgatggtgaaattttcctttttctaaagaagatgggtagcgtacatggtgatggtacaaaaaattacccaaaaaaattatgccttctgaaaaggatccttgaaaacctccatggaaatacgatggatgctgctgcttcatacctcggacaaccaaggggagaggagtagcatgctagcagccatggcagaaggtgcttttctttctagcctcgttgaccgtctaagcaccacagccttgtcggggatcacctcgttgtggggcgtgaaggagcaggtggattcactgattcacgagctccaggcagtggaatgcttcctcaaggatgccgacctgagggagatccgtcggcaagccacatccaacaacaactggttctggttacactccctcagagatgccgcctacgacgccgaggacctcatcgagagcgtggagctccatgaggggaggtatcacactctgaaccc

SEQ ID NO: 61138 - DNA, 894 bp, Oryza sativa
tcctgcagccctagcctatatggattaaaattctagacttgacagttgacgttagtacccgtatttatgactaattattctttcagtattaggcgaggtacctgtcaataacaatatgcccgtcatgtctgtgggtttataatgtgtttttttaaaaaaattaacagtggtttttatactactagtatgctggtacacggtcggtgcacttgtttagccgcgcataccacgtgacgcgatcggcgcacggttccctccccggtccgtaggccgcagccacccccacccctccaggtcaaagccgccggggcagccagccagagcccggccggtccaatggcgccttgccacgtgccccctccctccccaccggtccactgcgcccatcccacgcacccccctcttctcctcgcgcggactccccggtttgaccgcgcatcgccacgcgtcggctcaccattggccggggccgcgccaaggagaggccaggcgagcttcccgaggagccgcacccgtcgctttctaattttttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaagaggaggaaaggtgatctcttctctcccccctttttcttttttttttttgcttgtctcgctttttatttttttgctacctttacggttgctgggatttgggggagttggtggttggttggttggttggtggttgcgtgaatcccaggggtgaggagaaggaggtggagtactcgttcttgatc

SEQ ID NO: 61139 - DNA, 733 bp, Oryza sativa
cgccgaggggtgccaaggtgtacaagtcgggcagcgaccgcgtcaccctggcgcgcggcaccaactacttcatctgcagcttccccggccactgccaggccggcatgaagatcgccgtcaccgccgcctgatcggccggccggtcgccggagtccggcgggatcgaatgtagtagtggcaatctctaaatatccgggaagtagatccaataattctgtcagtgtcctacgttgctgaatgaccgtcttcgtgtttaggcctctgctttgttgcaggttagttgattgttggcaagtatagagaggaatatatgatttatgtgatgtgtattttgagaagaatttaataaaagccaaacagctgcgttctggcccagccgtatatatgtagtacaaggttctgaaaattgctttgtgtgaatgcgatggttcatgcatgtttgtaccatcctacattcgtctgtggcagttgagagaagaagttcagtgaactggtataactaattggtgcagaagctaataacagtcaaatgtttagtttcaacattgagaagctcgcactgccgtcttgaataacagcaattttattcacacaagaacaaacaatttctattttatagttatgctcgttctggctggaaagaattcagatttcatagctacaagttcagttcaggcatagtgtaacccaagtccattgactacttgcaaactatgccagacagggctgcagg

SEQ ID NO: 61140 - DNA, 1432 bp, Oryza sativa
gcactgacagtctaaccaagcaggactgtcccacaaagtcaaagcgaaccgacttgaccaactggctacgacgaggtctctaccaaaatggaaacgtaccagacaacatccgggagacagcgaggcgaccggcgtcgtacgtagtacaaattagtcgtcgtactcgtaccctcaattgccccaaccccgcaccgtcgtctcttcgttttcccatcgcagcggtgttttgctcgtcgtttttcctctcgatcggcccttgaccagcttgcgctcaactttcgtggtttattagtccaaaagttatgtccacttctcggtgccgccatgtgggtggttggtctaccaaagttcgggaaactattttgatcactcgatgggatatccctcatttgcttaaaaattatttaaatagttacttcctccattccaaaatactcccaccgtattaataaagatagtcgtttaggacaatgtttaagtcaaaccttggaaatataaatcatgaataactcttaaattgttgagtttgaaaatttaaaaattatatgaatagatttgtcttgaaaaatactttcataaaagtatacatatatcacttttcaataaatatttttatagaaataagaagtcaaagttgtattttagagaccgtgtcgctgtccaaaacgacttcctttatgagtacggagggagtaaaaggctcaaccactcttaatctaaagaccaagaaataattattatcatctcatagtttggatcactcatgcaaccaatagaattaaatatattgagtatggaggattcgaaagaaaatgctagttaatggcatgtattcatgtattccttaattatattatgaaacatttaaaaaaaatagttgcgccttatataatggaatggagggagtataaaaaattgtggaaaaatttaataacacttatacaacatatctatataaccccacaaaatattaagttcaaactcaactcatatatcgagatataaaaatatcagcatatgaatagtattatacggatcacatctgaatttttcactaaagccgagtatttaaacttaatttttattacctatcgattttactatatactttatattatcaattttttataattttttttaactatttgtatcgaatttgaaaggaaaaaaacacaggaatatctcttcgagggattaaaattcactcccactaagtcgtggtttcctcccagctgccaggctagctcgctagttgcactgtgtcgccggcgcgtcgcagatcctatcattcccaattcccacgcggtcgctgagctcagtttcacagttttcacacatatgtacaattgacagccacaagctctaattttggttaattaatcaatttcctatttatttcatggcatgtaggagtaagtgtgtgttcagtgat

SEQ ID NO: 61141 - DNA, 1358 bp, Oryza sativa
  unsure (1)..(1358): unsure at all n locations
tttactattcaacttactaaattttttagtaaatacgtagaaatataagaaatgcttaaagtacgtctaattaatattaatataattcacactaaaatcaattatatttatttttttaaaaaaaatatgaatgttaaacttagccaaaaatcaacaatgccatctactatcttcattctaaaatatatatgaatctagatccaaagaaaacattttataatattatgaatctgaaaaaaaaagacatagccagaattgtagtattagaatatatttcatccgattttagatttttatatctaagacgaaggtagtatggccgtgtttagttccccatccaaatttttttgatgtatgtgtacacacatttaaacatagactaataacaaaacaaattacagattccgcttgtaaactgcgagacaaatctattaagcctaattaatctatcattagcaaatgcttactgtagtgtcacattgccaaatcatggtgtaattaggctcaaaagattggtatcataatttacaagcaaactgtgcaattggtttttcgtctacacttaatgctccatgcatgtgtccaaacatttgatgtgacggaaaagttggaagtttgaagtgaactaaacacaacctatattcaaataagggttaattggatacatgccattaaaatttttatggttttgaaattaccactagtattcatgtatttggaaatatgccattataatttcacacatattcaaaagataccactacttaccccttggatgcatttccagataaaaatggaccaaactacccattatcccctcgactaactacttcccctaactccttcctcctctcttccttctcaggggcgacgcggcgcgtcaacggtagtagcggcagcaacgcagcacggtgcgtcggcggcggcgcggcggcacagcagcaacaacggcgcgacacggctcggcagcgacagcgagacgcggctcggcggcggcagcagcagcggcgcggcggtggagcaagctgcagcgcgcgcagcgggatggcggcggagcgagcggcgtantgagaagagagagacggtagaagatggggaagagagagagaggtagaagatgagggtatttttgtccaatacatgcaaaatgcgtatctcagtggcaccgctaagattagaaacaagtagcaatggcatcggtacaaatacgcaaatagtaatgtatatttcaaaaccggtaaaattttaatggcatggatctaatgaacccttaaaataaagccccctttcctcatcttattcctctactgaccaccctgatcgagccgttaccaagctccaccactgacgcatgctga

SEQ ID NO: 61142 - DNA, 903 bp, Oryza sativa
ttcagatatagttcaagcagtgacgagccatgagcaacttcataagctaaaactacaaggaagagtacatcgcaatctcctgctagaagatccacatttcagttgcatcaaaagcatcacattatctggctcgtggattgttttgagcccgatggaatcactaggctcactcacaactctttatgaactcaagctaaaggatgacgcgctccggtgctcagaggtctcatgtttacaaaacagtttccctgagctgcggtacctgaaaatcagtggactaaagaagcttagggtgttccatgtggggaatggctcatttccgaatctcacccgcttctccatccacgactgtacagaattccttagcacggttgaggttatggagcatgctacaagactgcaagttctgaaaattaaggaaatgccgtcagtcctgcctgatgttacagatttttgccacagcagaaacatcaaccttatcagctgatctggcatcaaagttatgtatagttgacaccattactgcaaacaccgtttatttttttatctcgttcctttttagtaaaattcagctcaggttcttctgagttctgatggcaagaaaaaagaaggcttagctgatctgatgacaagaaaccatacaacgttccaggagaacatgatccaaagccaggagtccagcacatgatagctgtttaatttctttgcttgagctcaatgtaacccaattgtacatggaaaaagagtaatgctagatatttggtgtaaactttgcaatattattgtctactaattattctctggagatagatgatgtcagtaaactgtagtagaattggtgatgagaagtgagagttgtacagttaagtgttgtggccacatgtttttcagggggctgcagga

SEQ ID NO: 61143 - DNA, 721 bp, Oryza sativa
gacctggaatacttgctacatgcgttcgcctcccgtctcctccattgccctcctaccgaatgccgatgcatgagtctccctgtcgttccccgccattgctcttctgctgccgcgcatcactcttgtttttgtcgctcaatccaaagaaataaataggaatacgaaccctcgtccccaaagcccgggtcctagactactacgatagaaagatttctacggatattcttcgtatcaattttataatgcttatcacctccttctgagctattcccacggtgccttcgggtcaaagcttaatccttaatagccaaccgatgcctggcaccaccgctaagcacaagggcaagaaaaagattggctttaaaagatccaaatacttcctgtgggtttataaaaaaccatatcatatcgaagaacttgatggtctttctccacccgttcgattacttcttaaaaggattagatatagaaaaaaagtagtctactcaggagaatgagataatgctcataatatcgctagtaaccaaccacaaaagtaaaccaccgtgcaaaggaaatatgggaaagagtgaagtaaggaaggaaaggagtcactgacatgtggactttatatgttaacttacgtggttggactaggtcaatgaaaaacaccttcaaaaccactgagggagtcattttgcattggttttaaaagtttggggatcaagatatccacggttac

SEQ ID NO: 61144 - DNA, 1801 bp, Oryza sativa
tgctggataatcatgctcttgagatgggtttctagctagctgggaggtatgcaactcatttacatgtatattcaagtctgcatcggagttatcaccatgctcctgtattagaaatgaattaaaatgtaagtcaccatagaagagaaaattcaaaagcacgacgtgaccagtaaaaaaggaagcaagggagatctccctccttaacacaatgttcattgattatgatactacaaatttgttcgtaagcagttcaagctttatgtcaggaagcttggagcttctttcaggtaaacatttgctatcagcagcgcagtggagtctataataattcagacatgcctaaaattactttttttttttgcaaaccagtgaatattaaaagttgcatcaatgtggcaatagaagaacagaataggctgcggtgagacatacagtactttgaattcctgttacacaaaagttattcccttattcatagttcatacaggacgtgaattaacaatcatggcaagctagattagcttattgcttacaaattagtttagattaaattaacaattgtgtttaattttaactcaggacaaaaaaaagtgcatgccatctacccacaaagactgaggcatatgttactaataaaagttataagtaaaagacttcgttgataagtaacaaatgcagacatgttcttcacaaaagttaaattaaatttgattgttttagttcctatttcctagggtggtcttgcctgtgctctgacaaatgataacaaaacacaaatgaataggtgatcgagcatgccttcattgcttgttagttgcttccttaatataaactctacctccaaaattggtcgtcctatgactcgtattcctatcgctaacaacagcataccgccataccctacgcgctttgggtacgattaagttcagaacaaaacagagcaaaattcgcccaaattcacatgaaaattaagaacttccgaacaaaggatcaaggggtaaccaaaataacctataaccaacggcaacaaaatggatggggggcttggaacagaccggagcacgtagaacacttgcactgagcccgtcttaccgggattaggatttagccccctttctacacccacacccacggccgcggtggcctggtctagtatctcaccgacctcggccttgccctccgccggcgacgccgcagccggcgagaccctatggcggtggcgatggtggccgcgcttgtggcgcttcggggaggaggcgccgtcctccgcgtcgtcgtcgtcgtgcggcgagcggcggtgcttgcgcggggagaggtgcgagcgggcggcctcctcgctggccatggagacccgagggaaccagctaggcctagggtttggtacggaggaggaggggatcccgcgccgcggcgaggaagggtatgttggtttggagttggaagaaggaatcggatcgagcccgggaacgaattcccctcgtgatcaattcggccaccgttttgtaggaggaacggtcgattggagcagaccgttcgagttagacccggatgaggattgaggcggtgaggcctcccttcgagcttacagatttggggagatttcaaatagttcgattcgaaaaatgaaattgggaggttctttgataattgaaacgcagagatccttacgattattttatataaaaatagttcgaatcgtacaaaatccttcaaaaatttcacgttcaaacggacttcttagaaagcaagggaaccattggcttgggccattgtttcctttccggaataagttcactttggg

SEQ ID NO: 61145 - DNA, 17850 bp, Oryza sativa
ttccttccccttccggccgccgtctctcgccctcgaccctatttaaaccctccccgagctcctcaccaccgtttccaccactcgccgccctctttccccctcggaaacgcgctcgcaccgctctcctctctctccgccatcgctgccgagctccggtccgtcgccatcgtcgccccggacctcctcccacctcggcgccgccaacctcggcttcgccgcgtcaccgccgacaccgtccaccgcctcgccgagctcgccgaccgccagaacgctgccgtccccgtcgaccctagccgcaccgccatctctctccgctccgaccgcctcctacgtcgccgtcatcgccaggggtgagccgtggaccgctgcctcctttccccccttccctttccctctctcgaggcgtggaccaccgtccaccacctcaccagtgaccataggggcacaggcgccgcctcccgccgaccgcgccgacgtggccgcctccgagcgcgccgtgtggccgcgtggggctcggccgtcagccatccgtgccctcgggtgcggctgacgcgtggggcccacggggccgaccggtgtgagcccgagtgcacccagtccaccgtggaccgtgaggctgccgcatgggccccactcccgtggacccggtccacgcaccctctcccctctgctgacgcaataaaccctatttttaattaaaatttaaatgaagaaattcgcaaatattcacattaagagcatataaacttcaaatggctatatcttggtcatttgaactcggaattggaccgttcaagtctctaatttttccttaagaagtcaagaacccatttatgtactttgtttctgcttgttatatggagtttattaaagtaaaagcctttttttctttctgttggtcgtgtagacgctgcagcttcggaagatccgctctacgtggaggttgaagccgacgtttgggaaagcgagcaaggcaagtcacatctcctttgaacatattgttgtcccatgctttaaaattattttgttttaaattaatgcattatcgctttattcaaattcccacgttatcactgttttatttagccatgcctatttacctttgttatgaccttattattattgttattgttattaaccctagagtaactaaaacctcactggtgtgtactgtattatggtctcactagtaccaattttaggtagatgcttcgccatttaaattagacaaattttaggtggttttataattctagactttgggagttctcatatcagttgtaccttgtggaatggttggcttatgtggaattggacacacaccttctcctctattcaaaaccctcaaaatggttttaggctgggctcgaggtgcatggttttgatagaagcacctcggccactataaggaccggtcttcgggcctctgttgcaaagcactaccgtacttccacatgtctagtgggtaaggcgtagtttgtggctcagtctggtcatgggcaaaagtacatggatagggatatacgaagtcgaggcttgatggacatctcgaggacaaatgaaggctacacaagctgtggcccgatagtcgagatgtcacggcacagggccggtgtcttgttgctaggggctcaaccttggttacctgtctcgggattccggccatagccagggttgggtcggtactcttgtttatggctaggatgggttgggaactatgtcatgtcttccgtctgtatgccgtggtggtatgtggcacgtggttacacgtgaggaagacgtgtcttgtgggtaaagatgtatacctctgatcagagtataatctattcgaatagccgcgcccttggttatgggcaagcctagcaatgtacccaagttagtggtttattttttaaaacttgcttaacaactaaaatgtgaaatggttggcctgggttggcttgggacgaactgggacctgctgggtctggttgccagttcggtctgaatcatcataggccttgggttaaggcaggttcgtgggggttcatggccttgattaataacactgtgtagttctaggatcgtctttacaaaatggccctgagcaactaaatgtcttctaaatgctgtttactgcaaatcctaacccctatattataacccccttatactccttcacatttattctgcaattgtgggtgtgtcttgctgagtacggtggttgtactcaatcttgctcattttttccccaacctagaagaggagttcctggaggatgatggcgttggtgtctagctcgtgcctgccgtcaagtgcctgtggtcgtcgccctagtcttccactgtttttgtttatcttcgtgtgtgctgagccttcgtcgcccatgtaataaattaactatttacgcttccgcttgttaaactctgaattgtatcaacttttggtgtaccttgcctcctgggacaaggaataatacacgcacttatggaatgcctgttgggttaattccggtcgtgacacactgataggtggggtctacttgtcgggatcatccctaaccttggccatgtcgcgatcccttgtcacgccttcccacccacgattgctcattcaaactcacgaggacgtgatcatcgcccacttcccctaccttcttcacccactcgctcacaatagctagcctttccacccactctatccttcacatcacctccacgtcaccctagccaccgcttgcctctccttaaccctgcctcccaaggctaaaaaggggcccctagcctccactactttttttccaccctcacctcctaaaaccaagcttctggacctctccattgctatgaaaggtaagcattgctgtctcttccattcttcgacgatgtttcgacgccgttagggactgtagcaaccgccgctagcctctccatgtccttcataggttcaggtgtcctcggccatggcttccccacagctgaggactggtggagcattgtctttgccggtgtcccgtgagtcttctctccctgctgacttttgaccgtcatttctcgcgtctcatggcatcgtggacctccttaaccaccaccaccaccccctaccttcgcctggtcaaggagatgcttggccacctcttcatcttcaccaactgccagtgaattgctgtcaatatcacttacccgaagcctcttgccgcttcgcgccccgccgttggtttcctctctatgcgcaccgccgtcttcaccattgtgcactcggcgaggacaccatcctattatgcttcctttttttccactcccatcgccacgtcgtatggtcgctaccggcaaccatcaagtcacacatccggttgtctggcaagccgacccctcctcgccccgtccgtccaatctgtcatcctcgtggatcatctgtggctgcctatgtcagtgccgtggtgacaccacctcaatgcacctgactaccatgcccgccatgtgcactgtcgcatggcaaggacacatgaccgtgcaccagtgatcccgggcttcgatatgtgctggcaaatcccggtcattgacctctcgtggaccacctcggcggatttggtccacgagagctggcctcccttcctcgctgaccgtgaggcccgcctgttgacgccaggttccccactactgacatagtaatcttgttataatgcgtcatatatcagtttataacttctacaaatgattacaatggttaaaatttctaagatttataactaattcattttaactaggtattgaacattcaacatgcacatttgctctaaaattttaaagaaatcattacaaatgttagatgtattgttttatgttgtcttatgtactattttgcctatgggagtatctaaagtgaaaaaacttctagaaataactataatataattgaaatgtaattatactgtaattacactgtaactacggtatagcttatataaaacttgtattcaattatggttttgttggttagcagcggaatattatacatgacatgtgtggaaatttctttctagcaatttttttccttcatgcacaaatctcaaggcaatcaaatggctacaaatttgaatgttcattgagcaaaaagaaaaaatttacgaaagtttttagcaatttcgtttgcgtttttgctttgtttctcgcttccaacgctcccatttaggccatgtttagtttctactcaaaaacttttcaccctgccatatcgaatgtttcgacacatgcattgagtattaaatatagacaaaaagaactaattacacagattgtgtgtaaattgcgagacgaatcttttaaacctaattgctccatgatttgacaatatagtgctatagtaaacattcgctaatgaccgattaattaggcttaataaattcgtctcgaagtttacaggcggaatctataatttgttttgttattagtctatgtttaatacttcaaatatgtgtccgtatatccgactgacatgtcaaaattaaatttgaaaatatattgtttatttattttttcctcaaaatattcgggatacaaatttttcttttttacaaatataccgtcctcgctagtttagagtgagaaaacgatacggtatcgtataactactgcacgagaatgacgtagggtgatgacacgacacggtttcgcgaggggtgtcgcgagagcgtacggcctcgcacagtcaatgtacgagaccgcacggcattagctgccacacccaatgattaatgtcttaatcacattgattagcaactaattaatcatcaattatcattaaataataattaattatagtaattaatcattaattttgtacaagacattcggtagcactgtttctttgtgcgatactgttcggtatcgttacttcattgttccgtttcgctgtttcattatgcgagaccgtgctctcgtacaacggttgtgcgagatcgatatatatttctgttaataaacttgtaccccgaatttttttagaaaaaaaataaataaacagtatattttgaaaaaaaaattaaactttttacccatgaactagagagggcctttgtacgagaatatcgcagaagtcccaggaggccagcaaggcaagttatatgctctttttttttgaaacgttttatcctttacaaataaactttcatgttttataattacatatggatacatagggacacctatgtataatagcgacagcaaagaaatgatttattatagtaggtgttaattagctttaggtgtctttgttccgcggccggcggcggcccaccttcagcagatgcagcagctcgcacgcccttgtggtccggtcgcggccgcgcgcggcgcaagggcggcgtccggagaccacccgatccgcagcttcaccgcccaaaaccgatgctccgcccgcctccacgtccgccactcgacaggtaagtcccgtagtagaggatggggaaaagtggctacttcgcgctaccgcttctgttcttccaactgaacaatctatattgccaagtgttttgggtgataatcgtccgatctgggaaatgctactagtagtacatgatctattattgttcattttattgcacacagccaccgtgtggacgtactgtatattagttgctgcgtcagtcaaggttgctgtagacgtagacaagtagtattgggcattttctttccaagatatcgagggattgtagtacttattatcttgttaaaatgttggtttggttcatccatgtgtttgggatggacaatttctcctctctgtcctattacacgattgagcccagaactgctttggacattcaatttgtggtggtgttgcgtctattagttatgtagcacagaagctggtcttaaatctgcccgtagaaataagtgaaataggtgaaaatttaatacatgtaaaacaagtaattataaaattatctctcaatatcagcattacacttttcactgaaagaggcatgtctatgaacatgtcaccgacattcccttgttctggggcacactttccagccttccagttattgctggagtttttacaacagatatagcatgattattgtgtaaatattactagttacagtagtagttagctattgcacaaatattacttcttctatatctggaccctcttcttgcatagactttaataacttattagtgatgaagttctggttgaatgtggttcctcacttcctcctgttggtgtgctactgacttcatcaactgatacaagtttctgcaccacacattccatggtaggtcttctgactctatcttcttcaaggcatgaaacagccaattccatcatcattcttgcttgtgcgctgttgaattggccattcaatcgggtgtcaatgaagtcggcaatccaaaactgatcgtcgccatctgacttaagttgctctgagcatagcctgattacccttcccagggccattttcacgtcctcatcatcattcttttccaattctgaaacacgagctcccttcagcaattcgaggagcacgactccgaagctgtacacatctaccttcgctgttattggcagactgtaaacccattcaggtgccaaataacctcttgttcctcggatccgtgatatgtctatgttagatccatctctgttcaggagctttgcaaggccaaagtcggcgatcttcggctccatattctcgcccaacaatatattttcaggtttcatgtcgcagtggatgacccactcagaacattcatgatgaagatatgccaatccttttgccaccccaagagcaatattgaatctttgtgtccatccaagtaagttctgtgagcccccactgccaaacaagattttgtccaacgaaccattctccacaaattctgaaaccaatatcctgtgtggaccgtcagaacagaatccccaaaccctcactagatttgtatggtaaatcctgctaatcacactcaattcatgctggaattcttcttcaccttcgtttacgtctaccaactttttcacggccactaccctattgtctttcaagactcccttgtatacgacgcctgatgctccccttccaagctcatccttaaattttctagtggccaacaccaactctctgtaggtgtacctgcgaaaatggttagctatcatttcatatccggcctcagctggccatactcctctgagttgtttggcctccctcctcaaaataaaccatcctaataaaacaaataatacctccgccagaaatatcgctgataagaacccgtagaaatacaaaaactttgatatgctctgcccactattaagtgtatccaaaaaatctgctatggaaatgttgtttgttgtattacagttagggccatatttaggaccaagaggctgtgaatggggaaatgaggaccttgacacatttactccctcaggaagcttgagatacatggtaccagtgctgccaaagttacttagtgttacaccaccaagaagaacagactttggatagcaatcaccagttccttcccagtaggcgaaacccttacacctgcagtctttcaagcatatgttcttgcagaatccaagaggaacaaaacgataaacactcagatcataccccaagaaatcagtattgcggagtgcaacaaatttcaccttctgtccatcacaactgaggttgacctttgggctgcaacctttgctccggtcacttgggtcgatgatctcgtaaccaggggcacaagcacaggcaggaacaggtgtatacacacatattccattctgaccgcacaaaccgcgtactttgcagagctgaggaaatgccatccatgtcactgaccatgttctgtctaccttatcaagactgtacagcctgagattgccatcataatccagtgttagtctcctcactgtgccaggaccccaatcagcagctatgaatgttgcattatcacttccaaggaaatgtccccagctgtcaagaaccccatttgtggtgctgttgaatggacttcttagctttgcccaaatagtcatactagggtttggccagtagataaaagatatgttcttctcatcatcaaacagtgaaagtaagtactgatcatcgaaacggaaactgtaatggccaggaacaagtaacctatttgtagacacaagctttgtagcagcagtgatgctctgagtgggtaacaatgtatcagtaggagaatcaaagctttgccacagagtgttaccactttcgcccttcacaacgaggttcccggtgtccaagagctgagcttgagcatactgggtatctgaagagctaacgttgttagcccacacaatctggccagcataatctttcaaaaacatgccaccatcgaatttcaactcaactttggatccccaggtgtacacagggtggagaggatttgcgctccagacgacggggttttcggtcaagttggagaaccagatagagaaggtggaggcattgggggagattttgtagaagccacaggtgaaagtgccatccggtgaatggagcacatcctgtacagacagggaggagcctggcttgaggaaatcttgagctgagatgcacaaaagtgggtggatcagagtgaagaggagcagagaggcagagcttgcaaccatttttggtggagctgcagctttggagttgatctttcaagagttattaagaagccactggctagtggccgctaatggagtgagcatcttggaactgcaggtttgaactttagtggaagacaggggcgaagctatagccatctatcggggtccactgaccccgacgatttcttgtgtacgtttcttactccacttaattttaccgtgtatgaccccggtcgataaaaacactagaccccggtaaccatgatttgttatagcctgattaattagcaacttgaaacgacacgtttgagattagcaagcaacaaataggaattagctagcgctaatgattatacgtcagcccaaaggcccaatatacattttggtaatcttagcagtgagtatttgtgcatttaatgtctactttgtttacatattaattatgtccggtttttaatacttcctccgtttcaggttataagactttctagaattgatcacatttatatagatattaatgaatctatacataatatgtagattcattaatatctatatgaatatgggcaatgctagaaagtcttataccctgaaacggaggtagtataatttatagacatgtccgtgcgttgcaacaatctcctatgggccaatggttgctcgtagcattatttaggatatggattttcatccctcgaggggatatcccctcattgtttgcatgtcatctaaatagttataaaaaaattgacaacataggttgataaggaatatatcactctacaaacatgcaaaatcaaatttgacttctacaagttacaataaaaaaataaactgaaaatagttatcgtacattcgcatttatatttgttatttttgtttcaatttgtagaagttaaattttaacttgcatatttgtggagtgatatatttcgtattaatctagctatttagatgagatgaacgaaacgagggatatcccctcgagggatgaaattactttccccgttatttagttttctgttgggtctggtttttccccgtattttttctttcagggtggatgataaattctgtttttatgtagtagagataaataggcaagcaaagtattatggagcgattcttgaaaaaaaaacccccccgctattttagaagatctaacaatgtatcatacactaaattagtattgaccccgtcgaccatttatcctggcttcgcccctggtggaagatgcagccattgaacaagtatgcatatgttttgcttaaagtcagggtgtgggtcgtgttactgtcggatgatcagttgattattggaaccacttgtgcttcatagagcactaaatcaatgggggaaaatatttagttattttttgtggtgatgcaatatgtgcaagagagactggtgttgttacttacacccttcgtcccaaaaaaaaaaagtccaattctaagtgtccagatttatctctagaattgggttttttttggacggagggagtaaaccccaatcataaatatttatttactccctccgtcgtaaaatataagttcttttttatggacacagttattaagaaagtatatagaattaaatgtgggaaatgtataattggatgagaagtgaatgtaggtaaaaaaaattgaatggttgagagttgtgattgattaggaagagaatattggcgaaaaagttgttatattttaagataaattctaaacactaaaaattattatattctggaacagaggaagtagattttatgaacttattttaaatttatggtcagtgtttaaatatttctaactggagtgtaatatactgtgtaattagatgttaggggaacgagcgtttgttattgtactagcgttttaaacaaattattcaccgaatcattatcgcggattatatattttattattacaaggataaattaaatattttaaaaataaatttcacagaacagaattttttaagaagtacccagaggtccagagctgctgctgagaggatcccctgtgactcgtcgattcagcgggagagggagtgcagtgttctcagcaggtcaacacgccaggtcatcggtcagccaccaaacatatttttggggggtggagttcaaagatgcgaatggtaagccagctggataattccttgtaataatgtacctaatcctcatccgtattcgcctaactcctgtcgggtgcccccactgaaatgccgcagcagtagatccacacaaacgacactgggatttattccttaatcatgaacttccaacagcagcttcccatatacagcgcatatacaccaccaggccatgcatcttttcgggagaccaaaaatttatgtcacgagacaactctattgcagcttcccatctctcctgtctcagaataatacaaaatgggaggtacataaaaaaggaaaaaggaaaaaacaacgccatgtacgttttaacatgttctatggaagttgaggagctgcaacaaaatttccaaacaaagaatggggggtacagcttggctcgaggagggaacccattttctaaggacgaagatctacataaaaccagacgcagcagagaggaacatcaacagcgggagttaaaaaaaaaaagatcaacgccacgattacaaaaagtagtcgggggtcttgcgcgttgtgtccggctctatttgtcgtggggctggatcgaactgtaggaagttctgatccatgttctccccgatttctagaattgctgccatgttaccacagcggtaacagtagtttggggcgctgaacaccgtgacaacgttcttgtcctgcataacaatcattgtcattaagtatcaagctttttgttagaattttccaatttggtgctcaagtgcaggtcactgatggtaaggtaaggttctatgtacatgctcctatgtgatgatacatgaaaaccaaacatatagtaataatactaggatcaacaacaaaccacataccatacatccaaaccaagaaaagttctgctcatcttatagaactgtatcaagcgttgcattctttatgtccgccatagattgtaaatatgttatgcctcctagataataatcagcaatcactatacagcataaactatgtgggggaagggccgaaggggttgtcattgtttaacagatcactgaagggttgaacaagctactaaaacttatataatgcgaagttcaggtaccataacatcataatgattactagattcagcaatcagcatcagcatgcaactatgagtctataacttagctaaagcaccagaaattattatgaataccaaaatggattagcctaacatagtaagaccaataataattatgtgaacagggctctcagagtgggacgaatgaaaacaagcaaatggaacattttataccaacctggcaccaattgaagccttccatcacaagttgatgggcccttgaaataagggtaaggccattagtatggttgaattgttgtgcaatatcttgcccaaacgtgtatcctgcccctcttggagaaattccccacccacatcgatcgtccgggtcagaccacaaaagatcacacatgggcccttcatgagggacctataaccattaaagagaacagggtgcataagtcaaaacatatgatttccataaactataaattatcaagacaaaaaagtgtgcaaatacagcacatatgttctacacaaagacggtcactattacgcacaattgctcaatgagggccacctttagttactagtttaagctatgtacgaacaatggcacgaaccaacaaatttgatatataggcatagcaggtactaacactaaaccagcaagcataatattatttgtgaatggtcatggcgagtgaggtcctgtttagtcttaccaaatgcttggccaacaataaagtaagaaatatctgtaactacttaagcaaattgtacaggaatattgatcttttagtttgtttaatttctgagctcttctcccatatcccattgcatcttgtaaaaaagaacacactatggtacatcagaaaatcgcgtaactggaacctattactccctccaggttgataatagttgtcgttctagacaaggctgatgtcaaactttaaaatctgactatgaataatttccaaaatatctgtctcagaaatatgcagaccatatgtatagattagtcttaaaaagtacttcaatagaatcatatatttgttgatatttctatatatattataatagaaaatagtggtcaaagttgttttttcgagaccatgtactcgtccaaaactacaagtattatcaacctggagggggtatatcaacctttgtatatcatttgatcctcacccagaacattttatgtatattaatataaagttattgtgtgagatcaacatatatgagaagaatgccattcgagccatgcacgtgaaacgatgcagataaattattagagcacaccgaatcatccaatggcaaagaatggtatatgctatcctctaatataggttcaattatttaacactcctggacctgttctcaagctatcatgaatgagcattacctccagttcaaaaggagggtgcctatggactatggagacatggcaagtaaagacgatggtgcaaaatgatgcataattagatcactagctcaaaggtatgggtgaagtgttgcatacctcctgtatgcgatcgagggcacgaatgttatccaatgtatccaatgacggcgagagaccgccatggaggcaaaagacctacaaaatgaaatttttcctcttgtcaggtatgccatatacatggacaagctgagttcaatgtccatattaatagaacaaacatttggcaaaaagagctaacctggttttctacaagagctgtgagaggcaaataatcaaacaagtccgtgaagtacttccaaacatttgcatttccatacttccgtaagcattcgtcatagaagccatacctgtatccaaacactgcatgtcaagaacaccctagcacagtgggtgtgcttgcattttacaaagtagaatgcagcagaagaaattggcaaaagttcatgtcatgacaagaacattataaagtaggattcttgctacatcaatcttcagacccagagcaatcataacttttttactttaagaaagttcatggcagcaagtcagcataaagttgagatctattcatcatattctaggaatttggcttaaacctccagtagatcattggctgccaatacctaaacttctatgtggggttgttagatcagattagggagtcagaagctgggagcccttgtaaattatttctaaataactctgcaactcaaatctcatgcaacgcataacccaacttacaaagtcccaaaacatacttacgcagctaattatttcaaaatataaattgatgatctttattgctaatttgcattatttctttctttaggtttctaaccaaaaaaagtcatgtaatttaccaaactttatgatttataaagcgacatcaacattacatgatctaattcttatgatatcatgctagctaaaaactacagtaccagataccgtgctgagtccaagaaaaataaatgtgttttgttccatgacctcttaatcaagagtggttagcagggatgcctttggccattttggatcaccagttcagataacaaatcaccttttgttgttttctccatgaaatggaatattcagagttcagttggtgtcgtagcctggagcccgagtcaaccaaataagccagcaattggtgattactttccatgccttttaagaacaaggaatttgtttcttaaatgattgtttattgtcattgatatatctgttgaaatgcaaatcgttgtttaaatagactgcctgcataataagcaaccaggttgttttttacgggtgttacgttgcaagaaattattttaactttgtaagtctttctaaaagtttttgctgttgagggttgtcaggctcctacaaagtataacgttttcatagtcatctgcacacataaccactaaaataggcgatccgtgactctgccactgcataattttaacaattcatcaatgtttgaattcctctttataatcaactccagattactattttaactcaatccacaattccatatctaataagatgtagactgagaatagagtgttgaattacatggcatgaatttccataccaagacaagagacagattccttattcagcttataggatttctgacgtttggcatgacaccatacagccattatgttacccctattagagggtattcaaccatatggaagtggagtatcatctatgaaaactagaaacaggatgcaatcctcctgattctaaaatcgaacaagttgactaacaaaatacccaggggataggccatggggtaccaaggaaacaattgaataaccaaatataataatgcctgtgccagaatttgcatcttacagatattatgtggccacagaatctagttcaactaatatgctagttcacctttgcaaggatattgctatgctcaatatcaaaacaatgtatttatataagacaagcttttgaatacaactaatcaaggaagttaaagctactaaggtcacaatgtttttcttgcatgttaactagtattgcaaataaaaaagcgcacaaaccaaaagatatcgagacaatgtaatcgtgatcttccaacagaaaaaaaaaaactgttactctaattcatgcccaacaaaaatatattctttgtctaaggaggcagaaaagatcaatttcaagcataatcatttggtaagatttgcagcatggtcatatatgttttgcaaaaaattgcaatatagagatactgtgctgaaaattggcaattggcaactattgaagacagttcagagtttttttcatatcagaggaatagaaactcacacttgggtgatttgtctgctctcgtgatttcctctcaatattgtgattctgtctctataacggactttaagagccactagtaatgtaacagtctccactgaatagtaaccacggtctgcagcaagcgacaacaaaatcaattcaactacaaatagaagaaacaaataaacacaatacaggaaaaagtaattgtgatagaaaaaaggcatatcattcaactgcttatctgaaaaggcattccgtacaaattgtctaatccttaactgaatggtgccctgtttgtccgacatgttgtattgcatacagatttcagatcaatacacatcatgagcatgcaatgaatacacatagacaaccatagtcatgatgacctcaagtttaagaatgcttgacatgtacgattaccaaaaccaacacggcagcagtgtagcggaaccaagcgacaagatccttgtatgttagtgtaccggtggcaacaagctatacatgccatttatgttgaaagtacatgcaagctctccgtttccatgcaaccttgaaacatttaaaatgaagcaaaccaaaaccttggctaacagacatctcatcagttccctaagacagtaagactccatataatccaaggaataaacactccaaagcccaaggacgttcatcccatcaagaaaaaaaaaatccaacatgcctaatatgtccaatagcaataaatactcacataaatttctacttgattaatatacctaatccagacgaacaacataagaaaggctagcatcaaaattctagcgatccatgggacaacataacaagaacatgatcatcaattcagcacattaatcagaccaaagcactgcctcaaagctcccaaatccgaacacctcagcacctcaacactgcatcaggatctaacgaattcatcccctacctcacacgccccatttataccagatcgattggtcgaaccaccacaccaaacccgcagatcggcccaaaaggggaacacacgcgtccgaggccggaggagaagagagagagagaggggtagcgagctagaaacttaccgacgtagtcacccatgaagaggtagttggtgtcgggggagtccccgccgatgcggaagagctcgatgaggtcgtagaactggccgtggatgtcgccgcagacggtgacggggcaccgcaccggctgcacgttccactcctccatgaggatcgccttcgcctgctcgcacagcgccctcacctccgcctcccccaggaacttgcactcccgcagctgcgagatctgccggtccagatccgcgtgcgacggcatcgtcgcctcccccctccccacctccccctcctcctcctccctcctcaccagggcgccgccgcaggggaggtggcggtggggggcgcggtcgctagggtttgcgggggatcgggggaggtggcgatgcaggaggaggtgctcatgccgccatctctctctctctctttcttctgcgaccgcgtggttgctcgcgtcgcctgtataggatgggggaaggaaaattgtttttttttttagggtgtttgttttggttttggctttgatgggggtttggtgatttggattggggcgaaaagtataaataaatttttgcgagttgtttaattaattcggggggaaaggtggatgggggagtgctttccaggtgtgtagagattagagaaagacaggatgtttcgtggagggatgtctgcgggtgcttttcgtatacaattgctcaattagcagggttggttggttacattaaatttaaattttatattgattttaatgttttattaaaaaaattttatttacttttaaatcgttaaaaacatagttttacacaatatttttattcgcaattttttctaatacatcgtgtcacatactatcagtatatagtcaactaatgggaccatatgttctaattgtagcttacggcatctgtatatctttcgaaagaaatttaaggttcagattggtataatataatgatgtgatttgtgggagataaaaatatatgtcatatgccactatatttgttgtgttataaatctctggctataattagtgattggaaattagccatgagtcatggcatatggcttgtctagttttcactcatttgtccaattgtgcattgttcaccaggaatgattgtaggaaaatagtttgtggctttgaatatattgcctgatcattaggatatatttaatagcatacttgcattaagaactagattgaggcacatcaatttatcattttggttcaa

SEQ ID NO: 61146 - DNA, 671 bp, Oryza sativa
ccgtaccacggccgcctcgcagctctgctatggccacctgccatccccctccccctttgcctgacctcaaaacctaacacttgagagctcaaactattacgactaaaaaaaagtgagatttgaagggagagacatccctccaaatatttttttagaagaaaatgtgagtgcgtcgggattgaacacaagaccttagggttgaaaaccacacacctcttatcacccgcactattaaatgcatctaaaactactattccatctgtcccaaaaaaggtgaatctaagactggatgtggcatattctagtacaacgaatttggacagatgtatgttcagattcatcgtattaggaggtgtcacatccggtactaggtaggtttttttatgggacgaagagagtacgactgaagcatgaatcaaagaataaggggatgtttggttgatgcctaaccttgccataactaagtttaggcatggtggcacaaatgtggcttagaaatagttagccacaagtgtggcatacttagctctaaatttgagagcatgacatgtgggtcccaaagttaagaaagtgtggcataacacaattgcggcagcgaaccaaacacatgcctaaaaaactgtagcatgactaaagtgtggcgtggcaaagtgtggtaaccaaccaaacag

SEQ ID NO: 61147 - DNA, 7512 bp, Oryza sativa
ctttatcggatgaagaaatgaccaaaataaaagttatagatcttgatgagttattcaactttgttgttgataactttttcagttgaaatcatttagtgtttaaaaatgttatttgaagctgtcatatttttaaattcaaattcaaacggttcaaaaattgttatatagaaaaataaccaaaataaaagttatagatgttgatgaattattcaactttgttattgataacttttttagttgaaatcatttagtatttgaaaatgttgtttgaagttgtcatattttcaaattcaaaattcaaactgttcaaaaattgttatatagaaaaatgaccaaaataaaagttatagatcttgatgagttgtacaactttgttgttgatgacttttccatttgatatcatttactatacgtaaaattattttgactcataaattgaattattatactgcaagttaattattttgctatagttcaacttacaaatataaacatttcatatgaaaaatgagaaaatactcatcgatgacgggctttagttaatgcccgatagagattaagtcatgtagaagttgaatttaaacttgcatatttgtgaagtgttatatcgcatattaatacaccttctcaattatttttaatttttttataaccattttagtgacatgcaaacaacaaaaagatatctcctcgagagattaaaataatttccccgtcacggctacgaggcacttggaggcaccgcgctggacgccggagacgagccgttggggaagcccaatcatggtcaagctgaggaaaacgaggcagctcccgctgacgcctgacggacgtggcgaatgccaacaggagtgagacaatgaagcgcgtgttgctcgcgtgcttcgcctcggtggggaggcagagcgaggcggtcagcacggtgaagccgaagacgacggcgatgccgctggccttgaggttcgccttcgccttggcattgcggagctcttcttcctccttcctcctctctgtcggagcaccgccggcctcctcgtcctacattggaaggtctgtggatgaccaacggttaatttgtaaatacagtggggaaacaattttttttaagaaaaaggaaaaaaggcaaaagaaatgaaagaaaggctaaagtaataagttcaccggccgtccctcaactttatgccgagtctgtttgaggtcccctaaccacaatatccgaaatgtgtacccctaaactatataaaaccatccaaaaaaggtcccgaggcagtatagatgcctgattttgctgacgtggcatcctagtcagcaaaaacaattaaaataaatatgtggggctcatatgtaagtgagagaaaatagtgtgggccctctcttctctccgcttctctcgagcgggcattgtggcagatgggggagaggtggccagcagtggagcaggggcagcggagagacggacggcgcaacagtgagctcagcggcgaaggagaggagcagcgcgtggcgtggcggcaggagagacgagaggactggcacgcagaggccgagctgctgcgccatagcgacggcctcagcctcggctttgccgtgatggacgatagcgccacgatgctcggtgcgctcctccatgccgcttaccgacacagcgcccgccctccccctcccccaacccggtcatctgcaacagcagcttcaacaacagcagtgggagcgagcatttcgcccccctacctgcaggaggaggcttcctcatcggagagcagcagcatgtgttgccggcgtcctacgccgcggcaggtgtccgattcatggccacgggagaagaaacgccgcagagctttggctttggcagcctcttcaatggcgatctcctgcaggaggcgaacgggagcatgtatcattatcagcagcagcagcggcagctgggcattgtgccctcgtcgcagccactgtcagggactcgagtgggctgcacatgggccgctggctgcaccacgggctggtcagcccatcgccaagaagcccaagcaaggccaagctgaaaattatatgagcagcagcagcttacaggagatggatcgaacagattcatttggccaaggcggcgaacgacggcggcggcgacctagaggctggctggcctctttgtcgatctctcctctatctcccttcttctctactagtctagaagctactagaaccttctagcccttgtatccttccatcttccacctcagaaccactccactattgtaacagacttggttgttccctgtgttggatttggcactgctatttctgaaattacattgttgagtgggtctctaacaatttggtatcagagccaatccccaccaagctcatcaagcaagctgccatgggaagtgaggacaagtttaacatgcttttaaggatgctcgaagagtgcgagcgaaggcgggaggaggcagaccaaagaaggagagcagatttcctgtctctcaaggcaacaatagactcgtggatgccccaagaatagaagaaagctgaagaccttcagtttttggttgaggatgagcagtccaaggtgacgcccaccacctgttcaatggagtgccccaatggcagcagcccgagcacaacagcgagatccatctacgacgacgagggggctactccgacgatcatcctggagcttggggatggtgaggggaaggatcgcatgcccttcatcattagcaaggacctttccgagttgacgcctatcatgtgtttgacaatatgctcaagcctcgacgtcgagcctgatttcaccgtggctgcggtggttacatgctccaacactgccatggactccaaggagttggtagccaccgatggtgcaaccggcaccaccaacattgacccccgtgtttgttccaaggagacgcacaccaagtgtttgttgtttggccccgatgtcaacggtgtcactgatagaggtgtgattgtgttccaaagtaggatgggtgtgttcaaggtcgttccgatatcaagtcagtccatggagttgatggttgacgagaaagcaacctgcactgacaccactcaccttcccaaggtgatgcacccaagccatttgatgttgggccccaacgtcaacaccggtactatccaggctggggttgcgtactcactattgcttggcgcgccagaaggaatagcatcctcgggaaaggccacactagtcatggcacaaaagcttaactccaatttctgcctaaaatgggtggcgctcaacaggtgttcgaccaaatgctccaagggctacaagaagctgttgatgagtcatcccaagagaaacccatggccacctccttgctcaggtagagtggttagaagatggaaggagtggtatgtgccttgggctgcgggcaattatttggggataatattttatttcatgccaccatggccaccaccaactcaaattggaaccataatactttggctgctggtaaacacatggttgacggaagtagagctgaaaccgtggcctgacccacaaccaagtcaatatagcggaggcgtgatgtgaactgagcaagtcccatagcctgcaccagtttttgcacatttgatgggatatgatttttgcagtgcaaattgcataagagaccaaacaccttctgttgcactatattgtgcacctaaaggagatttaaatcatgaaaaatctgatcgagctcataaggatacattggtggcaatatttaacttggaacagttccattatgtgggtggtgaggaaaaagttatagagggaatgttatatggcctaattacagtaaactgcaactacttgatcattcctgctgctacaatgacaacaacatctactcaaaatatatatatggagcttgttggttggaggctagagaagggttaaatgatatagctaagggaagaacttacaaaatttgtaagtccatgcgcatgacacttaatcatgttgagagctggctacagaacccaacaaacatattatacaatggtcagttgtttaactgtccagtgggggtacattttggggtcagaaggatttctgagattattgctagaggtgctggtgagaatcagaataggaaggttaagacatgtagttatgattccatttttgatttctgtgagaataatcctagtgatggtagtgctgcagcaaggttttccattgatgggattgataccaggacagattcagagatgatatatgcatcaattgcaaacagggattattggtctgttaaattattcgaggtcataaaagaggggtgcccaatacgccacttgttactaggtgatgtcaagatagaacaattgctgcaatgtgagacattcagtacaagacagacaaatatagagcaagttatcaagctacagctgagcaattccaaggaaatacaagagctacaggtaccatgggatccaggaggttttcttcatcggcttggggacaagccaaatttcaagaagaggggattgtcaaggactcgggtgggctgcacatgggccgctggctgcaccacgggctggtcagcccatcgccaagaagcccaagcaaggccaagctgaaaattatatgagcagcagcagcttataggagatggatcgaacagattcatttggccaaggcggcaaatggcggcggcggtgacctggaggctggctggcctctttgtcgatctctcgtctatctcccttcttctctactagtctagaagctactagagccttctagcccttgtatccttccatcttccacctcagaaccactccactattgtaacagacttggttgttccctgtattagatttggcactgctatttctgaaattacattgttgagtgggtctctaacagccacatcatctgaatgtgagtagtgactcgacaggagcaaaaaacctaaattgaatctgacatttaccattgttcttccatcattcgtccagtggtaacattttacatgtcttgcatcaccgcctgctcgccggcctccccatctccttcctctctgcttctcgtgcctcctccttaaagcggcgttcgttgacgttggagctccctccttgccggtcgtcgacagtagccaccgtcgacaaccacgacagtcgtgcgcgggcaagaaagagggaggtaacatctgccgccggccgtatctggcgctcatccgtgcccgctgcgctgctcctctcccctgccggtgcgacacgcgctcctcctctcctgtcgtcgtcgtcgcgccggccgccacctctcctcctctcccgccactgccatcgcgtcggcctcttctctctccctctcccgccgttggccgcctctctccccctctcccgccgcctccgctccgccgctggccgcctctctcccctctgtcaccacgccaactcgatagaatcaggagagaagaggaaaaataagaaaggagagatgtggggcccacaccattttctctcacttatatgtgggcctacatatttattttagttatttttgctgactaggataccctgtcaacgaaaccagacatctatactatgtcgggacctttttttagacggttttacatagtttgggggtacacatttctggtattgtggttaggggacctaaaagagactcggggcctgatcggttcagttggctgcggcgttttggactgcagctgtccagcctagacgatcggctgcaacccaaaattctacagcaactgttatgttttgaatgtgcacactgctgcaaagagcagctgcttgttggttgttaggaaaaagtatatacgaagtccctcatctcgtcatcggattacaaaatcatttcccaaccacaaaaccaggtatataacatctctcaaaatacaaaaccggttcactctaagtcctttgacggttttaaccgatgtgacagctgaatcattgtgggacccacgtggaccccacatgtcagggtgtccatgtcatcatctctctttcccctcttctctcccttcctcccactcttctccttgtcgtccgccacgaaggggtcgacgatgcatgccgtcgtggcgccgctgccgctggttccgggtggcgcgggcaccacaagcatcggcgccccggcagcggcattgccacgttgctcgcgctgccagagaacgcctgctcgttcgcggccgtcgacgccaccatcgcgtggctgtacatcctgtcgagcaccatcatgcgtaggccctggcccgcacgtcggcggcgatcccgttccgggacttcacgcactctatctcgtcctatttcttctcgatcaaaacacatcccaaaaatccgagaaaaatcaaggaggagcgcgggatactggcgcatcctcgtgagaaattcaggctagatcgatggcggtagagggacaggacaaaataagaaaagaaatacagtagtcttctagcaaaattgttgtgattttcgtctgatcgagacggcctctccatctcgatttgtattctatgttctagccttcagggagctccagagcatgcatgcaggcgactaggcgaggcttccagggttcgttctgctttgaattccgcctcgataaggttactaatctctatccccttggtcctatgatgaggcagccgcaacgccacgctgcttgcgctgccgtagaacgcatgcgcgttcgcggccgtcgactccgccgtcgagtggctgtacatcccgtcgagcaccagcatgctgaggtcgcggactggacaagcgccgtctcccggtccgtcgacgaggggtcggacgcgtcgtgcattggcgccgacccggctgggttgcctgctgcccgtgctcttcgtcgtgaacagggcgagcgccagctgctgcctgctgcccgtgctcttcgtcggacatggcatctccgttcaagttcaggaagtcgggtcgccgtcgggagatgagcgggggcacctccggctcagcaggcaccgtctccccggccagtctacagtggtggacgcaggattaaaataaaaatgaggtgaagatgctcatctcaataagaacaactaaacacaaaaaaataccatatttatattgtaatcatataaacatatagtataatcaataaattaaggcaaacaaaaaacaaaaatgatattaaaatagagtaataatttttgcgccatacataattcatcatacataaaaatatactagtaaacatatcaatttgcaaatatgagttaattcataaagcatggttgatagatatcttttaaaaagtaaatatatgagaagatatcgcatacccagaataagatgattattattttgcttagattagaagggagagagagaaaaacattaggccctatagtaggggacgggggtgagcaatgttgaggaattgagtcgggaaagcatcacatacgcaggattaaaattggacacttgggctgcttatttatgggccaattgtgatatggagggttggggcggctcaaaaatgatatggagggttggggc

SEQ ID NO: 61148 - DNA, 659 bp, Oryza sativa
ctctttggtactccctccgtcttaaaatatagcaatctagtactggattagacacaacctagtacacgaatctagacctccctatccaaattcatagtacttggtttctatattttgggatggagggagtacatttatagtgtaaatatgtctttgcttcaacaaagaaaattgcacggtacttaaagtaagtattgagttaaatggttggacaagaaacctctagtattactatggactttacaatatttgtaatgttctttgtggatcatagaggcacacctcttagatgatatcaggttatggttaactatggtgttagaagattatatattatggtggcctcttttatcgtttacttcactgttattatttttattccccatccacagtgtgtgtgcgtgggcctgtgtgtgtgtgtgtgctggactgtagatgcctggttatgccttgtgaatgaccctgtcctaacatcctctcattttggcagttgcaacttcttaaattttgctcgaaatcggcactgccttgaatgcaaagcagatggaccaaagaagatagaaacagctaccactgaaatgaaaacgggagactggatctgtccacagtaaccatcgaatgccatatttgttttcttggactgttcaacattattatat

SEQ ID NO: 61149 - DNA, 990 bp, Oryza sativa
agtagtagtacatacttatatgcattagtatgtctgacttataaaccatttgtatccgtttataagaagatgcagaatgtttttagactattaaacggttgcttagatctattgaggccaaattgtcatatgcacaactctcggcccaatctgagaaagcaactctagatttcaaacccaccaggaggcagcgaggcgagagggtgtcgatggcccaaaaagcgtcatcatgcagtcccattatcaggactctggttttcggttttctgagttgtgactggctgactgctctgaaagtcgaaacaaaaaccacacgctattgattgtctttgtcaaagtaacgattaaaatgtatgctgtttttacattcgaaaatattttcataaaggaaaattcatgtctaaaatacgtacttttgaaatatgaaaacgacatacattttgaaaaaaaaggctaaaatgacggaagtatatatttgatagaagatgtacgctccgtccgtctcataaaaacaaaactaatactgtaaatctaaataaaagtttgtgtcatactatagttttgtattagagatagagagagagcacttactatcaagaaccgtggcaattggcatggctcacctcccagtctcccagcagaattcccctcattttgtcgaggtgagttggacacacttgacgatagtctcaaactcccaatgctccaactaaagtattcagatcctgaccagtatccccaattaaaatgtttttatagtatagtaatattatatggcttgcatgtttgtaaggcaatgttaataatgagtgtgatgaaattgtttgtgcatattctcttcattctataaaaaccacttctaacacgtcaaacaagtacctttaaagatgtttttgccagtactttggtacgccatccgtgaataagtcttttttaagtttgttcgtttttagaaatacagatccgtatttaaatcggtgggctgcagga

SEQ ID NO: 61150 - DNA, 18731 bp, Oryza sativa
ccccgcctaatgggtggtaccgcccctgtccccggcgttctgctcctcttgcaccggaaccggctcctcggcgccggaagggccttgatggtgttcatgtcgtcctctgcgacgggagatgcctgtcggctgggtggttctggcgacggccgcggtagcatctgccccgacgccgccatggcgcgccatcacctccgacgagcggcggggacggggagcgcgacaggagagcgtggacactgccgtcgctgcgtcacccaccgccatgggggtcggtcctcttgctccagcgtcgtcgtccgcgtcacccgtcgtcggtcgaaagctgtcggacctcctctcccgcctcagctcgctggcctcctccccacccaccggccggcctgccccagatgaggagaaaagtgagagaggaggaatagagagaagaggggaaagagatgacatggtcgccctgatatgtgggtcccatgctgactcagctgccacgtcagataaaaccagggttaaaaccgcctaaggatccaaagtgatccgattttgtaagttgagggatggcatatatctggttttgtgattggtagatgattcgtaatctgatgacaagatgagggacctctggtgtactttttccttggttgctgctgcagcgcaaccacaagcgatcagcctctcggtgtaaagttgagggatgtatggtgaacttccacaaaaataagcccgtcattacacccatgttagatcaaggcccaatcactcattggcccagctagcggtttcacccatagcccgccaagctgctctgcttccgcacgacggcccaccacgacgtacggggtcacacagcatgtggaataagttcattctaggccccttaattttacaccgaattcgatttttatccttgaacccaaaaaacagatacaatcggtccctattaaaaccggtgcaaataaagtccctggcggtttagaaggcggttttggctgacgtggcgccaacgtggctagtttgacttgatcttcgtcacacgtggcatatgatgtggcgcttatgtggcaattcgatacttgaaaaataataaaaatcgtggccccatacgccagccacacacaaaaattaaataaaaatggtggggcccacgtgggccccacatgtcagccttataccttctttcctctcccctcttcatcctcaccctcttcccgcaggcgagcgaggcgggcagccggcggcgccctcggcgacctcgcgcgccaccgccgcactccacctccgaaccgccgcctttctctcccttcctcccccggccctcgccggcccaccgcctccatcctcctccccctgtgccgcctctgcagcagcattgggaggtgaccggtgagtagggagccacggcgttccgcggcggcggagaagaggcggctgtggcagtcggaggttcgcgaggaggaggtagcgaacccgtccgcggcaagcggcagccgatgaggagaggacagaggcgagggagaggagaggggagccggcgagctcgagcttgccatctcggccgcccgtcctcgccgaccaccaatgcgtccaccgccaccccgacgccgagctatggggccgccgggacaggcacgggcctcgccgcgaggcgcgacgacgaagactgcgtgccgaagaaccccgacttagtgttatccacggcgtcggcgctgtcgtcgtcctccgccgccttgctcctcgcctgtgcggctgtgccgctctgctccggacgccgccgcccacctcgctctgccccgcccgtcgcctgctccgaccgccccgctccaccgccaagcaactgagagagagagaggatggagagaagggtggcgcccgacggagagaagcccgcgtggcccgacatgcggccctccgctcgagcccgaacgatggcagcggccgccggaaaaccgcccgctcgtcttacctgcacgagctgattccgttacacattctggcggcggtgtcgatttgcttctcgccggcgagcccccggctagatgcgtcgtatccgccggtgaattggggatttccggttgcgaacacagaagaatgaccccatcatgtgggtcccgcgtggtcccacattttttattattttgtatgtgcctgatttgtgggtcccacagtttttattattttttagattagattgccacttaagcgccacatcattgccacgtggtacgaagacttagtcaaataagccatgtcgacgacacgtcagccaaaaccaggttcaatatcgccgagggacttcatttgtactgattttataagttggaggtaagcctgccaatgggctagattgaaatgggcccaatggattggtttcagctttgggtgtagtttggatggatggaaatggattgaggagtttaatgggctggactggttagggtggaggtggaaacggtttggattggattggtttttggtttctgatttttggatccaaattggattcagtccatggatttctttggatgcactagacagtccagtactctccaaagtccaaacctagcgtcatcagtcgtccacggctccactccttccgccgctgccgctccctccccttgcttcgcctcctccacctctccgccaccgtccgcgaatccgccgccaagccgtcgccggtcagattccctcccccaccaccattgcttttctttttccctggtttttctcggtctttgatatatcctggttgttttgtttgtgtttttttttgggtctcttcctgatcttggtggttgcgggtacaggtgaagcagaagaagaggaaggtgcgtgcgccgccgggcgctggcgaggatgtcctcctctggcggtccggccgcgtcgccaatctccctaagaagcccaagtaccacgacgtatgtgaacagtgtgattggtgtgatagtttctataagattttgttttttttgttggttttactgaggagttaacttgctcaagattacaatcttcgatgggtttatgtgcaggagttccaagatttcaagaagaagataaggaggtatagtgaatgcaggttcccttcatctcccaatgcaaattatttaacatatcattacagattgagtcctgatatgattttgagatgcaaattaattctatggtcaatcgaattttagtgtgcaatttttagattgtagcacatgtacaatgtgtgaaaaaaataattatagaccatgttctttcaactatcttgattttagatttcttcctctatgcagacaattgaacaaactcaataataaatatgtccatacaaatgtcagagagttcaggtactaatagtccaaataataatcaatcttcaagaacacgtaagagagctaaagtatgggaacactttcagcaagaggttgtaatgatagatggtgtccccaagactcaatgcaaatattgtagcttaagattgacagccaccaaaaagtcaggaacaagtcaccttattaatcacatagccgaatcatgtccagctattgatggtgatgctagaatcaacttccttgcaacaattaagaaacagactggggaaggtttcgtgtttgttcccaagagaagccgggagctaatggtcagattcttcattcatgcagaggtgccattcaagaaaattgaggatccttattttttggagtgggtggagtccatgcagccaactttcaaagttgtggggcgtcaaacacttcgtgatgatgcctttaacttgtatgagcgaatgagggaagacttgcatgctgaattacataatcttgattcgcacgtatgtctaacatccgatatgtggacttcaattcaaaatataggctacatggttgtcacagcacactatattgatagagagtttaacattaagaagaaaattataagctttaaggaattgaagtatccccacacgggattcgccattgaagaagctataatgagttgcttgacatattgaggcattagagcaaactgtttactataactttagataatgccagtaataacaattctgcatgtcaagagttgataaagaatcacaagaatgcattgatgtttgagggtcagcatttgcatgttagatgttgtgcccatatcctaaatattttggttcaggatggtatgaagataattaaacctataatacacaagctacgtgagttgttgaagcatttagattcttcagtatcaagaatgcaagatttcaattctatggcaaactcgaaaaatcttccttcgaagttgagtttttcttttgatacaccgactagatggaattccacctataaaatgattgtagaaggattaatgtacatatctgtcctggatagctatgcaaatcaacatggtgaagttgcacctactgaactagaatggcagaaagttgaatcaatttgtgcttttcttaaagcttttgaagaagctacattatcggtgtcagcagataggaaaccaacagcacataggttcttgcccttggtgctacaaattcgtcatgcattgaatgaccctgattggcagactagtgatattttaaaggtattggctgcagctatgctctcaaagtttgtcaaatattgggacagtgggtttaactctgcacttgtcattgccacaatgttagatccaagaagaaaaggagattatttgaatttcttttatgagaaaacatctaacagtgtgacagagattgtcaaaaaagtgggttctgctgaagattggttgaaggattattatgaaaaatacgaagggtttgtaagaagaaatgatgaacacatgctttcacattcttgtgaaggcagcaacagtgttggatcacctgttcttgggaaaagaaaactcgaggaagagtttgctttatacaagtctcgaaggagaactgcacggcaaacgaaatcagaatttgccatatatttagaagaagatgttgaggaggatagtgagagtttcgatgttttggactggtggaagagacatgctcaaaaattcccagtattgtcatctatggccagagatttcctagcaatacccctcagcactgtatcttccgaatcagcattcagttgtgggggcaggatacttggtgacacacgaagttcgttaacacctgaaatgcttgaagctctcatttgtgcgaaagattggttaattaaagccaacgatcctttgatcaatattccaggtgctgaaggtataatagtgataaatgattcctccataaatgttctgtgtatttcaatcatgaagtagtgatcatatatcatttacaggtggaaatttgtcctgatttattcaggtggtgaagtgaagaagatggaaaggtgactttccatatacatatatgcaactttaaattcaacttttcctttggcgtattggaaatttggaatggaatacttctcttgaacctgcatttttccaaaattgagtttaccactttgttgcctattctgtttgtatataaaatgttactattcattatttaccaattgaatcaatttggcacattgttttgataacactgcaaaggtcacattatttaaattgttattgtaattttgtatatttgctttcttaagcaacgaactcacaattttctagttattcctggatataaatttttgatgacatctacttctttcaggttactgtcatctgcaagaatgtgtggctgagaattggaagggtttttggttttggttatcttagaaggtaatctaaagattgagacatgaagaaattattggtgttcagttatacatggttctgaggcttgtaatgcttgatagctttttttgttagagattttctcttgagcctgttgctctagtagaatctctagtgataattgtaatatttagttgccaaaacttgttggatggcactacttaaagcatcaaaagttctaagtatgctagtagtgttgattgattatttttgcatcttgcttatgttatttgtaagtatgctagtagctgtatgcagcgtgagtgttcgccggctgctctgctctgctctgcttcctgccgtggattgggtatgggttggaaaatggattccacccgtggattgtgttgaatctggactgagcaactttgtgggttgggttgggtggggttagctcaaggaattcttggtatggattggagtgacaattttgctatagtcactttgggttgggttggattcggggtggatgccaacccattggcaggcttagttggaggatgtgatgtatctggtttttcggttcgaggacgaaaatcagattcagtgtcaagttaagggacctagaatgaacttattcccacagcatgtcgctccctgcgccgcctcgtggcctcgtcgccgtcggccgtcgccctcccgccgcgcgccggcgacgcgcatcggtgggcagctggaggcgcccgcggtgcggcgcagcgcaggatccatctccgaatctccactggcgctggtgtgaggaatacttgctccctctctctctgtccctgtgtcccgcacgaggtcatttaggtttgtttgggtgtagaaaggggatcgtcgacatggggagtgcgggcattcgtccggttaaacttccaactgaaaaattgatgccaaaatctgatgccgcgactcatccgatcctgaatgaagttgaatcacagcagcagctgtgctggcgctgtgaagagctcaaaacgagtcccaaatctgccaagggaacgagctatggataagcgtagcgtaccaggctagaactatattgtatgccaagatgctatgcaaatatcagcactataatttagcttttatcaataggaggacacgggagaccaatggaaactgcctgatctgatccactcttcagtcatagttggcattattgcaacaaaatattgcactttagttccagtactgttatttctaaaacaacacattgtgtatgtagtacataataattaataaaatgatacattcactggcttggacacatttatagtagtatagtagatgatatcttgcgagaaaatttaccacacagtcaaacgacagatctcttcacccagaaatagaagactccaacattgttcaaccggcttcatcaacagaaacaagcatctccaccacactttccatggtgggtcttctggctctgtcttcttccagacatgaaactgcaagctccatcatcactcttgcttgcaagttgttgaatcgagtgtttaatctggcgtcaatgaagtcagcaatccatgactgttcatccccatcagacgttagattctctgctagcattctaatgattcttccgagaaccatttccacctcctcatctttgtttgtttcaaggtccgaaacacgagctccttttagtagttctagaagcaccactccaaagctgtagacatcaacctttgctgttatcggaagactagaaacccattcaggcgctaaatagcctctagttccttggatccgtgacacgtttaaattggatcctcctctatgtagcaactttgcaaggccaaagtcagctatctttggctccaaattctcatcaagcagtatattttcaggttttatgtcacagtggatgacccactccaagcactcgtgatgaagatatgccaatcccttagccacacctagagcaatcttaaatctttgctcccattctagtaaggcttgtgattcctgactgtcaaacaatattttatccaatgaaccgttctccacgtattctgaaaccaatatcctgtgtgaatcatcagaacaaaatccccaaaccctcactagattcatgtggtagatcctgccaatcacactcagttcatgcttaaattcttcttccccctggtttatgtctagcaactttttcacagctactaccctcttgtccttcaagacccccttgtatacaacgcctgatgctccttgtccaattgcatcctgaaaccttctagtagctgtcaccaactctctgtaggtgtatctgcgaaaatggttggttatcatttcatagccaacctcagctagttctcttagttgtttgtcctccctttgcaaaataagtgatccaaatataatgaataatacctctacaacaaatattgctgacaagaaaccatagaagtaccaatacttcgattcattttgaccgctcttaagcttatccaagaaatccggtacaaaatatttgtcaactgtagtacagtatttgacatatttctgatcaaaaggctgtgaacgggggacttgatgatccgacacttttaattcctgaggaagcttaatatacatggtaccagtactaccaattaagcttacaccactaagaagagcagtcttcggatagcaataaccttttccttgccagtatgcaaaccccacacagttgctgtcattcaagcatatcttcttgcaatcgtgcaaagaaacatgaggataagcccttatatcattccctaagaaatcagtgtttgggagcctaaggagccttactttctgttctctagtgatattgaactttgggctgcagcctttgctccaatcgcttgggtcactgaactgataaccaggggcacacacacatgtaggcgcaggcctatacacacatattccatttataccacacacaccacgtacattgcagagctgaggaaatgccatccatgtgactgaccatgttccgcttgaatcgttcagactgtacaacctgagattgccatcataatctagtgttaatctcctcataatcctaggacccaaatcagcagctgtgaagtttgcatcatcacttccaagaaaatgtccctggctatcaacagcaccgtttgcagtgctattaaacggctttctgtgcttctcccagatattctgagttggatctggccagtagatcaacgagagatccttctcatcataaaacagcgaaagtagatattgatcatcaaagtggaaactaaagcgaccaggggcaagtaatctattagtagatatgagcttaattcgagcagtaatgttttgagtgggtagcaaggtatcagtaggaaaagcaaagctttcccatagaatggtgtcacctttgctcttcacgatgaggtttccagtattcaagagcttagcttgaacttgctccgcatttgaagagctcacgttgttggtccacacaacctggccattataatctttcaacagcatgccgccatcggatttcaactcaaattttgattcccatgtgtacacagggtggagaggatttgcgctccagacaacagttttctcggaggagtttgagaaccagatggagaaggtggaggcattgggggagatattgtagaagccacaggtgaaagtacgatctggtgagtagagcagatccaagctgcgttcaacagagagaggggagcctggcaagagggattcaagagctgaggaggagtacaaaagcagatggatcaatgtgaggagaagcagagaggtgaagattgcatccatggtggttgccgcattcaagctgatctttcaaatgacaagcaatgcaagctgttatcggaactagctgcccaaacttgcagaaaaaagtgagattctaacattctatatactactacgaaggtgataagactaaattcagtctgccagttattttgcgtcaatgggcagtttccttggaccaaactatgcaatgcaagtaccatgttggcaaatgattcgtgtatacatttccaacctgttgcacaagtggcactgtggcatgacgtgtccttgtcaggatccgtaaatctggacagtaaaataagatttgcaatatggtaatgagttcagtgtacttcaccagtccataggtccatcctaaacggctgcacatgcacatattcatcccccatttccaaagaagcctgacttctaacatgacggggaagctcaggctttgaacatttgaacacaaaaataatggcaattggccatgctaatttttatttacatgtggtacttcatgcattgtgagtttgtgattgggtccctttcagctttgagtatactcacgtggaatcttcaacgagagatttcagcaagcatacacagtaaggagagtttaataatatttttttattggctgaacaaatctgtgaagacatttcttccgatcaaatgcccattgcttgaacaaaacatttacatccttacctaaaataaacaaacttaatacgggacgtggacagattcatcgactttgttcgtttgttacctttttcagctcacatcccccaattttcacatgcacgctttttaaactattaaacagtgtattttttaaaaaaatttctatacgaaaatttctttagaaaaccatattaatacatttttttaaaaaaagctaatacttaattaattatatgctaatgagtactttctgactgcaacaaacgaactcagccttaaagatataggcaacatatccagacagagtcacgaaggggatatcaatttacaccaaacaatgctgtaaaaacagcttctcagacgacacagcacagcaccagggttcataattccaataaagaccggtcaaatacagtgaaatttcgagatttcgatgaggctcgaaagtagtaagctgtatgagatttcgatgagtttcatccaaattcaaatctgaattgataaaaaagaaaaaaatcaaataaaatcttataaatagtatgatattcatagaacctattgggatataaatttttgaaaaaacatcaactgtcatagtaccacaccattgtacacgtacgcgcgtggcgcaaataattttgggttgcctacggctcgggcgcccgagcgatttggagtaaaatcgggcgctgacgtcagcaccgatttacgtgcaaaactactttaaacttatttttctcttaaattacttatccaaatcatgatccgattgcaccattaaattcgttgcaattaaatcttaaaaacaagaccacacatggatatattccgacgaaaaaaatagcttattattgaataattttaaatattgcacgatgttctaccaggtatatcggaattgtttcactaagtagatcgaaaatgtttcactcgtttagatcgggtgttgtttcaccttatataaaaacaatgtttcaacaaatatcgaaagaatgtttcagttaactgcaacagttgatccatacatagtgaaacattataagtacactaggtgaaacatttttcggtggaacaaaaaataaaacgaattccctaaatagggggttttcaaaatatatgggtttttttttgcaatggaatatttttattcaatgcaacattagatctatacataatgaaacattatgagtacaataggtaaaacattttttgtaaaacaaaaaataaactaaattcacttaatagagagtttccaaaatatgtggatttttttattgcctccagggatatgctaataacatcaactgaaaattttgtatcgatcttaaattcgtaattacatcagttgttcagggttcagctagctagctataggaagtgtccggcatggtaggattctccgtccttgggatgcttaatctcgccgttacagctgaagcagaagtccgtccgcgacggcgaggtgatctccgggatttccaccggccgaccggcgggtcgtcgccagcggcgaggccgccaactcggtcggcctcgtcgtccagggaccggaggcacgtcggtatccaaccttcaccgtcgttacgcacctcggcgaagaagagccgctcctcctgccgcaaggtgccgccgccactggcggcggccctggctatgaagttgacgtggccgtagtcggctctgcaggtgatgatgacgccgctgatgatggccctgacgagctcgttgacgacgccgccgccgccgccctcgacgacgagggcggcgttgtagtgctccagcgccgcctccgcgtacatcacgctctgccgcatccagtccggatcgtcgggctccatggtcggaaacacctcgtagttcggcggcggcggcggcggcgtgtagtgctgcttgggcttcttcttgtttttcttcttcttcttcttcctcctcttttcgccggggcgatgaaacctgttgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacagtagcccccgagtcctttgcagtcgaccatcgtagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcgtacgcggcgcctaaataggcatgctagccgactgctttttagccacaataaaagaaatccgagtggtttacactctaaaaggttcacgaatgaacacacttgacaggcatccgaataaaaactctaaagattactcatcaagtattataaagattatggtaataaataagtcaaatagcctaggccatgactatttaccataaaaacaggcatataagacgccaaggaaatgactataataaaaacaagtcattcctagttaacccaaacagtttttgtagcctaaaaaagcttgcaaaaacagcataacgcctttctgtcgggcacctttttaatttgcattgcaataattccaaagaattatatgaccgcataaaaaggattttatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgcaaagctgcgcctgcgaactagggttcacaactccgaccaaatccacctccgaaaagtgcatcaaaatccttctcgtgatccaccgcctcaatccctcacctctcccaagccatccctcgaatcaaatcagcacatttgagtgaaaccgatggcggaagagggagaaagcttcgaaagccaatgggcgacatccgacgtaacggaggagaatcttaaggagatggtggcgcacggcgttctccctgccaaggaaatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaaaccccaaccaaacaagaacaaaccgtgtgtagtcgggggggcaggattccaactaaggggaactctaagccaaaaatatttctcgatgcccttcaagacttcgaacaaaggatggcatgcgaactggttctatgttcagaatcccgagcctgctcttcccgggtactcttgtcttcctccaatgtaccaagacacttggaactctcttccgatcggagatgaagcagtacaagccttggagttgttggatcgtatgttaaatcttaaagaacaaggcttacagggagagcaaatcactcggcacttcatcaaatgccgactggcgccaattaaggaaagatcccgcacagcattcgagttcgacggcaaacatgatcccaaccgtgaagaaccagactccttggatttcaaaatcatgaaggagaggatgtataaaatcttctcaaatgcaattgtagtcagctactctcaccaactgccggtcgtgccattcaacgcattcaatccgcctccacaggtatgcatcggaaactatcaaaccatgatcagaacatagttttatcttcatgctgaattgactaactatggaagcatcttgtgcaggaatatgcattgatgaagtcagatccaccagtctctcagcgccggtctcctcgccaacacaccgctcagggaggtggagggccaacgatcagaccagatccgcaacctcagacctccaaattggctggtcaaacaggtcctcgcaagagaaaactggtacttgatgatgatgaaggcgacgatgataaaactggggataagggctcgcctaacaaacccccaaagcgcaccatgcccaggaaaaaactggctggccgcgcaatgccaaagatcagaacatcttccaggtattagacctctcggtataattccgcttcagcatgctttccgatgaaaataatgctaaatactgaaaaaacactctgcaggaaaccatctgatatagatccatctggaaaagaccctgatccggctaagacagagcaaaatatatccaaggactccgagccgactactgaaaaccagccgactgctgaaagccagccgactggcgcccatgcttcgggagatagggccaatccgagtgacctgccgccgactggaaaccagtcggcaacaactgaaacggcaacaactcaagagcccccgactggaaaccagtcggacgcaggccctgatcaagaaattcccgaagtagaaacgcagacgacgacttcgcaaggaccagaggctggtaacgactcgacaatcgggtctccgggtaaagaacaaagatcacttcacgctcagccaggtacatcttcaggttagttgtcttctcaaacaatgtcgatttaaataacctcagtttatctgtctaatggcttggaaacacatcaggaccatcaggagatgacggagaagaaatccctcgcataaaggcgaccgacgactctcgtcctcctatcttgatcaaatggtgggacgagaactcacaagccgcaggcatagtcataaaccgtcaaaaagaagatgaagaagtgtgccagctgaagaaagcgctcggagaagccactcgtattgtaaatgtaagtcttccgggtgacggccttcggtaactttgttttctttttagcagaacctaaccgtgaaccatcgtgcagagaatccatcttcgcaatgaggccaagactacaactttggaaaagctggttcctcatttgggaactcttgaagcggttagggaccagctacatgaggccaaggagcacgccaagaagacggaaaaggagttaagggaccgaatcgctcagctccaggattcaaactatgagctgagtggttcatccaaaggtaatcatccagatctgttccattgaattatgctgtcataattgcatcctcaaacacttggatttcaaacagcgcaagccaccagaatagctcagatggaaaaacagattgaagccttgaaaaaagacaaaacagagctggctgcagaaagggactcagccgtgaaagaagttgaaggtactgccggctgatgatctgaactttcctcttttaaatgcagtagattctgattataaatgtgttttgtagaccgtaaaatcaagtctcaagctcagtttgacgtcctggttggtaagatcaagaggcttgaaggagcaagagatgacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagcatgggagctggcatggccttggcgatgacaaaatccttgtacccgagaattgaggttgacaccattgatgggtttgcagacgggacaagtgaagaagctgcccttgatcttatcagtagtgcgcaaaatgcggctgacaaaattgcgagcgatgttgtagagcaatttcgcaacaacgacctccagccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagcttagttgagcctagaacccaaagaagctattaaaaactttcagtcctcgcaaactaagtagaaaaaccaaacaaggcaatgataaaccaagtaagcaaactaaattgataaaaaatcacactccattattatgatgatagcccccgactgacaacttcaaggagaaaacttgatgtttgacagtcaaaatagggaaatacagtgataaagttaagcgtagaaacgacgaagatgttcaatgttccaagaattgtcgacgagagtgccgtcttcgcgcttgagtcgatatgaacctggccgggtaacttcagagataataaatggtccttcccatagaggagataacttgtgccgatctcgtgtggtttgaattttccgtaaaaccaggtcgccgactagaaaggcgcgagatcgaacattgcgattatgataacgtcgcaacccttgtaagtaccgagctgactgaatcaaagctgcttcgcggacctcttccagtcggtgcaagtcgtccactcggtcttcttcatagcgttcttctcggaaattacggaagcgcaaagactcaaattcgacttcactcggcaacattgcctctgccccatagacaaggaaaaaaggtgactggcctgtggcccgactgggagtagtacgcaaagaccaaagtactgatggcagctgttgcacccatttgccggcatagggttttagccggtcaaaaatacgcgctttaatcccttgaagtatcatgccattggctcgctccacctgtccgttgctcatggggtgtgccactgaagcgtagcaaatcttaattccaaagtcttcacaaaagtctttaaaaactccgccagtgaattgtgtgccattatcggtaatgatccgattgggcactccaaatctgtgcacaatgttgatgaagaaatcgcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtttgtaactcttgagctggcaagtgaatttgtctggcgaaaaattggcaaccttcgcacgtgcgcacaatcttgtcggcatcagacactgcagtaggccagaaaaaaccttgccggtaagctttgccgacaatggtgcgtgcagcagcatggtttccgcatatcccagaatgtatgtctttcagcaattgtctcccttcctctaaagatacgcagcgttgcaaaattcctgaagggcttttcttgtataactcagattcgtgcataacataaagtttgctccgccttgaaatccgctcggcttcatctttatcttgagggagctcttgagaagttaaaaatcgtatgaagggctctcgccagtcggcttcaaccatagctacatcatgagtgtccgcaacttgagtggtatctttgtgaggtaccgtcggcgtataaaggtgttcgacgaaaacatcagagggcgccgcctcacgcttggatccaaagttggcaagtctgtcggcggcttcattgttgtgtcgaagaacgtgactgagctcgagtccatcgaacttgtcttccaacttgcgtacctcttgtcgatatgccatcatattgtcgtcaaggcaagaccactctttcataacttggttaacaaccagctgtgaatcgcctcgaactattaaacgctttatccctagggaaatcgcaatccgtagcccatgaaggagggcttcatactcggcaacgttgtgggacgccgaaaaatgtatccaaagcacataacttagtctttctccagtcggggaaattaaaaccactccagctccagtgcccgaaagtctttttgacccgtcaaaatgcatggtccagtgctctattttctccacgggggtatcctcttggcactcggtccactcggcgacgaaatcagctaacgcttgagatttgattgaagtgcggggcttgaatgatatgtccaaagacatcaactccaaagcccacttagcaatccgcccatt

SEQ ID NO: 61151 - DNA, 1531 bp, Oryza sativa
  unsure (1)..(1531): unsure at all n locations
acttaaccaaatagggatcttataacctaaaacttgtctaatctgttggcattactgtccctctggcgcaggagcagcaatacccacagtactctgttatgccacatacataataagattgttcactttcgaattttttttctgttttaatatttcttaactaatcgtactgaatgaaacacaaggatgagaaatttcatagcatggggccctggaggcctcgaccatggtcatctcatattcccggttacccctctctatattctctaattagaacaagtctaatttgcctcctcacagttgctagttgtctccctcatcctaaaattggatatgtctccccatcttcaaaaaccagtgcaagttgactgtggttgacttgctaagtcagcaggtgggggtccacatgttagggatcagaggaaggacttctctcctcctcttctttgctcttcttcctcgcgcgagtgtgaccagatgaagccagttgtagccgaatgaggatgtagcgatggcgggcggggtggatggtcaccacagggctggaaactatagttggccaactgggctgctcggcacggcacagcccaggcccggccgtgcctgagtcgaggctaatcgggccggcacggcctgaccgacacgccgggccgtgccgtgccagtccacgggctaaatagtgtgggcttctcaatttttttaaaaaacatagtgcgggccccacctgtaaggctntcctctctctctctccccctctaacctctcaatctctctctactctctcttcctaaatccccatcccctctctcttccctcccctgatgcagggagcggcggcgcctggtggacgacggtgtgcagccatgggcggtgagcggcagcccggtggaggcgagggaggagaaggaggagtcattgctgttatcgcgctgcgcggcttggacggaggcgaggttggagcggtggatcttggcgacgagcgccgtggaaggaacgaagaggaggcgacggcggctgcgcggcctcgttgacatcgtcatgggggaagttggtgcgcacgcgcgggccaaccaagaaatcaaacagccatggccaagaaaccgccatggcgaggaaaaaaccaagcaatcaccgttgctcgctgcagcagggagggaggggagagagaggggatggggatttaggaagagagagtagagagagattgagaggttagaggggaaagagagacgagagccttacaggtgaggcccacactattttttttaaaaaaattgctgactggactaccacgtaggactgaaaccatcccggattgagccagggggggttatttgtccggtttgcataattaagtgtgtaaaatatccgtattcgagtttggggggggggggggtaattcgatcgcccataatagttcgggggtaatttgtactttttccataaactattgatacacatgtatgttacaaagacgagcaaatgctactacctccgtcctaaaatataataagttttaggagtggatacg

SEQ ID NO: 61152 - DNA, 726 bp, Oryza sativa
tatgccacgtaggatagatacacaacgaatccatacctctcacagtgcagggtacgatccccaaaccaaccaccccaacctattctctctcccgctttcccctttctctccttttccctttccctctcctactttcactcccaccgacccgacagagccggagcgcgcggcggtacaggtcgtcgtcgcccacggcggcgcgtgccgtccccgcgaatctctcggtggcgacgagaaggcggagcgaggaggacggcggcggcgcggatctggagcggcggcggcgcgaggggacaacggcggctggcggattctggagtggagcggcgcgccgtcctcgtgctcatgctcgtggtcgtcgtccttggagtggtcatcggagtggtcatggcgggcggcggcggcgcgtcgtcctcggagcggtcatggcgggcggcggtcctcgtgctcgtcgtcgccgtcctcggagcggtcatggcgggcggcggcggcacatcctcgccccgctctctcaccgcctgccccaacgccaagcggcggcggcatcctcgggacctggcggcgcggatctggagcgtcctcgccgtcctcctcaacgacggcggcggtggtggcgcgtcctcgcccgccctcaccggtgacagtggcccggattggagctggagccggagtcgtcggagtggaaggagttcctgctcgggaatcaaggtcggccgggctgcagga

SEQ ID NO: 61153 - DNA, 1461 bp, Oryza sativa
gaatagctagcatgcgcagcgcaggaggcgccgcgcgagcgagtgtagcccgtactgccgtcgcttcgcggcgttgcgggttgcccccgcgtgcgtcatgatcacgtacagcctgctaacgactactgactagggtgtacttagttcacgtcaaaattaaaatttacattgaaattggaatgatgtgatgaaaaatttagaagtttatatgtgtaaaaaagttttgatgtgataaaaaagttaaaagtttaaagaaaaagtttgaaactaaacatggcctgcagagtgctcgcgagtgtcaatgtgtcatgtacaagtcaacgggggcgaggccgagtatacgggtcaaactaggcccatgtagaaagtttaaaccgtgagcggaagcaaaggaatagtttacttcgaatccctcaaattatagtttaaacctgattcatttctctaaccatcatactggatttcttgatgcttaactattaaggccatgtttctttcagctcagaattattataatccagattattgggagtaagctgaaagaaacagacaacttattaaagtagcttattataatctggagcccagcttattataatctgataagctcatttaggtgagctttttccagattattggatgaaaaattatccaccatgccaccccactccctctttagacttgcaaacctaataatctaggctctaataatctagaaaagaaacaactaaccacttattctactacagattataacaatctagcttatactaatctgactcaataatctagattataataatcccaagctgaaagaaacagggcctaaaacatgtataattggactcccgcatcagcagttttcactgacgtgacgtgttgacttggtccgcatgtgttgacgtggtagcccaatcacaaaatagaagttcggcccacatgtaagtgatgggaaaaataagaaaaaatgtagggcctacttgcagtgcccttctcctctctctatcctttttctccaaccactccacacctggcacagcttaggtccgacccgtggtggccatcgtcggacaacacagcgacaacaaggctggtgaacgccgtggtggccacctccatgccgccggatgtgttacactacttctgaagtctatcctatcctccacgtcaatcacatgcaaccacgtgcgatcatgatctgcagttagagatagagttcctattatctagttaatcttgttttgcatgcgatgtaatctcttccaggttgttaggtagctccctggtgatcgctcccaggttgttgggcaacttcctggcgcacatgtatagccacaatcggggctgttccgatctaattaacacgaacgctccgcacagcgtgagtgcgagagtttccatccaatagagaaaactcacatggtatcagagcgttgatccaatctaccgaaaaatcaatcc

SEQ ID NO: 61154 - DNA, 2453 bp, Oryza sativa
cctcacccactaagcaaagtattaaactaattaaagcctagttcatgcacagaaccgaggcgataataaattgcaaggcatccatctcacgggcaaataacctgaggagatcgaagcgctctcggccgaacttgaggcatgcgttcttcaacctgttcaggtccttggatgggtaattgtcggccgaggccccagggtcctcccccgccgccgccgccgccgccgcggcggtcgcagccacctccccctccgcagcatcagcgcgagacgcgagggtgggctgctcgaagtaccccttggcccgaagcttctcgaggaaatcgccccactcgggccacggatgatctggtgctgcggcggcggcaggagcgtcggcgacatcccccgcggcggagcagaagcggagggagaggagtgggccggtggggaggcggcgggacggggcgggcaggagggaggagcggaggaaggaggaggtgagggtgagggctaggagcttggaggaggaggccatggcggctgggtgcgatggtgtcggggaatcaggtgagcagggatggaggcgggagcgaggaggggattagggtttaagggtttagaaatgtcgcggtctcgtttagcgtccgtaggaaactagcaatttatcatgtttttgcttcaattttcaagttgtaacaccgttttatacaagctaaatttctaaatgcaaaaacagtaaaaaggttttatcttcacaaacgggattttcatgtaatttaacacgagccaacaaattaaatttaatacacaactcttagcttctactccctccattctaaataatcatctacgtatttataagatagagtaatagatagaaaactaagtggtataatgtataagatatgaattatctctatatttatactaatattgtgtgcaagttattttagagagattatcttcatagttacaatgtgaaaagaaattatcaatattgtgtgcaaattatcttagagatttatctatatattatattatcaaaggaagaggaagccatggcagtattgtgtataaagtagactttgaaagcacaattgcgttagacatatcgaacaaccattaacttatatatgcattgatataattatactccttatatattcgatcaatcatgaattaagcaatagcttaactggttggttttttttatggtggaacctatccaaccaaattcaaatataaaaattacgatataaaataatccctctatttcatattaatatatatgtgtgtgttgatttattaccatatatacgaatgtgggcaaggctagaaagttttataatatgaaacggaggaggaagtaatacgtatgtaaaattcactattaatttggtttatataaacactaaaatcgtacatgcatacaaacaaatccaatatagtcggtctcacaattttatttgtcaacattaatagtgtgcatgtttaatcaatcaacattagtttaagtgaaaacattaatatttttagtctggttttcatattttcatgatatagcatagaatacatattgtgttattttaacctaagcatctatgtttattatctttttacatgattaaatgtttagagttcttttaagtttgcccccctcttctaaagctgcaatccactcgaaaagaaagtagagcaagctaaaatgctttcagaaaataaagatggaacaggattttacactgttccacaactttactccaaacctatcgagttaaacaataataagttaaaaacctgctaagaccctgtttgatttagtttaggattattatgagtaaactgaaacaaatagatagcttattatgatagattattacaatctataagccatactactataatctgataatccactttaaagatgattttttaaaaattattggatagctaacagctaacaaatagctactaattaagagacataaaggttatgcttattataatccagcttatagtgatatagctaaataatctagattacaataatattattaagatgctcttaatcgagctaaccagcctttaagtttggaacaaaaaatcaacctatgtgtaacccttcttttgcaaccgatacccggttagccgctaccaaaaacccgcccagcctccagccacacggcaccaccaccaccgtgtagccacaaaacgcccacacatcccaccgtgtaggtgcgctgcggtggcgttggcgttggcgttggccggtggggtgggtcagtccggtccacgcataagcctccaatccccaccaccaccaccaaccggcacacaaaccagagccagcgcccacgaattccggccgagccaaccatccccggatctgatccagccatccatgcctagctaggtctagccaagccaagccagccgtcccgtctccatcccaccacttccccccttccagtccg

SEQ ID NO: 61155 - DNA, 1307 bp, Oryza sativa
attgttctgttttggtactgataggagcagtcaaaagtttcttttctagctcattctgtaagctgagtctaattgattctttaagacatcgatcagatgaccattttaaaccagttgccttttacggttttgcattgattatacatttatactagtgaaagagccaagaggagaagtggagaacagggtagagaggcatataacccttgcctgaatccgaacaagtttgtgagttactgagttagatgttttttggaatattgctgaatagaatttgttttgccaataataatcgctctgccatcctcgcagactatccaacaatatttccatgactaggatattttgaagtgaactgtattttgagttaaaacattatatatttgccaatagttcacggatagaaattccgtagtggatcttggtagtgattggtctgcacagttgatagatctctgggtgcttgcagcagttaatcgccttactgtggagaaagcattagggccaacagattacctgctttgcacagattgaagataatgtgtagaattggtgccttggtatcccagtttgactaacatcagaatgccttctcatgataactgattacagtccctaaattgatatgcttttgaagtatctattttgaattgaagcttggcatggttagcttatatgaagcttcatatctcatttgcgtgccatttcaggatgtgtagcaatgagtcctcttttgttttcactccgttaggccccttgtcagaggactgtcttctcttccatgtttttgtgctaaacacaagcatgccattctaaatatcagtgtgcatgcttaatgtaatgttttgcaagtgaattgatttttcagtaagatggtgctccatgcagccttttttttttggcaggcagatttgtggctcatgtacagttattatgagatattgggaacagtggtttactttaaatgtcctgttgacctggcaaaaggtcgggacatccatgttctcaactctcaatcgaatgtgtttttgtttgcactatgtattattcatattttttatggttcctaactggtgtattttcctgtgtaagtactgttggtttccagtggtctcagcacaccatgcaatcgaccaaaggtcttgaacgacagttacaatttcaagcatgacatatgtactcagataagagaaccgctatgtgttcaaaaagataaaaagatgcaccatttgcagttttaatctgtttttcccccgtcctgtgacaacataaagaaacagatcaatcgagtatacgtttgagtggca

SEQ ID NO: 61156 - DNA, 1541 bp, Oryza sativa
cgggggccgcgacgacgacaggagacggccgggaggcgcgcagttcgacagggcgacgaagagacgctcgccggcggcgaggtttcgggtgatggcaagaaatctggcaggatcagacgtgccagcctcggccggaactacagttcagagatcgaggattcagctgaggatgatgaagtggtccgccatgagatcactgcagagagcgaggtgaaaccgcggggtctgaccaggagcgtgccggtatcagtcagaacaaagagggtgagttagctgcaaccagatggcaacaagagtgatgggagatgatttcttgattcgtgatattagcagctgctattatatttttgcagattcatcgttcgttagatcctaggcctgtaggccattgcatgcatgtaattaaatggagcctaacaaaaaaaaaggaaaaaaaaacttgattcagattttgttcatcggttagtaggagggagcaaaagtcagcattgtagttgatggcaggtttcatcattgattgtagatatattagaggatggattgattttatattacaacaactgggaccaaaatattcctctaatctcgttacctctggggaaataaactaatgcagcgatactactaacttatatgcattaactagaaatttcaacagcagatatgaccgggtctggactacgagtattcatgaactgtaggcctgtagctggtaaaacttctctcatgtaacctacatttgatttgagaaactcccatgctggatgatcagcgggatactttccttcttttactgagactcgtcagcatgtcactgtaagactgcaagttaacaccgacatcttcatcatactcgagaccaagctcttcctgcacagatacatattattcattaaaatgatgaccgtgctggatgctagcaattggtaacttttcaatctttttttgcagggcagaaatgagaaaatctgacaactaaaaattatctttcctgttgtattaagagaagcatctagtgtgtattaactactaagtgcaggtaaatgtaaaagaaagaagtgcatcaaaaccttaaattccttctggtctttagggctattctcagtgatattatcccatagctccttgaacatcctctttcgctttctccactggttaactttctcagagaagctctcttcaataatcttcttgtcctcaggtttcaccaagataacaccattcctcaatttatttagtttctcttccatttcctggacctgcaaaaatacaagacagccattcttaaaagttaatacaaggaagacattgaaaccataaaagataaaaaaaatcgcatatatacataacggaacacgtttatgcacatacttctctttgcaatttagcttcctttgacttgatctctgctaaagtcaagtttgactgcagacctcgtacctctgcaatagggtttgtattagacatttccatactatgataatggcactcagcattgaaattaaccaccaataagatcatagcatgaaatggaacctacc

SEQ ID NO: 61157 - DNA, 671 bp, Oryza sativa
gcccgtaggtgtagtacaccaaagaaaaatgtcaaagtgcgtgtttaattggtgatatgtcaagattgaggagtgggtgacaacgtggagtagctttgaagtggatcatacagtatactattcaacatggtacggatcgtgcaaatgtccccatctcttcattttataatctgtcaaagatcgcagctacttgttggcacgacgttgatgaaacttccaaagtttacatatttagtatttcattactcatttcaagaggtatatataaggtgtgtccagacttcagacttcagacttcagactgctcgagtcgttgctaaatcgctattaattatgggttgactcgtacgtcagtgggtaatgcagattgcaaccctgcaccaatcaccacagttatgatagtctagtctatcggtgtcctttgcattgagtagcaaagaaaggatcacttgaactgaagtttcatctgaatttgcaccaaatggcacacctatcactttgtcaaccatctcatatcttggtttctgatcgatcatagtggttctaacctggtcggattaattttttggcaaatgcttcaaggggctgaacttcttggcgatctttgggttgatcatctgcacggcttcgttcggcatcaacctggtcctgagggaatccatctgagctct

SEQ ID NO: 61158 - DNA, 613 bp, Oryza sativa
cggtatgaaattcagcagtgggttttattcatgcttgttgtgcctaaatgatttgcatacttcaactgaaaggggctcagtcaacgaagcatgtatactctgtagtctctccagattttttttaaaaaatgtcgatttagaaaaaaaaaattgttttagacgagaacacggtatcctaaaaatgactctgaatatatgtagggctattaataaatatatatgattatactgaagtaattttcaagattaatctatacatattatcctatgtttttaaagtagatattatttatagacaatttttaaatgtttaatatagtttaaaagacaattattttcaaagtaatttcctactaattatcgaaagaatctggcaaatctccttctatacgaagtgcttccgcagccgctgtagtcacctgcagaatccaatgcaacatttcggcgacagcaacaaagcagtctcggtttctgtttcaattcttgcgaattcaagaactgcatcagttttcagtccgtgcggctcgtgtattgcgcgtatcgactactaccaactcccaaccagtaatgaattgcatcacccagttaccccatgagaccgaggatcaccggg

SEQ ID NO: 61159 - DNA, 748 bp, Oryza sativa
gcatatctcatgaagcattcaaaaatgacaatgacattgaaattgaagtagagtttcctaaatagtttagaaaagtagaaatgagtgtgtagcggggacgtgcaatcagttgttcttttcttgactttaatcgatcgccagtgtgcataataacagtcgttcatactgaacaagacgtacttatctgctagtcctggcctcctggcatcgactcgaacaaggagcaaagttaataacaacctccaatttcggggcatacgtgatccgaatcaaaaacctacaggatgctgatgcataactcatcttctgtttgaagtgtctccgtacaaccaagatcatatcaccgatgaaattattcacacgactctaattaagattcgacttatgtattttagttttttttccggtgatgaaaagttgtcatttgaatgtgtaccagtaccaaatcagtcctctaaacattagcatatactccctccttcccaaaatataacaatttatccaccaatattctcttcccaaccaatcacaatcctccaccattcactttttccacctatcttcactactcattcaatcacaatcttccaccactcacttctacctattttttttaataattgggtataaccctaaaacttcttttatattcgggtaggaagggagtataagcaaatcatcgacgtacgtaacccagacaaacgatttatcccggtcactcaacagcccagtgtgtcatgagtcatga

SEQ ID NO: 61160 - DNA, 726 bp, Oryza sativa
tcctgcagccctgacatcttgatggtattgccaagcggccaggcatattggaccaagtctattagcactattttttttctcattctacagtagaatacactcgcagcttacgcaagaatcaaacacatacagcacagctcaaacaaaaattcagaaagcttaataacttgagagaagctaagtccaaagaaaatcttagctatcaaatagtacatactcaataaacagaaccatgtaggagttgtactacctccgtcccaaaaatataagggaaagctatgcatttacattgccaaaatcccttacattttgggacagaggttagtatcgtttttgtaagtgtagtcataacattatattatgattagcaacatttctatggtacaaacaggcatacaaaccaatgtcatggcatggcttattagatgaattagttaacagcattcaaatgggaataagaatgaaatccaaaatggtagtcaaagatgcccttctgcaacatgatgaaaagctaaaaactcatggtgttttacttgtggcaagcactaaaagtaaagcaattcatcagaatgtgataaacctggtcagaaataactggtgctaacaatggtattgattcctggttttataaactacctgaggggatcatcaaaaggccaatttatgcccttagcccctcacatatttcatatgataatgtatcggtgtaatctgacagttaaatat

SEQ ID NO: 61161 - DNA, 730 bp, Oryza sativa
cctgcagcccgctcggtgatgagattgcagtaggactcgagcatgaggaaggcgtcgagcgtgttctgctcgcggatgacctgctcggcccggagcagggcgcggccggggtggccgaggcggagcagctgctccacgtcgccgcgcgcctgcgcgcaccgcacctgcctgtgcccgcgcagcacgccgagccgcgtcaccgccagccccagcatcgacttgagcctcgccgtctgcttcgtcgtccgccccagcaacacgtccagcgtcctccccatcgccgccggcctctcccctctctcacacacaaaaacgagcaactgcctcctcttccacgctctcctgagacttcgagctcggtcttatgtaccccctcgtgtggcgcgggtgtgtgaaagtgtgaaaatggaagggaaaatgcgagggaacgaaggacccgaggcgaggggatgtcacggttgattagatcgggtttgctttgtggcgaaggcgtccgtccgatttcggtgtcgacgtcgacgtcgagcgcgacgtgtatttaaagccgttccgagtaagcaagacgcgtgcggggccactggggccaggcggcccccgctcgcgctcgtgagtcgtatgacccgtgcagctgcaggtgcagccgtcctcgcacagaactggttcacaatctcccatggaccacgtccccgcggctcgctcgcaccacgcggcctcccgcgcgcaggagatg

SEQ ID NO: 61162 - DNA, 593 bp, Oryza sativa
atccacttgggtggaatctggcaaagtcgtgtgatttgtatgatcttcttgggtttcatccattgttccttgggtggatggtgtctattatgcttatctccacttgggctagttttccgagaaccgtatatgttcttgtaaatggtccacaagtgatatagtaggttgtatctgtgtaagtgctgatatgcattatttgcaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttgagtattctatagtg

SEQ ID NO: 61163 - DNA, 682 bp, Oryza sativa
aggatcagtcttgttagattagagatatgattaggagagtatcgccatcgtacctcgacatccgcggcgccagaggctttggcctccattgtttcatccgtacaatctacggcaattgccggtgccaggaccgagcctctctctctttcaccgaaatgaagaatagaaccccgaatcgggaaatttctcaagtggtcgctgcaagactaatttaaggttctatgctatgctactcctaaaacaagataaatatgaggtttctcttataatttccaggctaactagctcgattaagaagcgattacaattgaaacaaaagtgagacaggaccacatcataggatgcactactgccagctcaaaagcagagtaaaatgacaactagaattcaacagtggtcccccgacaagaacggactctcagatcttcattccgattcgcgattaatcctgaccgttcttttctcataatcatccttccaatgcattttcttcagaatcttcagacttcagatattcagttaactcagagaccattcatccatttcaattcccagctcctgacagccgggccgtgacaacttggtatcagagcatcttcctgcgcctgtgaacatgtcgggaacacaaggaacaatgggcagagcaacgctgcgctggcagccatcctcgaccagactgaaa

SEQ ID NO: 61164 - DNA, 904 bp, Oryza sativa
agaaaaatcgaggtagttccaactatgaaataaccgagatagcagtcatgtctttctatttattaataaatttcctgtgatggctttcagattttattgtaccttacataaagttcattgttagcaacctagcatcaaagcttaccgctgtctcagaaaagcatttggtgggaaatcctttttgcacccactagaaattagaaaatacaccattttagtgcttatgttcgtttgttaatgacttgtttcaagtgtatctaatggtttagtgtggatttttttctccttctttatggctcttgttgatatttgttcattgttttggggaaccaggtttttaacatggacgctagaaggtttatcagttcaatatactcaagccaacatgtgcatccagtcacacaagtagtaatgaatttgcccaatgatgctgcagaatttttaggtgggttttcattatttgtgttacttaattgaactgttatcttgagttcttatgattatattagagaacaaatttcattctagtatggtattggcttaattcactcattcgcccgttgtgaaacatccactaaaattctgttgaattttggggatgtatattacaaaggatatgcacggtttcatgtcgggttctctcctctcacttttttactatagaagagtaagaacacacaatgccttttggattgtgatcagctgaaatgtagtaatttgtaacctgcatcttataacattgattatatggcattacacattgcagatttacagaatacacatcaaatgtgaatacgcatcgaatgtttgggagaaaaattgtttgggagaaaatctttcttctacaaaatggcattaccaatatagaaactaaataggggaagaaagtctatgagtggtaggg

SEQ ID NO: 61165 - DNA, 2550 bp, Oryza sativa
agcatttacatggtctaacttacataatttgttattttggttaaagtgagataatatacagttagttcatcatgacataaggatatgatttgctaattgctacccttgcaaacaaatgtattttttctcttcctaagaatagtttttctttctttttaacacatgtatctttggctacgtatttctaggtgatcctggaaccacccacaagcttggaataatatggttgcaaattttatgtatatattaaatgtggtctgtcgttggggcatgtgtaaattttatatagccattgtttcttaagagtaaaataagacaccagttattaaaattctgtgtggaatatcattgtggttattaagctttgaaaatacatagtatattaagaccaaattaatttgctaaatatatcgttgcaggtctaaaatctaatacatcagatctttaatgctaacagccggatataaagaaagtagataaaactaattgaggaacggatgttgtgattaattgaaaagtagatgtaggtggaaaaaattgaatggtgaaagtttgtgattgaccgagaagagaataatggtggagttattatgttttatgacaaattttaaatattagaagttgctatattttaagaagtaccactcaacgatacatttaggagcgtcaagatagacattgtattataagctcctcaaccaaccaatgtaaaagttcgaattaaaggcttcttcacattgctaccacttttaagttttaaccctaataatttttgttctgtaagtatgaattaagagctcttcaccttgcttccacttttaagttttaatgctaataatttttggtgttatcgataacaaactaaacataatattgtatcatcactctaccaaaatttgacatttcaaaagtttcttctcacataaatactagtaattttttttggcacgaatactgtaatttttgataatgctgcaaactaaacatataatgctacaaactaaacatatctaacattgccaaaatttagtaatactaaaatatgccaaaatttatgaatactaacttttggtttggtttattttcgtgacaaactcaaccctgaattccttaacttcacgttgcgcctaggactgacggttttcgttaaccgagggactgcactgcagtccccattaccgttcaccgttaacgggcccgcaattcaatcgatttgttggtcagcccatactgtgccatctcaacgcagcagctcagtagtcaaccaaatgtaactagtctcttcttaccggaatccccacaccttctcgccacggtccgacgcgcaagcgcggcggcgctcgctctcgcggttctcggtgacggcggcctcgtcccactcccgcccggggatgaacggcaccccgttgcgttgccatctctagtcgcgcatgaccacccgcgccggcgcacctctcgccgtcttcctcgtctcgtccctcaagtcggccgccgcacgcctcagccacggcgagcagctccacgcgctcgctgccaagtcgggcctgctcacctccaatcttttcgtccgcaactccctcctcgccttctactcccgcgtcgcccccagcctcgcctaccacctgttcgatgaaatacccccgctcctccgcgacgccaccgcccacaacattctcctctccgcgctcgcccgcgcgggccgcctcgaacgcgcgcagtgcctgctcgcggagatgcctcagagggacgcggtctcgttcaccactgtcatttccgccctctcgcgctccggtcatcctagcgcgccctggccgtcttccgcgatatgctcaccgaggccgtgcagcccaacgaggttcacttgcggaagtgctcacggcgatggcctgtgaccacggggcaccagcaccagttggtgctgcccatggcgttgccgtgcggcgtgggcttgatggatttgtcatcgtggccaccaacctggtccatgcatatggagcagtgtcacaggttccttctgcccgttccatattcgagctaatgccagatagaaacactgtcacttggaatacaatgcttaattgctatgtcaaggcaggaatgattaacatggctgctgaggtgttcggtgtgatcccagagagggatgaggtctcttggttgacaatgatagatggatatatgtgtgcggatttcctactgcaggctctcaggacatatgttgcgatggtgggtacggtgggcataagggccaatgaggtgatacttgttggtttggtcaaggcatgttctcgacattccgctgtctcagaagggcaacaactccacacagtcattctaaagaatggttttgacgctcatgcatttgtacaggctaccctgatccattattacgggtcttgtgattttattgaccatgcccagatgcaattcaaattgtcagacaagtcacacgtagcttcctggaatgcccttatggctagcctactcagaaggaatctagtgcatgaagcaaggcagctgttcgatgacatgcctgagagggacaccatt

SEQ ID NO: 61166 - DNA, 3423 bp, Oryza sativa
ggaaaagtagattagcatcacttatggaggtccccttggcctttgccatgttgtcatttggataattgcatctccgaacttcgatattcagtgttataagtgcttaattgacatgtctgataattaataatcctaggtcagtgatgccagcattcagtcttcggtacatgtttagactcttttactttttaaggtaaatgaatgacatccatgttcaatcgtacaaacattgtagtaatatggccagttctaagtgaatctttctagcattgatagtagttatttggtgcagtttgtatgtgaatacaggactacaaatattaagtaccacacatattttgtgtgcgcacggttttgtttcagttgcaagatgcattttgaatttgtaaaaaattggctcaaacaatctcacttgaaaagtttggagatgtaatgagatgttctgggtacacaaaaagaaaagttaaatttagtgttaagagtgtgattacttgtgttgtacaatagacatgtcaatcatcctatgctcttaaatcttaatccatgcttttttagtccatacacctttatattatttaaatattttgacgatcatgttatcttttgtaggttttagaaatatagctccctcaaggaacaataattcttatagactttgacacagtagggcatatttcggtcttcagcttcacatatgaacattaggttacaagaaactcaattgtcaggtaatatctcattatataatgcatttgttatccaatcttgtatatgctttcttttattctaatacaaagttttgaacttgctgctggtgctactcaaaagcaaataaaatatccaaactattgtcaacaagacagagatgatattttcaattattatggaattttttgcaatttgaaatcttggccggtaagtgttcccttacaacagtcactgtgtaacctttattgtcaaattgatattgcaactgtatatgttcttatcctctccttgttcatatttgtcggacatcgtttaaaatgtttgtcatggtataataacaaaaaataaaagtgattcagtcataaatattatgactgaaagcaatgcacttatttgcagcctagtaaaagagtggagctataacaagtaaggggaaatagaaaaatggaagttcatatgggacacgtgatagagatgattggaatccagaataaacagaatttagaggatgctatattttggatgtaatcttaatattatcatatattaacatggattcactctggaggagaaattaagacatctcattggcacattcatgtgtataggcacgaaattgaactaaaatcatgcccatacatgtggataggcacggtttttgcccatccaaatcctggccttatggaactgacaagtcctgtaaaatgtcatatgcgaatcttgaccttgtggaactggatgtcctgtaaatttttagatgttacatttccaagaagaatatgttctgtagacaaaaattgtttttctaataactagcattatgcctgtgtgttgcaacaggaggaccattatgaaattttctgagatatttagaaattattttgatgtatttcttatagacatttaatgtgtatggatttttagaaacaaaaactattttgaatgaaagtctataagatcttttaggctgaatctggatgttcccatccatccctcaaacccacctgacgccctcttccccagggacctagcccaccttattttccaccagaataagttcactcaggtccctcaatttgtcattgagtctgaaattcatccctgaaccgaaatacagatactatgtgtccctcaactcccaaaaccatttcaaatagggttaaaatgaggggctctggtgtgtgtgcggccagcaggggtgaggggccggttgggaattgagcagcaaaaagtagctgccccaatgttaatgctgcagtgcaaggtgtaccttccccacctcttttctctgtagcaaccttcatttgctgagagccaggcacattaagcagcacacatcctgaagcgcatccaacggtgcagattatgggtgcagatgctccagagttccaaacggcattttcatatattctggtcatccccttgcaaacaattgtgatatgtaatagtcaatttttttcaagaattcctttccgatctgaaataataaaatcataaacatggctcacgcgcagaggatctacccaaccagcagggcgccatcaaaacctggtcttccactactatggaaaggaatcaaccgagaccgagcaaggtgccgagcttatcctccacgccatcatggtaatccctagctcttgtagcctcttcctagggccatagaagctggcgcctccaacaattttggcgaatagcgcccatagccatgcagacccgaggggacattggtcggtcgtggagctcacagtggacatgccatcccaaagctcctctcacccaccttattagcaaaatcgaaccccaagacgctctgtacactcctccattcaataaattggccggagtccccgactatcgccaaagccccgaacctccttgagctcggccatggcgttgccatgccgcaacgctcgcccctgctccgccttgcgccgccaccacaggtggagggccgtcggaacccgttcgcacctcccttggtggtagccgagccatccccggccgagtccgcctcgcaccagccaacgctcatgcgtctacttcccagtccagaggttgaagacgacctcaggccgattttgactagagtcaagcacctgtcatttggtctacaaaattattcttaagagaaataatttggtaaatcagataaataaaccttagaccccacatgtcagccatggtaggttgtggataatgtttcggaataaaaataaatcaattaggaacagtactgtttcacaattattggaattacttcaaatttgaatattgttttgactatatctcactcattttagctctgatttgagtgaaacttgaacctgaattcatctaaatttaggagctttccaatggtatataattaattatttaataaaatttattttataattataaaataactaatgtcaaatggttagataatggcaaacctaaaaatgtgctaataaatgaaaattgtcattgtacagtaaactaggtaggagaataattgtctttaacatgttgtgccactgtagaaaccatgtaaatcaattagaagtattgtttcgaattaattgaagcttaggaaatactagtgccatttattaatatatgtccatatataattatacacatgacttccaaattatataaatgaattttagccttatatttttgtcactaaaaatatgaatacatatagatcagtccttagattgtttgtgagga

SEQ ID NO: 61167 - DNA, 711 bp, Oryza sativa
actgtcattttcattcacccactaaagaatatacaagatggttaatttgttataggccgtcctcttaacatgcaatgtaatttggctttgcaaacgccacagatactggaagggtaaatgatgcacaaagcatccattttccaggagcaacgagccgcactctatgcatttcaacatcggacacgttctcacccagcctcaaatttatcctctgcaattcaaggggtgtgtgtcaatcgataaacagaactatgtatacaacagttctaacttaaagaaaaaaaattttggtaatactcgctgcttacctcatggaagtcatattcaggatcttctgctttggagaatccatacacgtgtatatttggcattacacaagaaggcacagccaaatggtggttccatgagattcctctgaacacatctggggaaacagtgaaatcataaaataattaattggtcctgtgattagcctaactgtcaaaattcccatccaaaaaacatcggctgcatattggccattagaatggacaggtaaggttagaactaaatttcaatgttcaccctttttttgcataaatatactattttttttaaaaataatagaatatacctgatttgccaggtggcatgacaacactgctgttgccgctcggcagcagacggtgtcaccatatggccaggtaaaaccgaccacctgatgtccctaac

SEQ ID NO: 61168 - DNA, 724 bp, Oryza sativa
atatgcgtgtatctgatctgtacttcaagtcctagagggcagactacctgttagcttcgtacgttgtttcgggccatttatttccctccggaagaatattctttatgagtttcaataactcacaaaatgccttgtcagtcacaccatttttttgccttccattgaagaattccagcgtattacctaactttttatgccctgttcacagcctgggtacaagaacattttgtggtccgttaacatacgctcaaatttcgtgacctccttttcactttcgtagtccttctttgcgtcgtacaacatccgacaaaaatcatctgcactgtcattttctgcaacaggcccgcctgtcgcgcctgttgtattttcttcaaattcaccgaattgagcctaatctggaatgttgttatctttttcttcattttcaaccattggaaactgtcaaggttacgggtagggtataccctctacccttcgatatacgtcacgtatcgatatggtatgctcacgagtatacggacgtgttcgtcatacgttaaggaaattcatcatggagttcacaggtagaaggagtcctattcggtcaaaactgggtcgtcattgtgtcatgttcggtccggcttctccgagtcctacttggagacagttgacctgcgatataaaaggaacccctcggaaggacctaagcatcgaatctcagagccaacacatccaccacagccta

SEQ ID NO: 61169 - DNA, 1010 bp, Oryza sativa
tagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgggttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgggaatcggtcgtccgcgtgccattcaattcgttgatgatgcgggtgtaatcctggaggagcatcaactggagaccaccttggggggcactctcagtgtctatcagaatgccacgggcaagatctgcggtgtctggcgaccagttccccgtgattacaag

SEQ ID NO: 61170 - DNA, 778 bp, Oryza sativa
gcagatggcttcgccatagcaagttcaacttcaaggagacccaagacgccatcttagccgatcaagcccaggggccactgggccagcgttccccagtcggcccactagaagcccatgtacctcaattacactatatacccatgtaaatgtccctttcataagggcaatcatataaattcccctgtaaaacctaaccctaataggggaacctgtaatgggattataaatagacccctagggtcatgtaaaaggggggatcctaagaaaaattctcaatttaatacactttaagcggttgtcatttcgacaatagctggcgccaaccgtggggacctccgagcgaaaccactgagagcgaatgccaccgaagaaggtcgcaaaggagaatgttgcaaggcgtaaggagagtgaagcaggagtggagatggcagccgaggagggagcagaagccttcggcacttggtgccgaagccgatgtggtaccatcgactttggcccctgcgccgcaaccaccaccttcggctcctactgcttcgacggggcaggcaccgaacacagtcgatgcggcgaaggcggtagcagcggcaagggcgctctagaccagggcggagatcctttcgacaagtcaactggtggtgccccaggctgcttcgccgcagcaggctatagcttcgaccgcgcacagcacaccggaccaacctcaaagcgcaagccgaagccaacatgggggccatgcgttagaatatggtgcgactcccggacatgcttcgtcaaatgc

SEQ ID NO: 61171 - DNA, 1864 bp, Oryza sativa
atgaccaattcaccctcactgttcctttagaagggagcaaactatggatcaattatatatccgcactaaagcataaaggtggagcatggctgcatccacaattcattgttgatctcattgcgacaagatagaaaattgcaagaacaggagaaggttgaactggatgttaacagtggtcatccatggaaaagctaagccatagtccaattttttttttggacttcatgatggtattgtgcaaatcttcacatttgtgatgataacttgcaacctgctactattattatgataccaaccaaatttactctttctgaaatgtcttgcggaagaagtaatgaattattgtcgtgatgccattaatttttgaaaaatagttgcagttctatgaaatttaatcaatataatattgttattaaatagaagcaaacactttaaatggttgaaaccaaacgactgttgggaaaaagaatgattaccttcttgaccgtccagcaaagcaatgaaccagaacattgccaccagagctgatagattcatcaatgaaactaaagcattcatcaaaatgctttgccaaatcaatgtctgggctgtcaagtactgtatattggtaaacaaataatgatttaggagtgctggggaatttggacaagggcaacacaaaaaagagggtataatcacatcaataggtatttgaaacaccatgacacagtcaagaagtttaagtgctccatgcttatttcatttctcttgacattacagttttccagattgagtgataatctaacatgtctggtaaacttacaacacaacagatgaaaagtacataatttagaagtaaatgcagcacatttcttaaacttgcacacagagttcaaataggtatgtgaacttaagcgatgcgcattattactcctaaatatgcatacttcggttctaacttagttcttactggcaatagatgattgaatggctcattgcttcacttacatgacttcctccctccatccctcctcaccctctctactctctctgcatcctgccacaaccctaatttagttgttgcatccccaaacaacttcctcaaaacatagctggctagctggtaagattgaaccaccatgacaaagtgacctcaggcactgggatacgtgctgtacactacaggcagggagggagggaggtttggaatgttttttctaaatgattaatataacaacctaaaataatgtgtcagatgttcatgtcgaaaccgatggttggatgctttgttttcttatcagaatttttaggattttcattgatttaagataacgacgtaacatcttaagagcgtttataagatgttttttttaaaaaaaaatagatctagtgacctaaaataatgttttatttgattgaaaataatgtgtccatcgatttatgtctaatcctatggttggatgttgtttcccaaaatttctaagaattttctataatttaagaatttcatataccaacttagagttttttcttattagaaaaactaacaaatcgatagtctaatgctttgttcatttttaatatttgctagtattttatttaatttaatagcatcgtatagcatcttaaaagtgtttgtagcatgtttagaatgacagatcaggacctgctagacctagcgggtggagatatgtggtattttaatgtaaaaataatattgattttaatttctcatgaagaaggcttgttggtatgtacttgagagggaggttgtggatatgtgtgttttaaaagaaaaaacgatctaaccttcgaaaatgaaataatagatccaccaatttaattaaaaatcaatgggcaaattatagtatcacttgacgattta

SEQ ID NO: 61172 - DNA, 4807 bp, Oryza sativa
tcattcctctcaagtttagtttagtagtatctagctggtggaatagaaatagaataggagtccggagtccggaagccttcggaagagttcgggtatggctctagcagctttcctttcctcttttgtaagctttgtacttttattagaatactcttctatatacatttatggtattgaaatactttccgagtatatgagtacctactttacattacgttcatgttatactgaatatacggctagcttatctgggagatgctttggtgcgggtatagtgtttgcttatgcaattactctatgtcatgacgatgatattagagtagtatctggtagtttagacgtggtgtctagattatgagatatcattatttggggttatatattgcagatgagagatgggccgctaatggtgacacctcagtacgggtattcctccgcgcctatatataatccgaagttaatttcctgagaagggtattcctccgtatttagccccggttggatggtgatgacgggctgtcgtaagaaactcggcagtcaggggtggcttctcgaagtaccaggagggcatcggatagagggtattagctagtatattagttaactagaatgtatgtatactatgtatattagaagtataggaatagatttgttttctcttttctttccacctagcttagataaattgttatgaggatgagtagaaatgcttgtgtgtcactctacccttggattatcttaacccctgcttagaatatgattatcaaaataatatataaattattagttgagttctctctacatgatcttcccacgggataaaataaatatgatacccttgtaatactctcgggtgaaatgctacaatggtatatccgtgcgcttgcggatgaactctataaccataatataccagaagtgtttctgcgccattgcttggaattatatttctagtaaagtcgttaagaaataccaacaattttgcagctctgagctgtaggcgcttcgcttctgcttcatcctccgggagccagccgttcgagaggtactttaggaacagggttcgccagtcctctgggtcttcatccagctcggcctggtcgattgccatgatattcgggctctctatgggcacacttgatgcgtacaggacctcaaaaaagatgcttggcgaatgcgggcctccacaaccagcagatttcgtcaaggcatatgcttcctcattttggtctctaggtaagtgttcgaccgttatgccggcgaagcacttttccatagattgaacagcctccagatatctcttcattccttcctcttttgcttcaaaggatttgtcaacatgacttgccactagtttagagtcggttcggatgagcaagcaccgaacccccaatgctttcgccttttttaggcccaacagtatagcttcgtactccgatgagttgttggttgtgtcgaactgtagccttgcggcatagcggatcggcacgccccctggcaaagtgagcactgccgtgcgcctgcccctttgtgcaaccacgagccgtcggagtacatcacccaaggttgttcgacaggctcgggttcaggggcgaatgccagtgtccattaggccacaaagtcaactaggacttcagacttgatggcagtgcgggcgacaaaatgcaggtcgaatggagataactctgccactcacttgctgagccagccagtaatttctttgccccggagcacttcgcccaaaggatactgggaaagcaccgtgactttgtgggcctgaaagtagtgtttgagcttgcacgaagccatcactagggcgtaggcaagcttttccatttcgatgtatcgtatcttctccccttgcaaagcttgggagacgaaatactctggtttctggcctgactctgtttcttggacgagggctgcactgatcgacactggcgaagctgctaggtagagtagcagttcgcttcctggtgctgggctgaccaaagcgggtgggctctgcagatatcgctttagctcgtcgaacgctgcttggatttaatttctcaggatttaatttcatacccactacacgtaagttgtcgaaggtctcctgtaagtcggacgcatggtcgaaagccatgcggctttttatgacgatattgtcgacataagcctccacatttcgccccagctgcttataaaggaccttgtacacctgcctggcgaaggttgccccggtgttccttaggccgaaaggcatcctgaatggcaaaaggtgctgaatggtgtgatgaaggctgtcttggggatgtcggccggattcatgtggatctggtggtagccggagtacgcatccaaaaaactcatgagttcgcagccagctgtcgaatccacgagctggtcgatccacggcaaggggaaatcgtccttcgggtacgccttgttgaggtctgtgaaatcgacacacatgcgccatttgccgttcgatttcctcaccagtaccggattcgctagccactcggggtggtcgatctcctggatcaccccagccttgagctgcttttgcacttcggctttcgctgcttcttggcgatcagcggacatcttgcgcagcttctgtttccttagcctggcatccggcttgaccgccagatgatgcatgatgaggtctgtcgaaacacctcccacttcgtcggggccccaggtgaagatgtcaatgtttttcttgagcacctccaggatgttctcaacttctctttcgcccatgtcgccccccagcgatacaaatcttgtggaatcggcatcgttgacctgctccttgatcaccctgccgtggggggcaggcttcggcgcgtgcttcgctcggtcatgcggttcggcctcaacatcgtgcaccgctctgttgatagcggccaaatcgccctttgatgtagccgaaggttgaagccccttgaccacgatcactcctgcagggccaggcatcttgagcttaagataattgtggtgggagatggcttcgaacttgttcaaggttgcgcggccgaagatggcattatagttgtatgggatgtcgacgtcgtcgaacagtatttgctcttcgcgtctgttttcacctgtgccgaaggctaccaccaattgtgcttggcctaggacttgaactgcttctccgccaaaaccacgaagcgaggccggtgcttgggtaagggctagggtaggcaaccccatcttggcgtatgcttcggcgaagatgacgtcggccgaactccctccgttgactaggattcactggatttcgaagccagctacgtcggccgagatcaccagggggtcttgatgtgggaacaacactccttcggcatcttctggcccgaaagagatctgctggttcaaatatcatggggccccttcacccgccgaagtgatgttgtgcaccattcacagctacatcttcttttgccattttgacagttgattcggtgggtcggcccttgtaatcacttggattactctgcgttgtacatcttggcgttgttcggccgggggtgcttgttcttgaatggcttcgcgaggtgcttcgacagctgctccttgttgcggccttggatcttatgcgttgccgctctgccgaatgtttcggcattgctctgtggtgtgcgaagagcgtccgtggaaggcgcagtaaaggtctttcctgaccttcttgcgaacaggctgctgatggctggttgcttgttgggcgtcgaactccttgcggagggcttgaacttcttcaacagccatcacggccttgcctgcactatcggttctgaatttcctccacgtcatgggagcttgacctgacctttgcggttgtccttggttcgccggctgagactggcaaacagcaagaggagttggctcggcgacttgtgcttgtacttgggcttgagcagcgatgacagaggctttatcgtactcagcctggattgcttgccgtcgcttggaatcctcttcgccccttgcgtattcgtcaatgatgcgaagcaggtgctcaaccgtctgcggctccttgttggcgattttccttgtgagttcgccctcgagcagcccggccgaagcggcattgatgatagacgcctcagttatgtcctgaacttggcatcgggcttgcgagaagcgacacatgtactcctttatcgaatccctcggccgctggcgaatgccgagtagatgttgctctgtcttcggctactcataggtgcgtcgaaatttatggacaaagacatcgcgcaattgctcccatgagtaaatgctattagctggtaaattgaagtaccaagaacgggcgaggcagtctagagcaagatgtattacctttgccttggtattttcgtcgccatgagcggcttcgatcgcggactcatagatggacaggaactcttttgggtccgtttcgcccgagtatcgcggaatgggtgggaacttgaactgggatgggattggatgaatcttgattcccccactcagcggcagccccctttcgccccccgccttgctcacggcaacttgctgtagaggcctgtttggatatggcatggcgaagggcgaagtcatggcttgcacgtgcggtttggccacagtgttcggctgcctggccgctaacggtgatgcctgatgagccgccctggatgggtcgaaccaaggctaggtccatgccatggcgacctggtttggcgcctgattccttcccaagcctggtgtccgtgcctgtggtccgatggttggtgcttgagtggcattgctgaactccaattgcgggccttgactccctggcgaagcc

SEQ ID NO: 61173 - DNA, 1140 bp, Oryza sativa
ggcacgtctggtcgaagggtctcataacataccgccaacagttcccatcatgaacttcagccccagtgggctttgggatcttggtttgaggttctgacgacgtgtccgtcaatggtggaggtggccttcctgacatgtttaccgtcttccaccgggcgtgccaaaagcgtgttgatgcgtaaaacaggaggcctgggagatctgcttaactccagtgcaggtccaaaatcttgcctttaggttcgtgagcgtgccaagttcatttgatcctgcaatcaacaagaaataaagacaaagaaaccgcggttaaatttataaatgatagccgatcggctagttgccgatgacatcatttatctctgagccgatgtcatgtttgaatcgatcggcagatataaataagtaacaaaagactaaatctacttgatcggctgtagatattaacaactaataatccttatatcgatatatacttaaatcaagtggttgggatagatcagtcgccataccgagacagtataaatcacttagattgaaatatatattaacaacgagattatagatgctcatagcatagcagatcagatagatctagcatgtatcggctaatactccgataccactctatattaagatattaaagcaagcaaaatatatcaaaacggaagcctaacatactttgttgtactaagatcataatataaaaggcagatctagcatgtcaattaagcatatgaaatataaggctaaatcaggtaagatcgggtgaaaccccgatactaccctaatcggcaaccaaaagcaggctagaggttgagattctaatcacgacttataacgtcaaactcaactgatgcagctataagtatgaaaagaaggacaatatctagacaatcaagcagttggatgtttcatagagtggtgaatatcctgtacgatctaagccaacatagatatttaacctaatcggctgccttccaatgatagatgttagccgattgaaggttagataacgatattatcaaagattatatagaatatatgataacccgacgaattacataaacaagattagagtatcataaagatggaagcactaatcccgagaacacaagccgccacagcaagttttacctctag

SEQ ID NO: 61174 - DNA, 3320 bp, Oryza sativa
atcctcatgaagcacattaactcaacctgacaacgtgtaccacgccatattgttggtatcggctgaatcggccaacctagtccgactcgaactctgccgatcttagtcgtagccgattcagactttagccgatcctcactctgtttccggaacgatttctatcttgaattccacttcgatcctatcttcatctccgatacttggattaccaaatttggttgttaacaggttgtaactcgttgccatctggaccaagatcttcaaccattccctcttgaacaccatcacctttgtcacctaattcaccagcagttactttaccagatgagcttgaaccaacttcatcggcagcaaccactttcagcttgtatttctagacaattgtcccttggcgggtttctttgaatgaattcatgaacttgtccttcacgctgctcatcatctgttcaagctcttgcctatgttcagccatcaatttgtccagtgtgactggaataatatttccttcatgaacttcagatccggttgaatttggaagcttgttttgaggatctgttgacttcgaagcttgcttgttgcccgacatatttatcgtgtcccactgggtgtgccaaaagagtgttgatgcaaaaaacgaggcctgggagatctacttaactgtagtgcaagtccaaaaatctcgcttttaggttcgtgagcgtgccagttgatttgatcctgcaatcaacaagaggcaaagacaaagaaaccgcggttaaatccataaatgatagtcgattggctagttgccgatgacatatcattcatctctgagccgatgtcatatttgaatcgatcagcaaatataaataagtaagtaaggattaaatctactcgatcggctgtagatatctacaatatgtaatccttatgtcgatatatacttaaatcaagtgattgggatagatcggtcgcgatgccgagacagtataaatcacatagatcgaaatatatattaacaacgagattatagatgttcatagcatagccaataagatagatctagcatgtatcggctaatacttcgataccactctatattaagatattaaagcaagcaaaatacatcaaatagaagcctaacatactttgttgtactaagatcattatataaagggcagatctagcatatcaattaagcacatgaaatataaggctaaatcaggtaagatcaactgaaaccccgatactaccctaatcgacaaccgaaaagcaggctagagattgagattctaatcacgacttgtaaggtcaaactcaactgatgcagctataagtatgaaaagaaggacaatatctagacaatcaagctgttggatgtttcataaagtggtgaatatcctatataatctaagccaatgtagatatttaacctgatcggctaccttctagcaacagatattagccgattgaaggttagataacaatattaccagagattatatagaatatatgataactcgacgaattacataacaagattagagtatcataaagatggaagcactaatcccgagaacacaagccgccacagcaagttttactctagttaaagatcgaaatcgatgcagctaaacccgaaagcaagaactcgtcgaaataaaacgaaagtaaagggtggcgatgcgccgagattgtatttgaacgtatgttttttttattacatggggctcggggtctatttatacccgagattacaaaatatgttcgtgtcggacacgactcttatctctaacaaactctaagataccattagtctttgtagcaaactcttgcccaaatatatctctaaggaaattacatgaaatatcctaattaatagatacaattgccttctcaagactcaatccatgcatggcaatcctcatgaagcacattaactcaacccgacaacgtgtaccacatcacattgtcggactgggctcaatcggctaatcttgtccaactcggactctacccatcccagtcgcagcccattcggactttagacgatcctcgctctgaatcccgaaccatttccatcttggtttccgcctcagttttatctccatctccgatactgaaattaccaaatttggttgttaacagcacggaataccgttgtagcacttcaccttcgggtgaccccaaaaggatatcgaactcagggaacgtgtgtaatctacctaaggctaagactatccaaggacaacaactgatgataggtaggctaagctagagaggactttctatgtgttttagttacctacgctaagcaagataattccctatctgttgcttcgggcaccgacccttgctggtctgccagcatggttccggctatagctctatgatgtatccgatcgtggagaattactgggacggaattcagggctgtcaccacctgccgcctacctctgacaaatccgtgggatacacaacaaacaaaggtcacctctaacctagacaccacgtctaagttattaattactactctaatacttgtacaggaacttccttctttatccagagtcctagtactagagcacttagtatgaatactaaacaatgaacccgcaaagatgaaaatctatcttacttagacaaagtaattaaataacataagaaaggaacacgaatgcttactttatagaagaagttctctgaacccggagcagagtgtaccgaggtagaagtcagatgagcgccaaacttccgggcactcctccagagcttcccctccattctctccatctctggctggccatttttggtcgccgcgggtttcctcccaagccctaacccctctcctctctctcctagggtgccgtcgccgcccgtccgtcccttcgcgtcgccgatcatcaccgctgccttcgccttccgctccggccgccatacccgccggtgaggttcccctctcctccctctttccctttcccccgtgtgcaccgccgttctccgcgcgtgcaccgccgtcaccttcggccgacgccgctgccttccgcgctgtccgccgccgcctcccgcgccgccggttgccgtcgccggcgaccgcatgccgccgccgctcgccatgcttagccggtcggcttgaagtcgagccgagccaggctggcgccttcctcctcccctttgaaccaccgcctggtggggcccacccgccaggccacctcctcctcctgttgtgtcgctgacccgtgggtcccgcatgtcccccccccattggatgatgtcagctgggatgatttattgcgcaataaataattaaggtttttctctttacagtgaaaacacagata

SEQ ID NO: 61175 - DNA, 3462 bp, Oryza sativa
cacgtttacttgatatccatcctttgctaaactttggggataattggcttagcttgtgttacttatgtgacctagctagaattatatatgtttagccatgcttaattaccactagctcacataataagataattacgttattagacatctagtattttgacaggctgcgtgctcgagacatccgaccatgtttcattggtcgtaattatccaattaaaatacgacttgatggtgggctgtgagtgtacggtttcgctagtcgcacccatggtaattaaggaccggtttacgggaaaccctggaagacttacagtgcttttaccacaagcgagagtgggtaactacttgacttgtagtatagctcaaccctttcctaggcaccgatggtgagggagggcgtaatggagttgggtcggccgaggtgtccggttgtccagcttctggattcaccacggtgcacgagggaactgcccaactctggggtagggggtgggggtgaaacatcagtgtggtgtggattgttaggggagggttatgtgaagggtcttgccacaatcacttgacatggtgacgtgtctagccaggcacagtgacatgccggtggattatgttttgtgggtacagttgtacacctctgatcagagtaaaactattcgaatagccgtgcccgcggttatgggcgatcgaccagattcactgtgattagtctcacccctagttagctaatgaactggtgtagttcaggtggttggttgggcctgttgcaacgtggtatagtgttggacagtgattggttaatattgattaattactacaactgttttactgctttcaactactgcttttaaatgtctgctttattgcaaatgaacctctagccacagtgggtagtactcagtcttgctctcttttcccctacaccagagcagaagttcttcccagttggagccgtgtcgaagaagttggttttgttgatgccatcaaggatgcctgtggaatggagtcgcccactgcaggagtcaagtcttcaggcttagctcgttttaccttttccgctgcatttgtaatcttttatatttttgtaagacgtggatctgtatgtcaataattatcgtttgtgtaccctgactggtcctggacaggggtttaatgcacattcagcttagaaattctggtttgtgaatttctgggcatgacaataagtttgtgcacctcgagtacaaaactaaaaaaaatactccctccatttcaaaaaattttagaaaaatgtaataatatttaacaaacatattatcaaaatatattcaatattacatttaatgaaactaatatgtaatttggtatggtaatatcgctactatttttttataaacttaggcaaatataaaaataagtttgactaaaaggaaaggtcaatctaacttataatatgaaatgtataattctataaataaaacccgggtagaattatttatagaattctatgaaatatataattctataaataaaaccagcttatgatagcaaactagcagcggggaccgccaggctccaccgctgcatctctagtaccaactgctatatttaccattatcgataccttagaaaaatgatttgtcattggaaaattctattagttgtatagtattgttggctccactattgtaaaccagtaatctatagggtatggtattcatctaatgatgggtacaataagaataaagaataatgtacgtcaaacagtaataattttactcgacaataaattgaacggaggaattagcattgtgtccttcaagcacctccaatctcgctaatatgcaaactaaattagcagttagcaatactgtaatacagtgtaagtataatggtcctatggcatgtgatctgaaacttgtgtaggcttgttcgtttctggcgccggacggggagtggtgtcggtgtatccgatgcccttccttttcgttgggaagagcaagaagacgaacgtcgacatgaacgccatccccaggggcaggttcttgagcagctccttggtgtcgttgccggcgtcggggaagaagcccttggtgagcccgacgtcactgaatgccacggtgaggaacaccaccgccgtgaagaaggagtgcacgaagtccagcggccgtagtcttagctcactgtgactcaatttcttcgcttcctcctcttcccgggacatgttgaacacgttcaatccccgccgtgtcgccacgccgtagtagagcttgccgtcttggccgacgacgctgtccgtgaaggagaagaagagggagaggccggccaggacgccgaccagcacggcggtgagccacttgttggcggcgttgcactcgccgtggttggtgaaggacggcgacagcgcctggtaagccagcaccgtccccgtcggcagcagctgcgccaggttcgccgtgcttgccatcaccttgtcggtcaccgtcttcgtggccacatctgttttcgacgacgtcgtggactcatcgacggccttaggcgtcgacggagctaagttattggtcgtcaccgccgtggactcgccgttggtgttcgatgccatgttgatcacgatggcgcccggaggagatgccgccattgctggagcttttgatgcggcgtcgtagtaattaatcaactggtgaagactgaagagagatatatgtgtggtagctcgagttcctgcgcttatataggtgaaaacatttggaatgattccatgttgtgcgcgttgatttttctatgcttgaaactagatgggtcgtgaccattcatgcatggaattcagatcaactgagcaagtgtggtcagctgttcagcagtaccgatctgcatccactgcagtttttttctacctacatgttactactacatcttactccatcttggagttggagtacttggaaggttggaattctcgagatattttctcaatttacattgtaaccaacttggagcatcgcaatcgccaacgggctaaatttgtcttcactgtaccggtgagaccataagaaaatgacgtttttatcgtgccactgatgcatgccttttttttcctggaaggcgagaaaatgatttttattttcggtctgtgtgaagaactagggagtactctggctatttttttagtacaacttggccgtgcgcgaaaggtttatatccgggagtagagagaccgctttgaacctttcattttagatagaggaagatcatttaacaggaaacccagccacaattttttttttagccttacatgtaaagctcatgtatatattgcaatttatagttaatcgtaaaagacatgtgtattgatcacatgttatattttgcaatttatagtaatcatgtacaacactactcttgatatataggcgtgtacaatactactcttgatatatagtcgtgcagagaaaccatgtcatagaacaattcaatttagttctagta

SEQ ID NO: 61176 - DNA, 6648 bp, Oryza sativa
  unsure (1)..(6648): unsure at all n locations
aaaaatatccactgtatcagtgatagtcagatagtggacaggacaataaaaactctgtgaatgtccattcaattgtaacagtccgaaaccacgagcatggataacaaactccatgcaactaaaaaattgggacaatatagtaacaagacaatgcatacataagaatgacatgaggaattcctcttgtctacaaaaagaagtgcacagtaaattgtaagtaattcgaatgtgaagtaaggcagatgaatcttaacactagaacagagattaaaaatcagataaggaaagatgtcaccatggatcagcacgataacttggcaggtttaacttcagttaaaggcattagatcataaagtgataacaaaatgtccttaccctgtttgtttttataatacatatagtttcctcaaatttcttgtgaaatataagaacacatgcaaatttattgatcctatcactgtgtatctctcctgtatagcagggatacttttctcctctctctcttggttcctcactttcatgcctttaatccttgtggccactaaaaatacgaattattgtttataatggagggaacactcaccaagaccaactgcctgaaacttgtgattctgggagatgtttctatgagtcaactgtgtcaaagcaaaataaagaccagcaacatctataaacccaataaagattttcatcaattcctgcaaagggagataacatgcaaattagataaacgccaacatgttaaacacaattaggttttgctaaagaaaacagaaaatgcacctgataaggatcaaagctatcattctcaggtactttgagcaatgtcgctaagcaaacaagctgtcagttaaatttgtcaaggttagtataatctcctttatttgaatgaagaaataacagtgataagaacatatatttaagaagcatgtgaaacaattaaaacagaaagtaggtaaaattacaagaacattttaaaaaaaatgcaaagtcgaaaagaatcaggatgacaaacttggatgagtttaaaattaaatccatataataaaaactgcatagatgggaagataactggtccataccatgcaaaatgatatatatgcaattgatacctttgtttaactaattaaggaatatcacaacaacaatcaaagatgaacatatatgcaataagtgttccatgacccttaaaactggtatgttacagaaatataccactattccacataagaaaatggtatctaatggctatgccaaacatgtgaaactttctgaatcaagaaaagtagatcacaagcgcacatgatcaaacaactaggaacacatcatttgagcctagcaagcttggcacttaccaaatgttatcaatttatattacagcaaggacatatttctagctactgacctttactagtgctgttccaagataaacaacagccgcttttacacaagtgccaattgtgtcatactctgacctgcagaaaatgactgggcataagaaagcgaagaacaaaaatcctttgatatacaacattatttttatctatagattgatagacatctaactagtaaccactacccactaataagattcttaaaaacaaagccctccattcatcaatgatcgtctgcaaccctccatcaaaagtaaaaggccaagatctatgtgaccatccaaaaactctctgtcattagaacatacacagcagctctgtttccaactcttatcttcacaaacctccgccacttattatccattatgccagaagtacactgttaccacttatcaccaatacattttgaaacaaccacaacattgatcaaatagggatatgttaatgagacatcgagcttgctctgattagcataagaaaatttacatgctctgggggaacagggaatttaagatcaacatgggagcatggagtaggttgggtccaagggggaactccaacatgtacagcatggctttcaagagggacatgggacagaaatccaaatacccaatatttgcaagtctgaaaatgattgatattttattcaatggttcttatttctagtgtttgcacacgatagtatgcaacaccttattactagagtacatgtaaccaacgtttgatcaacaacaaccacaggaagagagttggaagttgacaggggccatgttgcacatgtatggcatctgcatcgccatcttcatcatctgctgctgcccgagtccagcacaaataacttgttgcatgctctgcatcatctggcaactggtgccacagtggcactgaggcatcatgccttgtagctgcatgcaacattgctgctgcaggagcgccattggctgcgacatgaacatggctgtggagctacccatgcccaacgtttgcatcatgtactgcctacacggatccatggtgcccatggctaatgttggtgggaaatactgcatagtggtgattgcagtagtggcacttgcagaaagagcaattaaggcaaacagggcaaagatcttgctggtgtatgctgccattgctgattctacaatactagtgttaaacaagattccagatggtgtagacaatattgttgaggatgatggaataatggttgcctaggggcctatttatacatgctggtagctgtgtaagccaggaaagagtttggcctttgcaaaaccacctagtggaggccacataagctggaaatcatgaggcatggaatttatttggacatttattcaaccaatacttttggaatatctacacaaagataattctgccagtgctttaatgcgtggaaagaaaatatgatgataaggttgtgccagattgctttggcattttgcagttttgtaaattatgagctggacaaagaaacttttgtgaacagaattcgtatgggacttgtagaatgtgttacacaagtcacagcttacacagataacaattaagagtttgagtcatcgccatatgtgaatgattgagtaggtaaacttggagctttgtaaatgtgccttaatagcatacatacatatgcagtttggcatgtatttggagttttgttaataagaattggaagtaaagaacattgttgtaaagggaaagaagtaaaggagaaacaaattttgggtccatcccaaaaaataaagcaaagattagagtttggccatactctttgctatcctactttccacatatctagttctttatcttacaaataaagagaaacgaggaagtaaacatatttcatgtaatcatattatgacaagacacatttcttaggcaggcactactgacaccatgcaagtatgaagttgcattattttcaattttaactgatattataattatccagtgcagcgatcactgcagggtgaattgggatggagaactatgcaatgtccatgttcagaatcttcatgtttttagtactagagtagtagagatgtaccaaacgtgatgtatagatctcaaaatttccatcctggattgaagaaagattcgaccccattccgaagccatacaacaactcacaaattgcaattgagttcaatgtggtctgccggtctagatgactagattgtgataaatctagggttaaggcttcatagaagatagaactgattcatatgctcatgtgtatgagtattgttcatcgcttgagtagataagttcaaggacaaatgattttcactgaacttggatggagaaaactgttgcacaaggtaagatcaatatattgctgaaatagaaaatatctatctgacatgctgccaggtaccaatgtgctatgaataaaccatcctagctacttatcttgctaacatattatatcacgaataccttcaatgtgatctcccctcagctagaatgaagttttctttcactgtcacgaagttactctactaatgagatgtatatggttggcaatttggcatgcattttccagtttcacaacaacatgttcatcataatatcaagtggcattagttagatcactttatatttgctgcatttgcctcataaaaattgtattcccagatcgtgatcccgtctagctctgaaaacgagctaaccgctcatctgaacttacttgatactcggaggtagacataaaccaatcagattcaattcgagcaacctagttcagaaaacagagcatccaaaccagaacgagcaacgcgatttcatgttctccaacaaacggtcacacgcggaaccaatctcgtgccaatccaaccgagttgagcaaaatccactgaaattgcactgactaaaccccatctcacaagccaaaaacacacagagaaccggcagcatcagggattcaagcacctccttccgctgacgacgcgacgaatctctgtccagaccgttcactacaagcagatctagcacgttcgtgatacggatctcgcggcgcaaggggagatggaggggggggggggagagggagtatacagcggggtggccgagtagtagacgacgtgggggccgaaggtgagggcggcgcagttgaggaagtggaacaccgtcatctcgtccccgccgccgccgccgccgtcgtcgtcgtctccggcgtctgagcaagcaacggcgaggtcggatcgcccgaggtgcgcgacgacttgggctggactgcttgagtgatcgagtcgcaccccatcgaggctaagtaaaagtatctcgggccacgtggatcagttaatgggcttcgcataatcactcatgggcttggagcgggaggatgatggcccataaaacaacatcccgcaagtcggtgacagtacaccatcccggcccaactaacaggccactgttagtcggttaggcttaggcagcaacgttgtttgatccagtgatgggtcacactcccacgtgggaatacaagtgtaaatattgaacataaatcgaaactttatttcatgattcttattctagccagtcgcacacgatagtatgcaacaatttactgttggagtacatgtaaccaaggtttggttaacaacaaccatagggagagagctggaagtaggcaggggccatgctacacatgtttggaagttgcatcgccatcttcatcatcatttgttgttggccaagtccaccacaaatagcatattgcatgttctgtatcatctggcaactagtaccatacccacactggcactgtggcatcatgccttgtagctgcatgcaacactattgttgcaggagagcaattggttgtggcatgaacattgttgcgtagctatctgtgcccgtcgtttgcatcatgtactgcctacacggatccatattgcccattgctattgttggttggagatatggcatggtggtgattgtagtagcggcgcttgcagaaagagcaagtaacgcaaagagggccaagatcttgtatgctgccattgttggcactacagtgctactatgatattgttgagggtgatggtatcgtggttgctgaggaacactatttatacatactaaaagtcgtgcgaggtaagtaatattttggcctttgcaaaaactacctaatggaggctagataagctataaatcatgaggcatgacatttatttggacaattgttcaactaatattttggaagaatacatggtagatactaagatgacgttgtagatatattcaaaaggctatcttttgccaatgctttaagaaatacgtggaaagaagttatgatgataaggctataccataaaagtttggcacttcataaaacttaatttgtagtatagttatttatcgaggtggatcaagaaacttttttcaacagaatttgtttgtgtcttacaaacatgttaatcaacaattcacatataaagtaccttttcaaagctttgtaaataggctttaataatagtatacagacatatgtagctaccatatatgtttggaattttgctaccatgtatttggagtgttgctaaagaaacatgagtgagtgaggttttttgaagggaaaagggataagctacttctgtgactacttgtttttatctttactcattacttgtgtatgtttattcctttatttttaaaaacagaaaagaaatttgagaaactcaaagtatttgtttattcaaattatgaaattaaattttatttaattattccagacactacaggaaatatggagtctttaaactgaaaatataactatatttttaactagtaagtaaagtcgtgtagggatgaccaattcttcttttggatcatcacatgtcaaattggaatggtggggtggtgaaatttagaatgcctgtcactcttgatgtgattagtaatggagacaccaaaaatgatgtctagattgcaaacatttcatcttagataggataaacatgttttgttcaattacaatctcattatggaagtgatacgacagctcacaaaattgcatgagttcaacgtgttctagacctctagattcttatatataaaggtggggttaatgtttcaaagaattatttcacatggtccttgtgtattgtgattgcttgagtagataaggttcaaggacgagtgagttttgactaaattaacatgataactagatgagcaggggcaaaaccacgttggccttctctgataagcatgacccaagtnnnnaagcttgcatgcctgcaggtcg

SEQ ID NO: 61177 - DNA, 4923 bp, Oryza sativa
  unsure (1)..(4923): unsure at all n locations
taactatgaagaaaaaagggggaagcaccatttgaatttttttaaaattcatttaatttaatggcaatttaaaatttaaaactgtacaaaaccatatccattccacccagtgcggcccaactgctgcccgaggcccacactgaattcctccctcactttcctcgcatcgcaacgtgcggagatgcagcaacgtctcgacgagtcgacggcgccgcgacggggagcggccgtcttcgcatctctcccccattcaaattccaatactccaaagcaccgttaatactactacttctctcacgaatccccaatccctaaaatccccgtacgccgcccgcttctctcctccgattcctccgccgccttcgcgccgccgccctcgcctctcttgcgcctccaccggccaccgccgcggcgtccgatggagaagccggagtggagcatggacgacttcgagatcggcaagtacatcggcgagggcaagttcgggaaggtctacctcgcccgcgagaagcaggtacgcttccaagccctagccctagccctagccccccaacaccttcgatttcgtctcgatttcgccttcgttgggagctgattttgcccggggacaactgcgggtggtttcagagcggctacgtggtggcgctcaaggtgacattcaaggcgaagctggacaagtacaggttccacgcgcacctgcggcgggagatcgagatccagcacggcctcgaccaccccaacgtgctccgtctcttcgcctggttccacgacgccgagcgcgtcgtcctcgtgctcgagtacgccgcccgtggggagctttacaagctcctccgcaccgtccgccgcttctctgagcgcaccgctgctactgtgagccccctcaccccctagcgcctttcatcagttcaatttcctcccattttcttttgggattggttttgttgcaatcgtgtactattgattacgttagcaaacttactgttcgcccgtaatttttatgacccaaaccattcgaaaattcataatcggcataaaccctgtatgttaaattctatagctctacagacatacggacggagtagtatttaatttctttcattgtcaaatcttttgcaagtggttcgtgctattggatctgctagaaattcccatgatctcatcagaacattgcgattcacaggctctaacanttttccagatacacatcactttttttttgcttccattacatgaaatgaactaaagcattgtcacctttttatgtctataaaatctgacaaagagtaacacaaggatatgctttcagacatgaattcatggaacatcatgagtaccagttttccattaaccaaaaaagatgaacatttcctttgattctttaccataagctctgaacagaacaacatgcacctgccttgccatctatgatatctcaggccctataattatgatgtacatatgttgctttccttctgattttctaatgttcacattatactttgtgatgaccttgtaccttgtttatttttagtatgttgccagccttgccggtgcactancatacttgtcataagaagcaagttatccatcgggacatcaagccagagaaattactccttgatatcgaggttggttcttttatctgcagttttgcacctcttctactgttacccttctcaacaccatcttccataaagtgttgcaagtgaattgaatagcatcttcctcttaaagaaataactgaattgtgtcatgttaattagtttgaaggtatcttcgccttttttttcttcttaatttctactgtctttgtaacaagtttcacaacctgatggtctcagatatgcacatgtaaatataccagattcatgatattttaatctacagttgatatggtgtttctgaatgaaacattttctttgcaactttgcatatctgatttgattcacattaagtgtaaattatagagctttgtatatgtgaaaaaatatggactgtcaaatttgacctgatggaactttttaaatggaaatggcaacttgaaacacatgtggaatggaagaatatgtatgtaaatataatgcatccagattatgcctgagtagtagtagtagtagactagtattatggtacagatcttacatgtaaataatgatgggacatgacagagaatgcctctactgaattccacacgatgttgctggtttgaatactgtatatgtggactggaagctaagttattacaatagaatcctctcattattattgaagaatggatagtgtcaccatgaatatgatcacatgctatcatgtaactctagttttcttgcctcaaatataagagtagaaagttgatagataacagtctcgatgtgttcatatgttgtgcctgatggttgatgtgaccttaactgcgtgtcggtacatgacatgctaacatttgttttaaataactatgtacctcccccttttccagggccgacttaaaattgcagattttggatgggcggttagatcaaatgctaaacgacacacactttgtggtacaattgattacctggcacctgaaatgatagagaaaaaggctcatgaccatgctgttgacaactggactttaggaatcttgtgctatgagttcttatatgggtcaccaccttttgaagcagcagaacaggatgatacattgaggaggtaagacctactgtgttgaatgttttgtccaatcttaatttgttacatgttttcactctccttaatatgaattctgagcaggatagttaaagtggatttgtcgttcccctcaactccttatgtttctgcaaaagttaaggtttttctttgcaaggtaaaatttggggtattgattacccctattgtatatgttacactaaaatgggttgaacttttgagttttgagcttcgagttcgtatgcagcttttggtgaaggattcaaacaagagactttctcttgatgacataatgaaacatccatggattgtgaagaatgcagacccatcagggagttgtagtgaccaaaaggctcgcacataatacctttaagaaacaaggtacattgggaggcataacgtgctaatgaaatacacaccttaccttcccagtgatcaccctagtatgctgagctaaacattaaactttatacacatttggtcaggctacattaaaacgattctgttctgttctcattatggactataataatttgcttcatttgtttgtgaagcattttaggcctactttggattgtaggaattctagatgatattcggaggtttcatttcctgtattattgagttactgttcacccctttggattggaggaagaaggcataggaaatttggaggaatttttcctttgcctttgatttcgtaggtagtccaagcaaatcaatgcatgttactccaaatgatcatagttttaaacacatactaaggaaaataatacacattttatgcttatttaggaagagtcctgtgttttactctatttatgtgttccaaacgatatgtatcatattttcctatgtttttcaatcctatattttgcgtatgcaatcctatcgtattactacatttttttctattcctgtttttccaattcctgcactgcgaatgagcccttgactaccaatagtgtccttcagctttcccaaaccttgtctgagactctactttggaagtggcaggttaagggcttgtcctgtaagatttaggtgctgtgagaagttttgaaattagaccaaagtgtagtctgatgcagcatacgaggagttagtttttccaccttgtgcccgttctgaatttggactcaaatccttgtggctttccctgctctcttatttgtatttattttttggctcttttatgcaggttactccgtgtcattgagggacctggtgaaggctggtgtagtattttggcgaatgcgttgtttgccagtggcccgtatttttttagctaattaagtaattatggatgtctatatgtatccgctaatcccacctcactgggaagccccaagctacctaactacactggctaatgcatgacgtgaagtcctaccatgtttatgtttgctgttgtccgctcctaaaggaagttggctggtgtagccgtaccagtttatgaccctaatcctcatcagtcatcggtgatagcatcttcattaccctaagtgccatgttgttgttgtggataaagttacttaacggaaatataagtataccaagtgcatgtctacctaccttaggaaaattggttcatatcttccccatatttggtctagttcggtgtggttgcgctaatgatttaatctaatgtagcctcatgccgttacacgagaaactagtgcagttagaccttgaacaagcaacatagaaagttgattaggtcataaaagtcaatttatcatatgcttcattttgaagaaatttagtgcgaattcgagtaatttctgtaaagctctggcaaaattcctgcgtttggaagtgcaagaaagaatattgtgtgcctcgctaatccagttatctgggcccaccagtcagcgtctgatttactccattaacgtccccccatctaatcctccgtcttccccacccttccctccgtgaagagagatccccatccaccttcggggaaggtaagcctcgagccctcgactcgagacctacctctccccgagctcgaatccttctcgaagcttccagattcttccacccccccccaaccctagccatggcttcctcctcctcgcctctgcccttctctgcctcctcctcctcatgctgctcccctccccctcctccttcggctcgttctccttcgccaccgcttcctccaacgcctccctctccaccttcagcgacagcgacccggagccggagctcgcgcgggagcctactttc

SEQ ID NO: 61178 - DNA, 11101 bp, Oryza sativa
gtgattgaccaaattacaaaactgatctaggggctgcaattctctcgtaaaattataactactcccccttctctagttgttggtgaatcaaattgcttgttgctgtttcatttgaatgctaaactagatcaatagaatcccatgtttagcttgtatgctgccaaccaattaccatgtattggaacagggcttccaagtattagatcgttttatgctgaaggctataacataaagtgcaatatttctatgtatgagcaataccatatgaatctcttcacgtactaatacatgcaaaaccatttggtaaagtgagttgtatagatgcaatgatggactgcttttttcaattgatgctatgtaatttatcttaaatgtgacattctggctgcttgagctggaatttagcttaacgacaaaatataagattggatggcagttggaacagaacacaaacattttctttaccatattatttggacactaccggttgttctgcgtggaatggaagggtcatggtctcatagatggcataactaggcatgcagatgtgtttttgtggttaataccaagtgtaaagcctgtaaattctgttagtaagagagtgcagtgctttaatgtgcatttggaattctagaaatattattagcagcagaatgcagttgtgtaaatggcattttaataacatgctattctatttgatagatagttgtaccatgcaatttagagaaaggctatcaacatgtaaataacaaggcagatgttgcaactctgttggcaaagtttctcgtttaagaactttggtagagatattttagatatttgatttagggttatgctattgatctttctttgtttgcaatatagtaatgtatacaatggttctctgtacgtaacagtcaccaactaaaaattacttaaaagagggtatctgttttccatatcctgtaatcggggcaagttttatgtaactaaaagggtacttttgttttttaaagaccggtcatctgtttcacgcaatctttgttttagcaatttccagcatttcgcaacatatgttgtaatcccaccttgactgcttcagattcttatgttgcacttcttatgcagcggaatgctacctatgcaggactgaagagggtaattgttgctgctggcgttgcattgaaggttattggtgcgcagaaagttatctttacccatcctcacagtataggtcttttaacaaatggaagcctattggctagtaataatgatccaagtcgaatatggcctctcagctatgcaacttgtgctccgatacttcaagtcagtgttgtaggatcagtcatgatagttgttaatgaaagcaatgtgcttgggaggcggagatcacatgacactgtggagttattatcagaaaaatgtgaagtggatgtagcaaaccggttgatctcagtttgtgtgttctgttcaattagttcaagactgccaaggctagataaaatcttgaagacttggtttagcaataaaactcaggatagcaaatcaatgcagtttatccaagctaaagtgacatcaatacctttgataaaattccgtttggagcttgagagggacatcactgaagaggatggcatctgggaaaatatttccaagtggaaaacagtacctatggtccagcgcgtcgcacttgatgttgtagctaaggttgaagaagaaggcaggctgaaggctatgtcagtgaagaaggttaaaaaaccttatccagtagtggacgcttcttcttggagcagcttgacttcaaatatttctttcacaaagttcatgtctttcgttttgccaccagaaccgttgacactggatgtgaagtggtgatattttctggttctcatttactcatagggtttataggaaattgcccatattaatcaaatccgtgtataattgactaggctgaaagaagttgtacctgaaaatggggttggaatgtactactatattaaaattttggattttccctgactaactgtgttgtttcaacctcattctttatagatgttagttctcttgtgcaacgaattttggatgctagttctcttgtgcaatgtcagtgcttacatgctgggattatttctaatgtggcaaggaagattgagattagagttgctccaatttgtggtgttgcgccaacttttgtatgtctagggatgccattaaacgggcataaatgatcgcacaatgatggtaccaaattggatgaggatcctaggttcatggcaatatgaaacggcacttaaacaatggacgtttcaaaacctcaaattcattcatactaggctcacagcgagtgtccaaaaagaacaatgagttgacccactttgcgttgtacaagagcaaaatttaccatcataccggtacaaaccacacaggaataatacatcaattcactttcaatcaacaccgcataaattgacaaggcttgacgaggaacaatgcatcatgctttctatttcttttacactaagatttgaacatcatctgacgcccactctccttgtgtctgaaacagatcatccggagctaagcctacaactatggatgttcatttatccgcgttttataaatatgaaggaggtgccttcttacattactgagtacaggaattgctgccttttaaccaagcatctgccaccagggcaggcaaaaaaactgatagtcagcccatctgccaaagggtatttgaggcaaggcgacgtccagcataacaaaaattaagaggaaatgtggctcagctcacattgaagctcggccaaaagaatggattggtttctggtctgccacaataaatatttctcaggagatgcctgctgtgcagtgaactgcatcatgctcaaagaccgtatgttattttcgatggaggccagtatcgaagcacagatctgccaagaatgttcttcacagggagaggtcccctacaatgacacagaaacataagatacttgtggcaaactggcaactgggttaacagcttaggtagtaacacccattgagattttgcataccaattatgtgaatcgaagctgttgtttctgttgtcccccagcacaaacacgtaaccttgaggaacagtctggcaaaagtaaccacgattgataagtatgtatgctccactatggtcttagcaaatgagcattaatattaaagcgacaaactcatattcccctataaggccataagcaaatgaagggtacataacaaaaatgatgcagtcaattcccacatttcaagcatcttaatgtctgatctaacagagttggcactttactcaaatacttgatgccatcaaactgtgacactaactgaaagcaaataagtactcctagtacattacaacatcaagtacattagtatccaatataaagagatgttgccataccacttgatccatttcatagttgagtggctccagcacaaattcctcatcctggactactccattaaccaataatttaccatcacgtacctaataaaagcagggaataccaatggtcattactcatgcaaatggcaaagaaaagcatgaaattttttggaaaaaaaggaaaacaaataggagtcactaccattcggataaaagcttacttcaacggtatccccacccttggccacaattctcttgatgaatacatctcctgaactgcaccccaaggcctgaaaagatcattcaactactagtcataacaaattctattatgaattaaatcaggcaacagataaaagggagaacatacctgcagaactgggggggcacggaagatcacaatgtccaaaatattaggctcccggaaaacgtatgaaacctaataccataacaacatcagcaaacacacatcacaaactattcttactcatagaacaatcaacaacaggaaattgactttaccttgtcggcaaggattcggtcaccaacatcgaatgtcggatacatagacttggatgggatggaccttggctcagctaaggatgatctatataacagtggcacagtcacagcggcaaaaacagtcttggcatcatccgaacaggagctcacccaccttgatagccagttcctcctgctcacctctgcagcagcaccaagtgcaggactgctctttctcaccattccagcagcaccggagttaattgcgccactaccaaccaatggtttcacgcccacgcccacattagaagaggcaccactggagttgattacgccggagttgattacaccactaccaaccaatgctttcacgcccaccttagaaggggcagccaccgcaggcgagggcacatgtgcaggacggggcgaaggcgcaggtgcaggcttagttcgtgacacaggcgtaacagcaggcgcagcagtgggcgctttagctacatcaactgggcgagccgatttgcgggatggcgccgcggaggtgatgaggtcactgcaagggagccacttggtcccctgcaggaatgggaggagcgccgcggggttgaacgctgacgatattgacggcgaccccgagagcgatgaggcgcccacgcggccagtagcggagcccatcccggaggtgaacaccatcagcaacccgatggccagcgatgatggcgggtcattcaccggagccttcgttgcgcacgaccgcgagaggagcagcgaatggccccctccattggcggcgatggcggaggcggcggggagagcctttgccttgggcttgggcttgggcttcggatggttgtgatcgtcggcgtcatggtggtactcggagtggcgggaggaagcgaagaggcagaaggggcgggagagcgcgtcctggaggaagcgagccccagcccccggcgccgcaccggaggaggcggcggcggcggcggtgcagcgcaggccaaaagacgaggccaggctctgcgccacatagccggagtacgacatggtgatgcggatcgccatcgcgaagctggactcctaatctccgggatcttactggagatcgtcggtcactttcataccgtcagccgggacggcggcggcggcggagaggggcgcggggtatcggggggatctagggttctaccgagtaggaggcgaccgctacaggggttcgtcgcggtggcagcacgcagatcgaggatgcggcggtgggaagggtaggcctccggagatatgggaagtcgccgccggtggcggcggcggcggcggaggaggcgagttggggggaaggagagaaggtgggagatggggatggtgggtggtggaagagacgcgtcggcttttttatgtcgaggcggagtcgcggaggccgctcggattttccagatcttttttacgattgttttttgcccgcaaaggttggaacgaggtgggtgtataattggatatttggatatgtgtaaattcgattttgcaagtgctgaaaagttttgaagataaaagagggaagtggtgcgatcgtttttaaatttgaaatgtgtgtttgactgtttgtctaggaaacaaataatcatccgcttaaaacttaaatcgagttcttttaaacaactcgatattttttttcgttttacattagcacgtttctcaaactaataaaatgtttcgtaaaaaaaatttctatgtaaagttttgtttaaaaaatcaaacaaatttatcttttaaatatataatagttattaatatataattaatcgtgcggtcataattcatcttttttttggggtcgcgaatagctaccgtcaaactgcttattcgtactggccctcggtcacgcggtcacgccaacgaaagttgctagctaggctgtcgttatgcggtagtattattgttttcaagaataaaaacaaaggatattcttaggtactttttctgtcaaaaaaaattaacatgtgactcctcttaggatagtttatattcgttattctaggaggcgtcacatttttttctaggttgaggttttttttttttttagaacggaggggtaggtgtacaggtgtaacatacacccctttacaatgagtaaatattatttatatttcttaaatcagaactcattagtcattacaaccattattttgtgcactttatatctatacttgtagctaagatcatatccacacacaaagatcaaggatgtatactgattccaaaagttgcgaaactacagtacacagcaccacaaaaaagaatggccaaagatgtgcaaaaatcagagaatccccaccactagagggacagatcaaatcatcaaattgcacctcccactatggtatagggcatgaagcggtataatgacctgaagctatgcagacaacgacatgaaacacattttcactaacttagggtgtgtttggattccagccactgtctgccgaagttacagtatttttgtcacgctacattgttttgtgatgtggacaaaacgtccgccacacatgtggcgagccacgtcgtggcatggcattctatgccgccaaccaagcaaacccttaatattctagccatctaatatcagatataatatatcataagtacatatagtataggtgttttaaattttcggagagagggagtaagtgctaccatgaccaccacgtcaattcctatagctaaaagcaacgggggatgctgaagttgacaattcgcaagaggttgccgggtgctgcttcttctctgatgcttcttcccctgcataaggtccaggtcatagagattgagtgagtagtatttgattagtacctcgtaagcatgattggtcctaagagatagcagtgtatggccgtgatctgatctccaagctgcatggatgaattcaagaaacatggtaagttcttatcagagttcaacgtttcaagattgcagtaaatgtaaatagcataggatgagctttagttgaagaattcagatttcagagacgaaagacgtgcggacacgggataactgagaaattggcgtgtatatattttgtgtataatgatgatcatcttgtaagctgtagatgccaacaaaaaaaaattcactactttttaggtagctgacgtttgaactgtcgtaagcactcacgttgcacaaagtaacggtattaacaatttggttaaggaggcaattacaaatcaagatgccgacttagactgggcaaagcaccggaattttataatgaaatgacagcgagccatgaggcaaatacttcagagaacttttgcagtataatttacttacagtatataactatatattgtcaatataaaccattgacgggtatagattgatcatttgatctgatctccaccttaattgggttgcaatataaaattaaatgaggaaaacttgacaactcggttctgggatcaggagtggaaaactagccgcctgacattggcatgatcaaaccagagagccgattccatcttgagctattgcgatagtatgatttaccccttaaaaaaagagatttcgagagatacgtccctccaaatattttttttaaaaaaatcgttaacatgttggggattgaatacagaacctcgaggttaaaactacaccccccctttgccccttaaattaggacattcgacatctcaaactcttaaatctggacgaattaccccccgcccccagcactatcttgggcggttttaggctaggctagctgaccaaggagaaaagcacaacctcaaatgccatgttgaagaaagacctatggcgtttgaggttgtcacgtcaataaactttaaactttgtcatgcgaacacattaactttgcgtggagaaaaggtcatcttcttgcatgcaaacgggaaggccatgggctcatgtatgggaaattaactcggctgcaaaatcgaacagcctttgcaccaaaagaaattaaatctgcatttagattgtacaatacgcttattaatttggatctttttgtttttgcttatgcggcgatcaaacgtgaacagagggactattaattattttaaatttagaaaattaatatgcttttttaaaacaacttcgtagagtaaagttttgcaaaaaaaaaaagcgcacaaagcttggggaagcatacgcatggagaacgggagtttttttttatctactaggaaagaacacagcctggagttttttttatctactaggaaagaacacagcctaatattagattagatttgctagatatattttttacattcctttaagaaaacaaaactgagaagtgagaaagtatatcggtttccaagtatatgaaattgattggcataatacgggtctaaattatcgggagcaatagttaattgcacgcggccgttgtttttctccatggtgtccgtccgtagaccccaaaatcgtcacccaatcataatctgcctaaaaatatgttgttatgtatggaattggaaacaacgacccagataacccaaagcctcgtggcttccttcgactatatataagggccacccgatcaagagacccctgccacaacaaaaaaaaaatatgggaaattgtgtaggcgctagcaaccgcagtacctcgcgagaaaacaagggaaatcaccgtgtcagccgtcggtacggcgtggacggcatcaccgtgttcggtcgagcacacgaggtgaagctgacggccaaggtcgacggccgagtttatcgctgcatcaaggtcagggaggggatgttcctcacgctagcgacggagtacaacatgcctgcgctgatcggctgcccgggggacgaaccgaggatgctgaccccgtacgtggatgacgacgaggacgaggacgacgccaccgagtcaccgaccctggcgcgcggcattaccgtgtgttttgcaagaacctgccgttggaggtggtggtccgcgggggccgcattgcctgcgtcaagattcgtggccggaaacaccgtaggcattactcgctgcgttcaagtcaaactactccaaatttaattaattttataaaaaaataagtaatatttttaatccaagacaaatatattatgagaatttattcaattatagatataaaattatactggtgttataattattactattttttctacagagttcgtcaaactaaacttaaactagattagtttgactttaaccaaagtcaaaacgtcttatataacttaaaacagatggtgtattattctttcaattacttcatccgttcaaaaaaaaccaatctagtactagatgtggcatatactctgtccagattcgtagtactagaatatgtcacatctagtactagattcgtttttcgtgggacggagggagtatgttctaacgaatcctatgcccctatcatttcacttattccacaagaagtgatactacctctatcccaaaataagtgcaaccatgaaaatccgtgtctaacgtttgaccgtttgttttattaaaaaaattataaaaaaatttaaaaaatagtcatacatgaagtattattcatgctttattatctaataacaataaaaatactaatcataatttttttttaaataagacgaacggtcaaatgtttgacgtgaagtgtaaaattacacttattttgaaacgaagggagtatttgcaaacgaaaagtgatctacgaataaaacttctatttgtgtgtgagtttggccagccgatcgtatgcatgtggccatgttatgtcgtcgctttgatctttttcgcgaacgcgcaagaggatctttgctagcacgaatgtatgcatcactacttaaaaaaaacttcgtgttatcgtgctactactgtcgtgttacactcttggtaagcgttggttggcatttttcaggcatggtaagtgacaggatggtgcagtagtcacaatttacagattgtgtagaatacgtttgaaacaccagtgcatctgcaaatattgctcaaacaagtcactgcaatgaaattaagcatcgagttcttttcacaaccaaatcagtgagaggaaaaaggaaaagaaatatcatcacgctgaccagaagttaagtagcttgtcaaataaaatcttataaagcaactttacggtttattactgagtacactcttgtttcgatgagcacaaaggttttcatctgtaaggtgaggcagataagcagtgatatactctctctttccctaaatgtttgacgccgttaatttttttaaacatgtttgtctgttcgtcttatcaaaaaactttttgtgaatattattcaaaaacttgagtagtagtatatttaacaatggatcaaatgataggaaaataattaataattgtttaattttttttgaataagacgaacggtcaaatatgtttaaaaaagtcaacagcgtcaaatatttagggacagagaaagtacattataaagaagaatcgtcatcactttttctaatatgagcaaaaacttctaaagcaatcttatgctacactcttttttgagaacatcttatgctacactcgaagggcgcaaagctgtggtgtactagagccacatataagattccaacaccaacaaccaaggttgtagtttaatttgtttttttctttacgatatgtagatattaaattttaagttacaactgatatattacatattaatatacctttcttttcatgattaacatgcaggaacatccttcgagagcttagaatagaatagtttccccacgtatattcatatacaaaactaaggatcaccattcacagctagattcacttagctagctctaccatgattgctcgctaaacaagttgatcaagaaaacagaaaatgagctagatcaagaggacagaaaaggagcagagtcaaaagtacatgtaaggagtttgtgttacacatctatcacctttttggggtcatcgtcctctgcaacactgctaattggtatcaaaaattgaaagttgaagcaatcaagcaggatgggatggaaactacagagttctccgtactaacatcctgtcagtgattaagatacaatgttatataatattcaatacgtaacatgaaagcgaaaataaataagattagggaaagtaacttcataatgccagtaaggaagctaacaggtttccattatcgaaaaagtaagaaagctaacagacagtgtgaaatacacaatgtt

SEQ ID NO: 61179 - DNA, 12284 bp, Oryza sativa
aagaacgcgttggttttacaaatttagaaagaaaaagctacacgacattgactaaggatgtccacacgggttacatgtcaagttaaataaaaataacttctgaatcaaatggtcctttaatccgttctatccagttacacatagaatattatgtgtacctccaggtggtgttctgaaaagtgaggtgccacccaaagcagaagacgcaaatcttgctggagtggatcctagtgcaagtgtggaagctgagccaaatggtgtgggctgcagcatagacccagatgaactgaaagggctgggtgatggagcaggacttgtttgaatgctgaaccagggcaaagcagaaagtggtgttctaagaattgcacgagtactagatgaagttacgccagtaggggatgacaattgcaaaggttggcttgccagcacagatacatcaacccctgtaggatggactattctggcagtggcttcttgtttagctgcctctcttctatctgcctccaaaaaaggatcgctacaatcacccatgagccgccaagcattccgatagtgagttctcattacctcagcatattgatgaagattttccacctggacaaacaaaaacatcagagaagctcagtattctctgaacaccaaacaatatagttccatacaacaagaatttaatatattttagcgacacataaaaacaaagtgaacctatcacttggggtatgtttctgttgtgttacaaaacgaaatagatatattagcttaaatatgctcaaaactgtaaataaccaaccaccttgacaactttaattacgaatttaaattgaacaacttcagagtggatctgagcaatatataaagaaaaatccatgcagtattcagaatatgtaatgccagtgatcaatacatgtattcatcataaattacctgggtagcaacatggatgagatagtcgtacacattaggcactactgttgacagggattcgaacgcatttgaatagttcttatcattctttatttgaataagctgctctagctctccgaccattctgctgcattcctcaagacggttctcaaacttggaaacagtgtgttgcataaaaggagaaggccgcattgcaacaccactgtaaaaatcaaatgttggcacaattgctgaggggtgattgaaataagttggagccccagatggtccagcatgatgagcaaaaccagtatttgcagtgtccagaatatctacggatgaaatttggtctcagcttttgatatgagcggaaagccgaatctgtgttccgcatcatttcttcgaccacagccattaagctccgaatggaaaccatctccctgtccatgatggtggaggttgatcctatctcctgtttcagaaaggaaaatcctcctgttacaaacaaagaataaagttgaacgccctatttcaactagtggattcatgaactattccttcctcttttagttttgaacatattttcaatataaagtagtttcagaaagtagcctaatcaataaggaggctgaagtcaaggccagtaaaatccttttttgtactgtacaagtgtacattcaacaaaatacatcatatcgccccccaactatttgagactgataattttcgtgctgcagaatattgatatcttgcacatttgtgaagtaacattaagtcattactcaaccaaagatatgcgcattacacttaagaacattgaatatcagctggtactcaactgatctgtgaagactgaaaatatagttgatgagtggtgactagcgcaaaagctatatacctaataaaaagcatacaagcaagtaaagcaatgatttcatggtattacactaatatgtggggaccaaaacatttccaaagtaactagtagtaccaaataacagcccaagaagtaaacaaaacctgagaaatctgcgtagcatacagctcaaaactcctgctagagactgatgggtcgtagaggcggctgcactggtccaacagatcgctctcatgcttgtactccctcatcttgttcctgaaaatcacaggttaaccaggtgacgatcgtagagcaatggaagtttagacaaagcaattaacacaaagcacagagatctttatcaagggagacatcaagaacacacggaaacccccattgatctgcccttgccttctttcagaaaagggggaaaatgaaaagaaaagaaacccatagtgatccctaaattctgtaaaaatcgccacagatatctcataaaaacccagaaaataaacttcgacgacaatggggcaaaaagaagccaaaagattcagaccgtctcccaagaatatcgagaacgcgatgcgacgaacaatttccacgattcacatcttaataatggaatgcgttctcctgttcaccttaccgaaaaaaagggaaaatgcaaggcaatctcgataaagagccccaactcggattcccccaaaaatgaagaacgcgatgaacatcgccccaatcccccaatagaagatcaagaatgcggagcaagccatactcgatgtgcagcagaagctcctgcgattgcggatgcgctccacccacttcgtcccgtaccccgcagcccttccctccaccgtgtacagcctcagctgctgcgactgctgccgcgctgcctcccacacctgaagctgcagctgccgcaatgccgcctccgccgccgccggcgcgcgacgccgctcgaactccctcaacgccgccgacacgggcacggccacctgctgctgctgaggcggggacacggacgcaacgggagactcttggaacatcgtccgcgcagccggcggcgggtgcctagtcacctgcctctgacccgtcggcggcgtgtgcagtgcacgaaacggctgagggctatccacctccatctggccgcgcccgcgcggcgggcgagacgaccgagagccaccaccgcgtctgacccgtcatcggagcgtgcctcgcgtgaggcggcggcggcggggcgcacgtagaggttggtgtccgcgtgcgcttcggcgtcgccgtcgccgtcgccatccccgccggtgggccattctccgggattgtggggagccccggccgcttctggggcgaccggcgagggggaaggggcggcttccgcgacgacgaaggcggcgagggcgagggcgagggggaggaggatgacgagaagctgaagcgcctcgccaaggcctgcaggtccgcctcagcttcatcctccacgaccctgaagcgcgacatggcgggaggttgtctcgaggaagacgaagagttcccggcgcgtggcggggcaaatggatggacggatttgcccctagcggttgcgccgaattgcgggcggtcttggcggtgggcgctacggggtttcgcgcataacgcgggggtatttatgggtcaagagtttctcgctgctgacgtcatcgcccgtcggtgaaaaatgacgcaaacgagaatcgcctgcaaaagagagaacgggattgctctctgaattctcttcttccgtggccaagatgaaacaagtgaaatcgcctgcaatttaggcatggcctgcgctgtatttttctctgaactcaaaactgtgctgcaagcatactctgttcaactgggatacaaccatcgaaatcctcatcatccatccaacaggtgattgatcattaactccaggaaacagattcagaaactctattccagaacatatatatacagaaagacaaatttgtgcaagctatctcatgggacattgcttgagtttacagggaaggagctatctgaatcctgaggggaagacctgaacagcataaaacacacgccattatacattcagtaaagcaagcaacagcaatctaacctggatagctaccacgctgctgaaccttagtgcattacccaaaccacagaacttcaggcatcataattatccggcaaccaatacaaaattttcacaaggagcggtatatggatgcttggtgacttgattcagtcggtttcatgatctgggcgaggcgtataccaatcaggaaatctccccattcttctcagtagcctcgtataggaggactccggcattagggcctcctgttcttcagcaagctcttcctgtgttttcggcaatccgtcaggcacagggaaaggccttggcttcgcagcttgccccagggagtttgatgatagtgaattatgagatttctcagccatcttctttcttagatctgaacggtgatggatgctattgatcaggtacctcggatctccctcggagtccttcaccatccttgcaatttcctctttgggtagctcttgctgtcacaaatggagaaaccctgttaattcgttgagtccaagtagactgcaagcttaataatcttgatatgattgtacaacaatcaatacgaatggcacaaacctcaagtttattgagttcaaagtaagcatcccaacagctgcagcactcatcaccttctagggttgtgcaataatctgtatccagatcagaggaacaattgttaggaaatgattagacaacttcttatgcagttgatgttgcagagacaaacctacttaaatcaggttctaactgaatcacattcacacaagctgaatcatttttttccacaaatatgcaagaggattgtgtatccttgtattaaggagggtatcagggtaagcacacagaatgttggacaggctcaaagagccaacccagctgacgttttacataggtttacatctcacaaaagattgatgaaacgaccaacagcagagaagaacctgaaaaggggacaagcctacagatcacgacaaattgaattttctttgtgcatttccattctcatttcatctagttgaaattttattcagatcactgtattagctctgtacatttggcctcgaaagccaataattgcatataatgattaaatgatttatatataatacaaaacaacccttcctctgtttgactacagcacaaccttacagacatcagcaacaataatttcatcttacattgaaattaaagcatctatttaagaccctcaatctccaattgaagaaactgttttacgcctctacatcttgcattacacgctaattgtaggcttatagcactacttaattcttatgcttgttcacacaacatttagtagggatatattttagtttgatctggcagcatcactggtcctaagaagttatcacgaatcctactaagaaattaccacgaatcctcataaattacccctaattaactaaagcaacttagatctcagaactggagcatgcactgctactaaaactaaacagcaagtggcctaaacctcggcaggaagccgcatcccacgcagtaaaataatcccaaaatattgctagaaaacaggcagtgaggtgataactcgggctctcggctaaagcagcaacacaacccagcagctttacctgtgatctggtctttggtgcgctggacgagaggcttctcctgcctgaggaactcgtcgaggacgctgcggctcgagctgaagggctcccgcttcgggatcgagtcgtagttccgcaccgcgcgaaccactacccccgccgccgacccgcgccgcccagccgcggcggccgtgcgggaggccgagaaggcggtggccgtggccgtggccgtggcgggctgcgccagcggccggagagcggtggaggacagcatttttttttctccggcgtggtccccggctaatcgtcttcttctccggtggattttgggaaggatggaactaggcgagtggattagctcgcggcctatatatatagcagcaatagcggaaagcgcacgaaacggataaggattggccgcgagatagtttattttgtttgttttggatttttgttttgcaattctaaccttcaagttgtcctattatcgaaaataaagacgggagggattaaaatatcttgggatacttcggctttcggagacttttccatcgtctgcgcacccgggatccaaaacggtgggatctgagccgtcggtttcgaacttggttacagctacccgcgtataagagcaggtacaatagcagatataaaccagcttcaaacatattttaagaagataaatgagaatagagaacagcagtgggctataaatttatagtcagctgtagcacgaactccaagacacggggtgtgtattataggtgggaccagatattaatagtgtagtatgtaactattgtataaataggctattagattagttacagaaaaattggagctactagtttgctactagttggctgtactattaaaattgctctaataaaccacggcaagaagtgtcgacgtgtacagattttgactagggagtcgtcgtatttgttattgatatatacgtgtagttgatacatttgatttagtctagcttaagtctagcttatttggccaaatgatggctgggacccaggtggtgcgtgcagctcgtagaaactagtagaaagatatggtcatatggagcaacattttcagacagaatcagaatgctcatttgaaagctatacatgtatattagcatatctatgattagcgcaatatctgccaagctggcaagcttgatatacacggaccgtgttatacgtgtcctgtaattacagagtcgcagagtatgacagggctctgcattcaggtaaagcacatcttcacttgatcactttcagtcatgatctgccattcttctgagcagcctggtatgcgtggactccggcatggcagcttccgtttctccctcgagctcttctgccgtcttgggcagctcgtccggcgcagggaagtaaggtttggttttggtggagtgatcatcacccggagacgacgacgactcggcggccgtcttccgcgcctgcgcacggcggtggatggcactgatcaggtggcccatgtcgccgccggcatccttcaccaccgtctccagctccgctcttggcagctccatctgcacatcaaatcatcgaagaactaacagtggttaatgcaaatattattagtggtaatagattgatactactagctcgctagattgcccaaacagcacggttaatttagcacacctcgagtttattgaattcttcgacagcgtcccagcagctgcagcactcttcgcctttgagcgtcgtgcagtaatctgcgaataaggctgtgtttacttcgtgtgatttttttttacacgaacacatattttacatatttgaagtattaaatataaactaataacaaaatgaatttacaaattccacatgtaaactgcgagataatttattaaacctaattaattcgttattagcgaatgtttactgtagcaccacgttgttaaatcatggcgtaattaggatcaaaggattcgtttcacgatttacatgcaaactatgtaagtggtttttttcgtccacatttaatgtttcatacatgtgttaaacatttgatgtgatggaaaagttaaaaattaaaaaaaaattgaatctaaacacggtctaagtacttcaactggttatgaccactggtgtcctgtgcccatgtcagataatcagatggcacgagaaaaagttcaccggacgacgtaccggacatccggtccttggtgtgctcgacgagatgcttctccttattgacggactcgtcggcggcgccgcgccagctgagggcggcctcccgctccggtgccccgtgtctcccgacacggacgacgcgcccgcgcgcgcgcgacgaaacggccgggaagaagagccgggccggcgccgctcgcgccagcggcagcggcaacagcgtggcggtgggcggcaacatcgcggcgcgtgcgtgctgggtgagtgagtgtgctgtgtatgttggcgcgtggctgcctatcgtgcggaggacgagcaggtgtgcatggtggcctttatacgtgtacgtcgcgcatcgtcgtcgcggccgcggggcaaaaccggcagggaagccgtaacaccgccgctgttcggggatcccatcggcgcggcgcacagccacttggcaacgaccgcgcgacggcgcgacgggacgggagccgttggtttggcggattcccgtgggcttcccgtgtagaacgattcggtcgtgaaacgggtcgcgggaaagcgctccgcgatcgcgatcgagcccgcccacggcccatgggcaactctggagatgggctaacgacggttgtggctgaaactgcagcctgttccgggacgtcacacaaggaattttttttaatttttaattttttaataaaagttgtggcaaaaataatttttcattttgaaaattgacagaagtggtcgcctaccgccctctgggagggcgatttttaaaaatcgccatcccagagggcggcaaaagtgacttggcaaacggccgttcgctctcggacaacggccgtcaacaaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaatagtcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcagtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatagattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaactgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccgggccatctctccctctccccccgagcgctctcccgctcgctctctctctctctctctcttccccgcccgcacgctgctcgcgcgtgcgagagcctccccgagcgcctctctccccgctcccccctccgccccgcccgcgcgccgcgcgcgcgtgcgcgggagtcgcccgcgccgagcgcccctcccctcgcgcgagctccccgctcgcaaagacgcttcccgcgcgccgtgttcgcgtgcgcgcgcccgcgcggacgccacccgttgtttcccgcgcgcgcgccgagtggccgaccgcccggtcgccgccgtcgtcagcgtctgccgcgcctgtcgccagtgtcgccgctccgctccaaaccgcccgccgtcatcgccgtcgtcaccgcccggcccccgccactccgcgcgcaagccgccaagggaaggaggccgcgcccctcctctctctgccgcgtcgcccccgctcccctccccctttttcccgaatcggcaaaggggcaagccccctttctccccctccttttcccctttttcctcctcgccggcgtcatcctccctgtcgccgctttggccgcgaccgccgagcgccagctcgcgcccttgaccgccctaagtcggttcccaaaccgacattgccatcctataaacccaagcctccccctttcccttcctctcccattcgcctcctgaccgttgccgccgccccgtgctctgtctcgcctccgccgtccttcgccaagcgccgggagagccggtgcgttcgaggacgcggaaggggacttcggccgcgccctctccttcctcttccccggcccgaggccggagagattactcccgcgccgccggcctctcgtcacagcgcccctcctcttctcggtgatgtctctctccgttcttcctcctcgctccatctcctccccctagctttcagtagtagcttgagtagcctccccgtagttagccggcgccgccccgaccgttgccgtcgctcgccgtgtgtttgccgccgtcgccgctcgagctccgtagcacccgctcgtcgccggcctcgctcggcgtagttccgcccaatccgacgctagcgtcgagctcccgaagccgcatagatgctctcaccgccgggaatcgatctctcgtgacctcgtcgccgtttccctcttctcccgccgccggttgccgccgccgcaatccgccgtcgtcgagcaacctccgacgaatccgagccgttggctcgtctccccttgtcacgtgcaaccgcccggtgtgcacgcttttgcccgtatcgccgtggttcgctccgccgctcgccgccgccgcccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcacgtgggcccgccgcacctgcgtccaccacggaccgcgcgcgtgcaccgcgtcctttccctgcccgcgcgcatgagccacgtactccctccgcacggtgagccgagccgctgacaagcgggtcccacccgggaccgcgcgtggtgagcccggtccaccggactctctctcctccctcccgcgcgcgcgcgcttgggccgtcttgggccggccggcccgttaagctcggccgagccgctccatttaccttggaccgcgccctagccgcccgaggaaaagtctaatttccatccctctgttctttcttttcttttctttttcaaaaaggatttaattaaatccttttcctttagaccaaaaatccaataatcttataaattcaatatcttcccaaccgtaattccatttgactccattcaacttctaaaatttcccaaatctcgagatctatctagtggcacgcttagaggtctttaatagggctttattttcgccgtttgttgagttgtcccgtttcgcgtgtagtttcggagcccgaagacccgcagtgcaaggatttcgaggatcaagctccagatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccccccagttgcacct

SEQ ID NO: 61180 - DNA, 2026 bp, Oryza sativa
aattggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcctatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgttggtaaagtgtaccccctctgcagaggttaacaaactgttcgaacagccgtgcccacggtcatgggcggatgtgaggtgattcctagcgtagttttgtctgactactgcttgtgaaattgctgttgtgaaactgggttcgatgtttgaaaaatcagcagctgacgggatcagctaggcccgggtggccgtttgaaatgttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataacccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttgctgtgatactctgtctccctgtgataccagcactatttcctgggactggtatcgattaacaggttaatttggagcgtcacgggctagttccggtcgggaatagttcggggcgtgacaacaacggtcaccacaacgacactccggacgctcacgccacgtggggagtcctaggggatttacgtaccattctaaagcctcagcagcaattcgacgttcatgctcatccttccgccttaggtagtccgatcttgtttcactacgtgggtaagcacgggttccgtcgttttgtgggttctccatgtctacccactcaatgaagttgcacattggacgatatgtctgtgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtacccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacagcacagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccat

SEQ ID NO: 61181 - DNA, 8943 bp, Oryza sativa
  unsure (1)..(8943): unsure at all n locations
cccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacatgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtctgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatacttacattgtgtagacttcttggtctattctaaatcctctcaacaaccaactataaattgactgaaatattctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctatacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgtttttttttggatttttagtgaatataatgaaatttcagagaggggggactgggctttatagggggaggcaaaaatcgccctcccccagggcggcaagggggccgcctgcaaaattctatgccccctcgccgcccatttgcaggcggcccccctgccgccccgggggcgggctattggagcccccccctgtggcgccctgcccctcctcttggcagtctcattcctatcactaacggtccaataacacacgattgagagcgaggggtgggctgccgatggggagcggcgacgccctgctggttcgctcacttaatccttggttngctcccttannnnnnnnnnnnnnnnnnnnnnnnnnnnnnnnnnnnnnnnnnnactgaaaacaattctcacacatgtgattaagcccaatcgctctcctccagtcgcaactcaactggcaacagcccaaggttctttaccgttttgggggacggctaccatagcaaatagtgaaaaccaaataaaaatttatcagaaagttcttttttaacttggtagggttactggattcttactatttccgcatcgacactgcaacgtcgttaaagtgataagcgtgaaatcatttatagtgtacatctctcattatctgctcattagtttataagccacaatcaggatttaaatttagggcttattcaactgtttgatgccataaccaaccggaatagtgctacaagtagtaggcaacaacagtgtaaaaacgtgcaattacatccacaacctcgcctattgaacatgtaattagtaatgaagagtttattctagatacttttcagacttcagtcctagcttaggcagttaagaataaacatataattactttttattgtttaatttattttttaatgtttatctacaccttctataaagttacaatccactaactctaaaattcaacataggctaacatgtcatctcatcatccacgcactagcaataactgcttattaaaaagttcatacaagcatgcaatatcatatataatttatttaattatacaaatcaatatgtaaatatgttgaatcatcacctctcacatcatatccacaatatttcaacatatctatccattatttttataatacttagatatatttatccatatattccgtattaaagtgtggagtattatttagtttattatgtttagtaccaataaatcctagccttttttatcttccgcttcttgcgataaaaatcttggccaataaccaaaatttcatctacaatcttccacggagtctattaaaattatttctttccaaatatggcttggcaaaccagttatatttgttgttaataattaatatcatgtatactccttactctattgttgaaaaaaatagagaactactccctccatttctgattgtaagtcattttgactttgaacataatcaaattactccaaatttaatcaagtttgtcgataaatatagtaatatttacaacaccaaattagtttcattaaatctataattaaatatattttcataatatatttgtattgggttgaaatgttattacttttctatagacttagttacacttagagcaatttaattttgattaaagttaaaatgacttataatatgaaagggagggagtacttagtaattcccacggcacggcaaaacgttggaatcatacaatgttgataacttgtacaaccggagtatcgtgtgcctgggattgaggccgagataactaacgtggttagttgacggcttctagtatgggctccatatgtccagtctggaacagaggtacagtttcaagaacaagtgcttacagcaaagttgcaggctttaatcgattatcctagatcaaaggagaaagtaggcaagcagatagagctacttttccgaaaggcaaaatagcctcacatattaatccatctggaacttggacccctttttttcttttttctaaaccatctgaaacttggaaattggaagtaaaaacacaagctcaagctactagtctacaagtctacaggggagattatgtaagacgatgtttttctaactgtctttggaccatcagttgatttatatcagatagttagacgaaattaatcagacagctgcaactgcacaaacgaaatctttcctcaattgcagctggccagccactcatgggccatggctgtaaagaagccatggaaagcagttgttaggtacccccaatacatgctttggccatgagctttttttgtgagttgtgacaagaaacctttattaaccttttgatggtgaggagaaaaaacacatggaccctgagaaacaacataatgacaattagcagcagtgatatcatggtaggtacttcctcagttgactgctccagagaaatattttggcttttgactcttacttatatttatcgaattactatatgcaataccacgcaggcagaaccaaccaagagccatgacccaaagcccaaaggttacatctttttgtacaacatctggttgaattaaatggattgttcttaagtcttaaccagcaaagcttaattccttgcaactaacttctgaatagactgaaactatacataattggtagggttgagatcgttccatcagaaagaaagctatgccgccatgttgttttataattaaatagctgagtaccagggatgctccacatgggaagaaaaagaatatgagaatgatcgtcatccatggtcattgacctaacttagtttaatttgtctccagccttttttttttatcttaatcaataagtaatctaattgctgtttttttaaggctgtggtcatgcatctattccctttcccatccagtagcattgcaaccttagtgcatcatcagagtcatcacaccatgattggctataattaagtctatccatgcatgtatattgccactgttacagagtttgacaccctttatgtcttattacaggacacattaggtgttcatgcacagtggaccaatagaatcacaaaaactaatccaacatagtacttatcttgatcagctcataaccaattattggaggctcaaattagactttgccggaacagcagtggaacctacatgtctgcctcatctggttgacgaaatggcagttgatgtgggcctgaaaagattgaagaaatcagaagatgaccttctgatgcttctaatggagctactagagcctagagcagccatggtgatcgccaacgttgacgtagtgcataattaaatgttaccccgatctcgaagagattctcttcgcataggacatagctgatgactacatcaaagtagtttggtctgaatttaactgtttctactccttccatatcatattataactttctctagcatttaaaattgaatgatagaaacagtactttaaatggaaaaggtagttgtgatataggatgaaggtggtacagtaatagatatggctccaactaaaggcgacactgtgtttgacaagtttaaactgtaaacattattttggagaggtttaatatgggatggaggtagtaacagatatacaactccaacgaagtatcacatgtttaaactgtaaacactatttggagaggcttaggattacaaattattcatctttctaaaattgctttggccaggtctctcaacttgagctgatgtactttgaacattctgtacatgaccataaacaaaactaagagccaaactgtatgtgcattatgaaattgagctcatgtctattctttaaaagacggtgtcagaattacgttataccgataagaaactcaaccgggttttcagattgaccctagaccggttgacaattatatactaccaaaccttgacataagttaatcgtgcttggacaaatgcagcctgaattttcaatagtcgatggcagttcatccacgtcagagatgtgcactcgccgctcgcacgcaggccgatctgtcaatagtccttgagtcaatgatcggagctgttgggctgcgtcgcttttgcaggggagcgacaaaatcgatcggtgacaattctttcagctgaaaccaactactagaagtttctgaaggagtgttggcaggctacaaattgttgtgttttatggttttgcaagtttttatttaccttttttaatcgcccaaatttacattgtaatagtattttgcgagactggttaaccactgaggtgtcacttaaaacacgtgaattttacattgatttttattgacttatcagccgcaaccaaaataaaaaatttgaaagttaatttaaggtttttcgttataatttattttttcagtattgcatttaaatcttaaagaacacatatataaatgttttatgataaagttatttttggtttcttcatattttaaatgttatttataaattgtatagaaaacgatgagaggcttaattcttacaggagtctgaacattttccccgtattccaagtttggacctcatggtggctctgcattccatcagaccttcacaccctccttcgtcacaaaaatttataaaaccaacacatgtgggacattcatcgcttcacatggtttcaattctgaacccattcaaacaaattttttcatatggaaaaggatagtctagtgagaagcaccgaaatggtgtatagtcaaaagcacttatccaatatgcttccatttagaaggtacaattccattgcgacacattgacaaatttgccactcgaggcatacacaaaaaagcaaaagaatccacctgccacaactctccaagggcaccaagcttcaacaatttgacaaggcgaggcaacaactactacttcggattcatatataagacgctttcaccttttctagctaaaacttcttatatttgatcaagtttattagaaaaatataacaaattttacgatactaacccagtttaatcaaatctgtattaaatatattttgatagaatgtttattttatgttaaaaatattgctatgttttactataaactagattaaacttacataagtaaggagaacaagtaatgctttagaatatgagacggatgaagtagtagagatttggtacggtattttgcttgcatggcactggccccgtcctgttgacaatcctgctccttgtaatcgaagctcagggcatgcatgcctgcatgctcaggatggagctgcatactatcgctgtcactcctggtcatcgagagcgcatttctccggcgtttacttggcagaaaactaaaaagccggtttcccagttgatcgacgaccaattcgccgttccacgcgcatggcaggatcgttttcactgcgaaaatgatgtgttttctctgaattttcgagttcagatacttcaggtagatagagaagcgttcaatttaatccgtcatctccccgattgttaacaattgctcatgtgaagttctgataaaaaaaaataaagtacttggatcttctactgtattctttctctcttcacgttcagaggcgctaagatccaaagagacgataaacctgttactcttttatctgtaacttttcgtcaggaacacggacaaaatggagatcctgataacactttcacactccgttcttttaattttcttgacccgattattcagaaacggagttcatccacattcagaccagagcagcacacaagtcttcagaggagacgcaaacatgacacggacgcagcaaggacatttttggccgatcgtttttgagcattttgacttcctgggagcagtgcaaaaatgctgtgtgatcgagcggttccacgtgtgagaagctgtgtgtacgaagacagtgacatggacgcttcaggggagcaggggacttgttcgtatttttttgcttctgtgtttatttctgatggagaaatttggcccgtttggagtccgaaactgtgtacggatcgtttaaacgaagcttctatctatatggaggttgtctagaatttgtgtgtacttgattatggctaatcattacttatcatgcacttgactctatttgctttttggaacttattattgtttgtagtttagattatacttcatccgtcctaaaatataagggattttgggtggatgtgatatatcctaatagatttctagtattatgatatgtcacatctatctcaaatcctttatattttttttgacggaggattagttttatattacctatttttttagaaacatattctagcggccagagccttgttatcttaaaaacacgtcaacaatcagatatcataaatcctgataacgaattttactgcttctgcactttcaatgtacatgttttatcaattttcctaactatatatttataaaatctattaataatataacagtatggaaatacctttcatggcaaatctacccacgtcgtgttataatttcaaatcctaatatttatatattaattaatcatttaaagttttaaggtttaatcacacgcattctagcacgaacgtctatttgagaattgggtagtacccaacatcacctcacccccactcttattaactaaactatgacttatgagaaaatataccagcccccatatcattttcacatgtaaaagaactatatttatacatattaatgagttaaaatgttatattgtgcctatcttaaaacatcatcttgtagtactcgataacggaggaagccaacagataacggccctgtgttcgctgagctagttcccatccggaatagtgcgcatggaaaacgaaacgattcattagcgcgtgattaattaatattagctattttttaaaaaaaaatggaacaatatgtttttttaaacaactttcgtatagaaactttttataaaaaacacaccgtttagcagtttgaaaagcgtgcacgtggaaaacgagggagatgagttggaaacgtgggataagaacacaactaggctgtgtttagttccacgccaaaattgaaagtttgactataattgaaagtttaaagaaaaaagttagaagtttatgtgtgtaaaaaaggatgcgatggaaaagttggaagtttgtaaaaaaaggaaaaagtacgaattaccccccccccccccgaactatcgcggtcgtctgaattacccccctgaaccacaaaaccggacattcttcaccccgaactatacaaaccggacaaattacccccctcgactcaatccgcggggttttggtttacgtggcgtacgcgtggcagtccagtcagcgttctatataaaaaaaatgtggggcctacatgtcatacactcttttttcttactctcctcactcctctcgcggttgagggctgcaggctcagcgcgtaggcgg

SEQ ID NO: 61182 - DNA, 2339 bp, Oryza sativa
gaggcgccgtccgcccgcccccacgcgccgtccggccgtccgctgtcgccctccaccagccatgcctgccgatgcctctcgtgccaccgcctgtgagagagagagaggggaagagagaggcaggggtgccgccgtctccatcatccccacctctgccactgccgcccatcgaccatccgcccccgcgcacccgcgcgcccgtcctccctcgcttgccgccagccgcgcgggccgccgctcgccgctggccgcaccaaccgctgctcgccgccgccgcctccgcgccgaggccgccgccctcaaccgcgagaggagtgaggagagtgagagaaaatagagagaagagtgtatgacatgtaggcctcacattttttttaataaaacgctgactggactgccacccttaccccacgtagaccaaaaccaccgcggattgggttgaggggggtaattcgcccggtttatatagttcggggtgaaaaatgtccggttttgtggttcggggggtaattcgtactttttccttaaaaaaaagaaactaaactcgtcctagctcggattccgaaaatactcccttattccttaagctatcctgacattctgctactagcataatctggaccaaaataggagcagtacagcatagctgacatagtaaaaaagacgttacctgtgcatcagaaaaaaagtgtcatttggatgcttgtgcatataaagctgattgcaatgtctctcaagggcatatataaagaactagagtggtctttgcttctccttcttttcccccacacccactaattaccctaaaacggtctgaacatgtataaggttaccggccaattgtctcaagtttacactagatatgcaatctaaatattttttactgtttgatcatattcctccactaagcaaaccctgccacaattcataacaaatgttatagcagatgatgttgggaaaaaaaaaggaaagatgatatatacaaaaatgttcatccaatgtatagccttgataatatcgtaaggagttggaaccaaggggaagatctgggtcttagaagagccgagttatgttccatttttttttgttctagtatgcccaacactatgttttactgcatatagaaaaactggaaatcattttctctgccgcaatctcttttcttcatatatttggttgaatcatatgtggcttttgtgaaaatatacttgcatgatgatctgtttaaatattttgttcgatcgatgttctagaagaaaagatatttgtgcataaatttttcaaaataaacatgtgggattagatataggagcccactagcatgataattaggccgggccccaattcttgagctttttttgaacctgaaccaggactctaggatgcaaaaacagtaagcctagaggactgccatgaaagatctcccatgaaaaaggaatatctctgggaagaagtcaatgatcatgaccatcaaaattgcatcccattctttttccaccaaaccaagcctccaattattcaaaccatcacagattattcaacagcctcccagatcatacaccaaatccgaagtgaaaaatcaaatgcagtggactcctttttgaaaagtaaaaaatcacatcatgtaaaatcattagtggacttaattaaatttgtctgtgtgagctgggataggatgctgcagtgctgtacccagtcagtaaagatccgccaatataagatgggaattaaatggatccagtacaaagttcatttaaacgagaggcaaatcaggagatgaactttaataaatgaaccaagtaaaaaaattgaaatagagatatgaaagaaaaagaaaagaaaatttcaacaaaatttattggaatcgacattaaatgcccaaatggaccccttgcttttaattccgtgcaggcgagttggtgtgttccaattaactcctctcctctcctcttcttctcttcctctcactcctctcctctcctctccccttctctgctccgttcttgatccagaattccagattccgtacgagggagcgcgcatcccgaacccgatcgttcgcgttcgccgatcccctgagtcgcgggggggattcttgctttgcggcggaattcgatcgcggtttggtttggtttggtttgatcccgaggaggaggaggaggagggggaatcggatggtttacgaggggaggggaggtgatgcatctgtcgctatggaagccgctggcgaactgcgccacgctgctcaagaaccggccgccgcggccgccggcggcgggaggggcggcggggggaagcgggcggcggctgcaggagagcaagctgcgggaggcgctgga

SEQ ID NO: 61183 - DNA, 1052 bp, Oryza sativa
atacaaagcacgttccctagttagatgtaggttaaacttcccgttcaaaaaactttaccttttacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctttggggcaacaaacagcaggc

SEQ ID NO: 61184 - DNA, 11372 bp, Oryza sativa
tttggttcccagccacactttaccattatttgccaacaaaattgccacaccttgtctaaggtgaggtgatcaaattgttacccacaacttactaagcctaagggaatcttgccacacttttttgagccattgacatgtgagacccaatttgttggaggggaatcttgccacaactgtggctacaaccaaatacctgtcaaatttgtctaaccttaggcgtggcaaactgtgacaaactgtggcttgcaaccaaacacacccggagtacgtaacgttgattacgttatgggcgtaatctgtttttctcttctctagctcgtgtcgtccgaggcaggcaccactcttcactggctcactgctactagtactgtactgtgcatggcatgcatatttgcataatcgatttgatctatggagtagtcacaaacacatgcacagaggcacacagtcgtgctatagctgctggtacgtacagggccctagctagcgaggagtacgtagcgatcgattaaacaaaaagattgggcaaagatctgatgcatgggaatgttcttggagggcgatgctgataggcagcaggaggtgtgtcttctccccgcgtgatgatggcgtctcccgatcgaatctttgttgcctctggcagcgcgccccgatcgacggattggaaacaccaagtttgtttttaccaagccggcttctgcccctgcctgcctctctcttccccgcgtggtgaattccgaggagagaacaaaagcgccgcgaggtgatctgataaagctgtgacgtatcccgcgccaatttgttactcctccgaccatcgagatcactagagttagttctaaattcatcgtcacggtttacgtataaataatcacgatcaccgatgttaaatcctaccacactagtactagattgatcagtgcatgtgatttgctcaatcaaaacccatgtgatcggtggcaaggtttgcagagaggaaagaccgaaaattggccacaaagggctcgtttgaagttgagcttttgggtcggcaagcgagcgagcaattctacgagagagagagagaaagccagcgcgtgcctttgcagttggtgcctttttgaacagcccaaagcagatggcacgaatccccagcttgacccatcatgattaggaccgtagcacccagcccggccggccagcatccatctgtaatccgcacccggccccgcccccgtcgtcgtcgtctcctccgtttcgcgcgctccctcgccgacgaaaagacaccgcgcgccccacccccaccaccaccccgatattcttcttgacgcgggcatcgatccccgcgcgcgcgggcgaggaagaatgggatgaataaaaagcaaggcaccggatggtacaagagtttgtttcctcatgtcacgtcgcgtcgttcagctagctcaccgcggttgaatgacaggcacggtggacaagcgagcaggcaatggcgcgtacgaggctcgctccctgctatgcatccatccgtgatccgtccgtccgtgtccatccatcgactcccatgcaccgcgcaagtgcacggcagacacaacgaatgaccggccggccgcgcgacaatccgatgtggtagtcagctagctgcatgcatgcatctatcaggaggtatccatctatcgatcgatcgatcgatcgccacatgccggcgtgagtgacgtgcattcagcggcattccagcgtgccgtgccggcccggactctgattgtaacgtactactacagggagatgcgggtgcatgcatgtcgtatatcagtatatgtgcatgtccttttcatcccatgtgcactttattatcgatgctacgatcttactttgggaaccttttgatgctctgatgatcatcagttcccaatctcgcaatgacaccgtagacagttttatccgattcagctaagtacgtacttgtacttaaaacttgatggcagagtatttttgtggaagagtgtacgcctttataaattactcctgtggcaaagaaaggtactctccatcaagttcacatactcttttgattaaggtatggtctttgcaattatcgactctcagtggatgagagaacacgtacgtcgaatcgaatgacggagcaggggatagctactcctaggtacgtactcctacgatcattacacgccatatactagtactacgagagagagagagaatctcgctatctcgtgcccatgatcggtcgccatgtccgggagaagagaagcagcaaggcaacaaggtaaagcaggcccgagccggagtagtagcagcccgggtttctaggagtcaatcggcacaaacacacagcactgtcctgtactactactggctactactcctaccacctagccggctgtagctcctccttttactggccactagcttaggcctgtgtcactttaccgctttgtttccctgcctgccttgccgttgaacggggtcggcccccgaacaatcgacgtacgtacgcactctacccacacagtctccagcctcggccgcgcgcgcgcgtcaccggcgccgcaccggccgtgtcacctgctcgacgagacgacccactcgcgcgccgcgcgtcttggctcggggatgagctgtggaggatcagaatctggccgcgcgcgcgcgccgttgttttcgccgggtacggccgcgctgtcggggcgcgccgcgctgcgtctgcctgctgccgtgtccccgggcggcacggcacgctgcaagcggacgccgttggcgcagaaacggttttgactgggcatcgtcgcgtgcccgcgcggtgtgtaaacggtcgttttcttgccggccgccgccgtttcccatcatcatccagacatccaaagaaaaaaaatgaaagttccatgttacgacttactctctccattacataatataatattttcaagcattactcacgtttatatatatactaattaatctagacgttttaacatatatataaatataaaaaatacgagaaattcttatattataaaacggagaaagtacgtgcaaatataaactagctagtgccatggcatggtttctctccccaatttgtataagaaccgaggccatgtttggataataggtttgtgatatgatttcccacccctcaaagggtaagttttaatcttagtcatctattctccccactccatttcattctatccctccattcattttcatttcccaattccacatctcctaaccaattatccaaacacaccatcgaaggatatggccctgatcatgataggcgttactactggtactaggagctgtgtacgtacagtactctactatctgcggtggcggtgggcctaggtcatcgggaagtgggccacaccctgaccgaccgagaccgggcgaccggttcggatgatgttttcgctttgtggcagcttggcagtgaggaggacgacgccaacggccaatctctgcgacgttggctgccagaggcagcagcagccagctgcagctcgaacggaagacgaagctagcaaccgaagaagcatcagcaggaagcagcactgcgcgcgtgccagcgtttgtccgaaacatatatgcgtgccaggaagtaggagtatgcggtttgctgttcagagttcagacaaagccaattgtactgtgggcttgtaccagcaacgagtaacacgggaatttgaactggttttctggtaaaaaatcctaaaaagttcctaagaattctcacttctctcacaggagcctaaattatgtaatagtgtaatcaacttcaatctaatactcctatacttcaatagtacaaccaagattaactttagaaaaccgtggtgtactctgaacttctaaaattttagttacaatgcaggctctaaaagcaggtacaataaccagctacaagcctactttatggattttaataatgagatgaaggagagagaaggtaccagcaggcgactgtttaagcgccggctctactcgcgctccaatacatatttgagcaataccagtgattcaatgccatgcactgccacttatgttagaagagagagtgcatggtactagaagaaaaataattgtttaaggaataatacttttattactatagtatgaatgtagattggagtaagcacttggctgtactactagacttgctctaacgccctcggagagcgagaaagtgtagaggtgtgcacccaagaaagagcgggactgcagctgtttagaagaggccctaaattactctctgttcagggcttttggcttgttatcatagtctcgtcctttccccttctttctttctccatcgcatcatgaaggaagaatacactgccgtgatcagccaggctcatatactagcaacaatgttctcttttgtggaactgctactgttcagaatgtgacaagcctggtcatgatgatttcgctaaagggacttgtggtaatcattcagtagtgatcaggggaaactgacgactgaatgtctgaataaatgaaagcgcagaacatcacgccatgcatgtcgccaaaacattggcagatgatcatcaaccaacagtttcatgcacacacacaaacacaaatactacacacaattggcaagcaagcttgttcaaaccagattgcaaaagggggtcaaaaggtgtcacctcatgcatgagtcacagaattctggatgttctcgaggagtcaaggctgcagttcagtccagccgaccatgcgagtgagtgacaaggccattttagtttgtagagctctcacaaggtcacaaattgtcaagtcgagcacccaataaatatgctgttcttgcatataataattaagtttattagtttgttagctcttgagttaagccagctgcttgggcaacgacacatggccttgtactcttgtgcttcctagcgttctctcccattgactgcatgattagatctatcccttgactgaccattattaacctgttgccatcaattaatcagctcgatataagcatgttgctatctttctcatgtactttcggtttagaaaatgtatgtgatgatcgaatcggttttcctggaatgctctgtgtctgatttacggggcgccatatgcatgatagcacacgctgctggctggccctacacggccagatcgaaacatgcaggcatgtacagaatgtgattatgcatatattgcatgggttccacttccttgtacaaattaatatacgcacgtacgagtggaatacaaggacgtttcatgtagagaagtagctgtattgtcttacgtgtgatcacgggcatggacgttaaatttgtagtttttggtacagtatagatataacaccaaattaaaatgtgttatagaacaagctagctagaagcaagagttgtatggtctgaagctagctactagcagtaagagcaattaatatatcaaataattaagttcaattcccagcaaaaaacgccagcatcaacagccgcgcgcatcccgtccttccgaattaacatgcctttaatccagcgctacagcaattgcgcaggaaaaaacaaggttagtttgactaaattcgttataacattgatcaccaattaacggttgtgatatcggcatccatttgactgctcggaaatggcagaaactagaaactgttcaatctggaaaaatatcgtggcaacttacaatgcctattagcagttaccgaaaataggagaatatgtgcaccaattttcgtattgctaaattgataatgctaaagtaaacaccccccaaaaatatatatatatatatacttcctccgtttcacagtataacttattctagcatttctcacattcgtattgatgttaatgaatctagatatatatataacatcaatatgaatgtggaaaatgttagaatgacttacattgtgaaacggatggagtaatagacagtgtcaaagaaaaaaaaaaggcttgacactttcaaaaaacaacttaaccggtgaaggaaaaaccactcccacgacttttcattaagaagaaaaagtcttgactaaacccggccaagagaagccatgaaacctaacgcccacacacgcgggacgggactctcttgctacccctatacgagggcctactagatcgattgtccccctccttcctacaagagaacctaaaatttaactggtactaaaattcgttcccgtggagagtagaaccaaccaaggatctgtaatgctacttgagcactgtaaccgataagctataggttcttttgcttgtcacaccgctaagctataggttcttgtgatgttatcttgtcactgttttaaacattaaatctgttataatattgatacctttcactatgtgtgccttttcaaaataaaaagaaatgatctcttttgattgacatttttcatgaaattttctactttcacctaaaaatgggttttcaaccctaatataccactaactcacgacaatcaaaacttcaaagttttgtttcaaaacccttttacttttccctgaaaatccaacctttagaacttggatttaggaaagtttgtcatgtgaggtaaagttgtcgtggctcttggtactgtacattgctgaacccaaaatgaatcatttgaatattactcctagctaggaatgaaattgtaagaaggtgatatgattcatagtaaaagaaaaaaaagtatgagctaaaaccacttataaaaactcgaccaatgcaccaaccgaagtatttaacctgtaaaaaaggatgattatctagtactccacttaccaacataagtacggagaagataaaaacaaacaaagagacaacccagtcagttagaactagaaacatgacagtgtaaaacagtgcaaaccccaccattcatcattccaaggaaatgcaaagcggcccccatctacaacacatctagaacccctaatccatgctgccatgcaaccagccaataatttacagagcaaagacaagttttatcttctgaacatggacaaataaggcacagaaagaaagcagcttcttctagccctagctaccatccaccatcctctttataaaccctcatcaccccctcaccccaagtactaccataactaccccacccaacaccatcatctgatccatttccacaaagcttctgaaagccaacacatacctcactgcctttgccttcttctcagcttcaagaagccttttgagcttgtgatttctacatcatccatccatttcatcaccatgatccaagaactccttggagggacaaccatggaccagctcaagggcgccagcgctctgaaccacgcctccctgccggtggtgctgcagcctatcgtgtccaacccgtcgcccacgtcgtcgtcgtcgacgtcgtcgcgctcgtcggcgcaggcgacgcagcagaggtcgtcgtcggcgacctcgtcgccgcacgggcaggggcagggtggcggcgcggcggagcaggcgccgctgcggtgcccgcggtgcaactcgtcgaacaccaagttctgctactacaacaactacaacctcacccagccgcgccacttctgcaagacgtgccgccggtactggaccaagggcggcgcgctccgcaacgtccccatcggcggcgggtgccgcaagccgcgccccatgccggcgccggtcgccaagccgcccatgtcttgcaaggccgcgccgccgctcggcctcggcggcgggccagtgtcctgggcctccgggcagcaggccgccaccgcgcacctcatggcgctgctcaacagcgccaggggagtgcagggccacggcggcagcaatgtccaccggcttcttgggctggacaccatgggtcacctccagatcctgccaggcgctcccaatggcgccggcgccggcacggcggcgtcgctctggccacagtccgcgccgcggccggtcactccaccgccgccgcacatggactcccagctcggcatggggacgctgggccaccacgacgtgctgtcgagcctcggcctcaagctgccctcgtcggcgtcgtcctcgccggcggcgagctactacagcgaccagctgcacgcggtggtgagcaacgcggggcgcccccaggcgccgtacgacgtcgccaccgcgtccctcccttgcaccaccgcggtgacctcactcccgtcggcgctgtcgagcgtctccgccgccgcgccgaccagcaacacggtcgggatggacctgccacccgtgtcgctcgccgcgccggagatgcagtactggaatggcccggcggcgatgtcggtgccgtggccggacttgcccactcccaacggcgcgttcccatgagatagacgacggcgacgacgtcgtctcatgcaagcatgacattactagctagtgtagctctcgatcggtttagctttaatcatcatcgatcttgtgtggtttcggttaatcagtgtgaggactctgaggggtttaatcaagggtgttttagttactggtgtttttgttaatcagtggggatcgatcaagtaaccttttttactgtttacttattattaggtttttacctagggtttggtggtaactgggtatagtgtttaagtcgtgatcaatgcatagatggggttgtactatgagatgtgtacgtgtgttgtcggtttcgttcaggttgatccatgtatggatgtaaggtttacattccctgcaagctcgtggacgtacttatctcagctgcaaatttcactttcgacgtactctgaaatgcaaagtacagggcttgattgtagtaatggcaagaacttactgcaaaaggtggaactcttttgtttgctttcaaatttgtcttgattctgatcgttataatgcatgctatgtatgcagtcctggatctgggtttatttggagcactcatgctgtcatgcttccttgtttctttgctcatagaaatgagcgaaatatatattcactgaaattgttgatcttttattttgcatacttcggatcagagacagcatgataaggactacacatatatactttccctactagatattgtactgtagcagacattcccaagcatatactatatatatatatatgacctaaagagatgggccatgaattccagtcctagctatctttatttataggaagggatcggattatttctctacatacagagccggatctttagctaattaaccctgcttactgagtaattttggaacttgaatttacatttatcatgcccggcccattgtactccactatacaactattccatgacccatactagtattcaagatcagatgattcaaatctgcttgataacttctttttaggtctatttgctcaacaagtgttgtttagacttgagtactagggcatgagacctgagccaatctagctattgttggtattctgccttcctactggttggtaataacccacatatatacaattggccttcataacacctatagattcactagtgtgctttcacagcattatcacagctcaaaagtagtttatactacatctagctatagcaaaatgtctaacttagcacttagcagtatagtgtaccccttttgattagttacttctccacatatatatatctagctcacttgtgcctgtctaccaaatgagctagatagtgctgatgcccaacacataacttacggagtaagagtatagcacagcatgcatatataaaaagttccatctaagctagtgcttcataaaatgtgttgcatatatatacctccatctggtgctagcagcgagccctaccgctactactatttcacatgccttcttcccaattcccatcgtatcgatcacgctgatcaaaattagtaggtcatcaatgcctgtctaaaatggctaatccataggagattaattaggagtaatatacagtgtagtactgtattccatagcatgtcagctagtactaataagagtatttatattcaccaacagtaagcacatctcaatcaagatacagtcatagagagtgattggactacccatccatattgctaagctcttgcttgttcaaacttgcttcattctgaaacttgaactgttttcagagaagcagctagccacaggcctcgttcagggttcagacttcagaccacgcatgcagagagagagagagagcagccatatgggaacaagaacaacactagcagccatagctacacactggtgcagtcaagcaagcagagaacgaaaaggagagagagagagagagacgacgaagcgctagctaccgactggccggccggccggtcggggacggcagatacattcgtctcgccaccagatcaatgtgcatgctagtagcatgcatgcagccttaagaaggaaggaaggaaaggcacagtatagctgaaacggcaggtggattcgattctctcatgcacgatgcccaaccaatggctggataacactgactggtagtattggctattactactactccctccatcgggattttgaatttttgtttgtaacgtttgaccacttatcttatttaaattttttttgaaattattatttattttatttgtggcttactttattatctacagtattttaagcacaatttttcgttttttatatttgcaaaaaaaatttgaataagacgagtgatcaaacattgtaaacaaaaattgaaaatctcttatattgtgggactgagggagtagccagtagcttagctagctgcagaatgcagaatacccgaatgggtgcagccttatgggttggtggagtgaaggaagagagagagagagagagaggtgagctctcgttgttttgtccatgcctccgacgaagcacaatgctgcaagcatcgatccgtccatcatccatcgccaacatcgctagcaactctacataccacggagatctagagagagaggtgcatggtggtggtggtggtgtcgtcctcggaacacgcacgtaaatattccgtctccggccgtctcgatcgcccccatcgagaagcacgtatagtacgcatgcatgatgctttcttttatcatctctctcctcttgctcactccctctctggctcgaggaggaagagggagaagggatggatgtctgattttcctatacattctctgtctcgtaaaagaatgatttaagattgaatgtgatcatttaatctaatacaatagatatagatacgagtctattcagactcgttatactaggttatatcaaatctaatcttagcttgattgttttggacggaggaagaatatccgatcctattatgccaggaagtttgctattggtcatgacgcactacgctgtgccggcctgcactggggtcattgttattctcatactccctccgtttcataatgtaagtcattcta

SEQ ID NO: 61185 - DNA, 757 bp, Oryza sativa
agcaattttaagcagaagctcgctgttctcaccgtcggcgaggagacgggcgcagagcgggagctcgcgcctgaacatctcgatcttgcggcgctcctcctcgaggctcatgatgcacgcctccacccccgtcgcctccttggccgccgccgccgccatcctcacggcgctcctcgccgcgaacatcttcaggtccaggctcaaatccagccccatcccgatctcccccacgtccagccccatgtacaacaacaacaacaaacaaaactctctctccctctctctcgaatctttgcaacaagaacaagaacaagaacaagaactggaggaagggtcgcggattggagcggaggaggaggagaaaggcggtggtggtggtgggtgagggggatctggaagctgcgcggcgatatatagacggggaggtgggaatctgcgagctggaccgcaggatttgttcgtctctctctctctctcgcgcgcgcggaggcgaagcgagaccgcgcggcgcgtggggtgggtgggcgcgatgcgttgccgattcctcacgtcgcgtccgtctcgtccgtccacccgcgagaaactcgcggaccttgggagcgggctagcgatgtcgatctaccgcttctcacgcccatgcagaacaccccctaacctttcccaatttcacattccagcccatatcacgcatattcctccataaataaaactcaacttacagaggtcgggtttagttccaaaataattcttcaaactt

SEQ ID NO: 61186 - DNA, 4103 bp, Oryza sativa
tctatcggccatttttggctggaccaaatgttgctttgttactggctttttgcaagttgggttttgggtgtgatatgagtggaaaatggacgtgcgtccccgcgcgggggcgtttttgacaggaaaagctaaggggaagctagcgatcaaggcggcttgctttttggcggctttcgctcgcatcaatcaaaggcgccgatggtgttgtggtggggcggcagcgcgcgcaagagcgacactgggaggcagagcttgggcttggctatggccagcagccgccagccggcaggagacaggagagtgctgctccctgtagccactagccaaggtaagtaaagcatcatgatcaaagtggtaatttgaacatgagagctactttcttcttctaaaataaacgaatctagaacaagataataatagaatgcgattttttctagcacaataaatcttgccctaaaataaaagatgataggatgtgatctttctagtataataaatctggacataatatcatatcctattctaaattgatttttatggaacggagcaattatgggtttgcaatatcgaacggttattgcagtaaaagcctctcttttttatcggtaactgcagggtaacggcaatataccggtagtggttacccccagcaaaccagtacgaggaaaccctgcaatacttgtgggaaatgagtgtttttgtgtagtttttacaaagttccagtgagattattctgtaagggcaagtgctatggtagatgtgactatcacctctaaatttatctattttatttaattatgaactaagaggcaactcatacaatgtatctaatactctcacatccttcttgaaatttgtgtggaggttgcctcttgatttaggggtggctcatcatctctctcctcacttctctcctccacatcatcactcaatccaatgtggcattcttagaggcaacacatgggttatatctaatactctcacatccttcttgaaatttgtgtggaggttacctcttgatttaggggtggctcatcatctctctcctcacttctctcctccacatcatcattcaatccaatgtggcattcttagaggcaacatatgggttattacagtacttgccctaaagtttccaaaacttatccacaggagagatgctgttggcagtgcatgcactgaaaccatcattttcactgaaccagtaatcccatacgccaggggaaaaaaatccattgcatcttcatcatcaggtccactctctccattactagtactacactgcaagtctgcaacttgtcacctacggtaataatattcacaaacggagcaacatgtatgaatggcatgacgagtcgagaggcggagagctttggaagcctggatatgaggctgtcgccgcgacaagagctagctgtgccgggctgccggccctgtcgtcaggctgtccacctgtgggggttgctttccgtaatcatacggtgcacatgcccgcagtacatacggcgtcgtctcatggtcctcctactacggttttgcctatcggctattcagtcatcagtgggcggtcggtttggttggttggttggttgctccagcgtgtgcgcaccgcgcagcagcaggggaagttaccgcctcgccaagtcgcgatgtgtgtgtggcacgcgcgctcatgcgaggggagatgggatcatgggcatatgggctgcccgctcccgccgttttcgaggcttttctggccctgtgcaatagccaatagtacggtggggttgtgagaggttgcagcccaatttttgtgttgcggactcgcggggttccgcttgggcttgttcgcgtgcgcgatcagctgctcccctctagtctgatctcttatcctatagagtactactatactatacgtactatatatacacacacgtatgtatatacaatatatatatatatatatacacgtataaactttgtatgcgtatatacgaagtttatacgtatgtatatatatggtatatgcatacgtgtcatatgtgtgtacatatacataattttatatgtatacacttttaatgtataaaagatacacatgtatataaagtttgtgtgtatacatataaaaaatttaaaaaatacgtgtatacaaactttgtatacgtgtatacaaactttgtatacgtgtatacaaagttggtatacatatgtataaaaaccaaaaaatacacgtatacaaactttgtatacacgtatgcaaaagtttgcatacgtgtatataaagtttgtatttgtatgtatacaaagtttgtatacgtgtatactaaatttatatacgtgtatacaagtttgtatttgtatgtatacaaagtttgcgtacatacgtattaaaaaggaaaaacagaaaaatatacgagaagaaaaaaaaagaacaccggaaaaggtacggaagagaaaaaaatagaaaaaaaaaagaaatcgtacgcccaaagaaaacggacggtacacgcgctgtcaccgcctcctccccgcgcgcgacacgtgtacagtcgcacgcaggagggtgagcgcgactagtcgtgtattagccgtctcggggggttggtggctcttccgcacttgcaattgggagttgggacatttgcagtttggcactacgtcctatataaaattatttaccacttctgatgtgatgctttttaccgatttgctactactaaacccacgtgttataatcatatgaggaatttttgtatcattttcacgcgtagtaaacataggtccgacattactgatagtgcaatgttaccctgcagcgtgtagttagtactacatggtactatgtacatagtacacatgtactaatatgattttcgacggtccagaccttgaactggagctagtagagccaggaacctgccagcgtgtgcactccacgaacagggcccggaaaagagaaacggggagaggaaaacgcacgtcgacatgtggaccatctcgggccaatcaggatccctctggcaccaattgcgccttcaccttttcacaggcaaaggataaactcctccctgccaccatccattccgccggcgccttatcctaccctcatctcccgtacaaaacccactccctccctcccgctcccaacctgacccactccaaccccccctgcgccattgccggccacactcctcttcctcctccatcgccaagaaccaccacgaggtaggcaaaccaccctcatggagatggatttctgtcgttctgagctgcaacattgcttgatctcatcgttggttttcttgcagcaatggcgtcgctgtccatggccacaacgctgccgtcgctggccggcgccgcaccggcggcgaggaagaggagcggcgtgacgtacgtggaggggatgaacgcgtacagcgggctcaaggcgctcaacaaggtgaccctgctcggcgtgcgcaagaccgccgactactcgttcgccaaggtggtggccaagctgagccccgccggcgggaagagccgcggcggcgcgttcggggcgcagtgcaacgccgccggtgagatattcaggatcgccgtcatcatgaacgggctcgtgctcgtcggcgtcgccgtcggcttcgtgctgctccgggtggaggcggccgtcgaggagtcggagtagtggaccccgatcgagccatagcaggcagggcccagccagccatggctggttggccccgataagccgtgatatataactgtgatgtatgtttcgattaaaatttgctttcgttttgtacccatgacgattggtgaatacccttggaacgaaacacgttttggaggcagaacctgcaaatgcaattggtttttcagctgtacacattgcggacttgctacggtctgtccaattcttcttccagagtttacttcggttttgaaacattcaaaaaaccagaatgatcacatcatcaccatcattcatcagcactgaatcatgtttagtgtactcactttcccataaactgatgacaaaactgaatgttataggctttcattttagatgatgccatgcggttgacagaagaagcacagcaggggcaaaatatacttttagttcaatgcctataaga

SEQ ID NO: 61187 - DNA, 35246 bp, Oryza sativa
gttcgcagtcgccatccggttgctcaccgtcgccgttcgtcgtcgtctcctcccgcgccggccgaaccccggtgagaactccctccccttctcttcctctcgcgcgcgccgctgctccccgcatgcgcgtcgccacgatgcgccgtcgcccgcgtcaccggccgccgccatcttctcgccggtcgccgccgccgctcgcctaaccggtcggccggcttgcagccgagctgagcccggccagtgccacctcttccccatgagccgccgcccggtgggccccgcctgccagtaccccctccctctctctctctccttgagtcactgacccgcgggtcccgcgtgtcggcgccgcaccccccttgctgacgtcagccctagggcaatattgcgcaataaatacattaaggcttttctttaatagtaaaaacacagagaatcttctaaaaatcataactaattcatccgagctccgattaagtccattcaagtctcagtaaattcataaaaatgcatagaatccattaaaattggttttgtttcctgtttcagtagtcttatagcctgttttgcttgtgtgctttgtttgtcgcgtagatttcggccgtttcgtcgatccacggtttctcgaagacgttgctgtggtctcatcagtgcgagagcaaggcaagtcatgcattataattgatcatattgtacccaatttacaaatgtcccgcttttctattaaatattgcatcgttttacaatatcacgtgggatgggtcctactactcagccatatattgtttaccttatgccattgctaactcgggtattaaaatgactagatgttggtttaggaaatgcttagccatgcttagttctattagtacacaaaaagggaatcacattaaagcatagactttgattattggcaatagctctggattagtgccaccgtaatggtgttggctaattaaaatacactacatggtgggctgtgggtgcatggttttgctagttgtgcccatggcgattaaggatcggttcgcgggaaaccctggaagaatttatcgtgcttaccacaagccagcgtgggcaacggctgggcttgtagtgtagcttttctctagccgacatacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacggaaacgtgtcgtgaggctgtgtcttgtgggtacagttgtacacctctgatcagagtaaaactattcgaatagccgtgcccgcggttatgggcggtcgaccagattcaccgtgattagtctcacccctagttagcttttggaactggttagttcaggtggtggtttgggcctgtctcaacgtggtgtagcgttgagcagtgattggttaatattgattagttactgcaactgttttactgttttcaacaactgcttttaaatgctagctttatgcaaaaaaacctttagcctcccttggatataccctgcatcatacctcctcttccggtatgacttgctgagtacagtgggtagtactcagtcttgctctcttttcccccacaccagagttgaagtccttctcagttgaagatgtctcgaagaggttggtttcgtcactgccgtcaaggatgcctgtggaatggagtcgcccgctgcaggagtcaagtcttcaggcttagctcgcttttatctttttccgctgcatttgtaatcttttatatttttgtaagacgtggatctgtatgtcaacaattgtcgtttatgtaccctggctggtcctggacaggggtttaatacacattcagcttagtaattctggttcgtgaatttctgggcgtgacacgttcctcccgtggccaccggccttgagctcccgtccccgccgtcgttttgacgtcggtggtcctgtcgccctcgagctctcgtcagtggcggtttcggctcccttcggctctggcgacggtggcttcggccctagcgacggcagcgaattgacgttataggtgctatcctggttgctcaaaatctcggcagtagtggcccaggcagcagccgccttgttgagaagtctcagtggtggctgctgctggttcccgagctccatcccctactgctcccatccgactaggttgatttctttcatatgtagatgtgtatgatttcttcccttcttattgactgttgatattgagaagggaatgcaagatgtgcatgtatagagcaactatgtatgtagctagttgatttagtttccttttggtactattaaattagctcatgtactagataagtggtataataatattactgctatattttgttgttctgaggtcctgtaagtgctgaaatgatgcctaagattgcttgctatggccatgaattgttatgcagttaggtactctgccatattttgctactgtaatgcccaggattgcttgcaatggtgatgtactatgccagcgatgctcataacatacacagtacttgccttgttcttttagtttgtcacttgcattcgttttatggccatgatgcttatgatccacatagtggtgagtgcatggatggtccacgaagtgccttgtcaaaatttctataaattgctgaccattctataaattttctgtgcacttattactcagtctcatagaatatgatgcactcatggatatttcaatctttctcaacctctcaaatacaatcagtcactgagaactcaaattgcactcttaagggcataatggacatttctaggtaaattaaccactcaatgctatgagaactaacggtagggacatgggagggatcacaacgaaatctcgagggcacgcaggggattgatcaaaattgaaggatatggaaaggattgagtcagttttgaggtgcatacagggaatttactctagatggaatggcggcagcggcgttcaaccagaggtgggaaggaagctcacgatctcttcactttgccaatggatcagggattttctcgagtcattttgcagctggggttgagaagttgatggtgcagtaattcggcctgggttgccccttggtgtctggacactggagatgggaaagatgatgccaatctacctcgtgcacgattcttggtgctctgtcaggagttctctcaggcaatgacttccttggtctgaattgatcaagtctgatggtgctgtggcatggccagaggagcaatgtgcttgccagaatgcgagcatcacgtggcggcggcgatcctgatgctgcagagatggataagagggcggctggtcagtgcagttatgcagagtattgtgccatgttcccgcgaatagagatgggctgggatgctgctaggtggaccacaaaattggggaggatgaaggtacaaaaacttaggtacatatggatttgagttcatctcaggatttttttttcaacattttctcttctccgaatcgaattgaccaaacttattaatgtttttaaggcctgaccattttaatgcagcatttgcagggagcctagtttcctttgacaaggtgaagattcaaaattcgagttaagttgctcccaaaaattcagacaaaagagtgattcgtttgaatttattcaatggctaaactattgaattagaaccgatctatctatctatctatacctatgcctatggtaattgtgactttctacgaggcctcacattaactagaaaaatctaatcattgattagattaatgataaaaacacaaccacatattttacaattttaaagaaacttttgtcttattatgaaaatcttgtagattctcattcatgccatgctagaggatggcaaatgcttggtgttggaggaagttcttaggatggcaaatgtattataaaatacattttcaccaaatttcaagctcaaactcaactttatttaagagtaaaaaaaagacaaatttaggtgaatagtaacataacactattcacacgaaatttgtctttttttttctctttaccgaagttgagtttagagctgatatttagtgagaatgtatttcatatctatacctatctattgtaattgtttcatgaattttcaaaatttttaggtacgattttcttgagtttccaacactcaactcgttttcaccggatatgtcctcagggaggcggagaagggcgaagggagtagatggcaatggataaatgattgtgacaattatacagaggcctgaatgtactttcattatctaaaataaatagatgcctgcaaaaatggaagttatctaatggataacatctatggacaagaagctgttagatttagcctattgtagttggtaataatagacaaatggataactgaaagttaatggaatactgtgaattaattgtgtgccaattttagttcagtctctttgttccatataagcatagcaacagaagcatatttttttcattctcaatagaaacatggcttaattctctgcagcaattcacatattgtcgaaacaagatttcggcaatattaaaagggggtggctatcaagctggaaaagtagatgagtttggagacaaggaatttcatataggttcaggccttcttattcaagaagtaatacgctactcctgtccggggattgatccgccgagtctgttattgatcgtatgatctgggagaaaaatcatgtcccaaagggacccggacccctccttatataaaggaaggggtccgtattacaaaatacagtccatatccctaacggaatatgagattacagataaaatacaatcgtaaccgactatgatcctgggtattttctcgacatacaagtttagaaaccaacccgagtcctcatacagatattctatctaaatttggtaccctgtacccagctagattataactgccgtgtagatatggggtatccataatctccacagtagcccccgagacctttgcagtcgacgaaatagccttctcagaacaaaaaacaataatccgagtgcttcaattcctcctgctttagcctgtcgagtactaaaatcaaagactgtaaagggcgaaaataaaacatggcgcatcgagcaaatgtacctaattaggtgtagcccccgactatgtggttagttaaaaactaaacatatagtcaagaaccaaatggttttacaaccaaacatcatatagcaaagcacgcgtggtatccagtaagacacccagccgactacttcttagctttaatatatcaaggaaaaatatgaaaaggcccgagtgataaacactcaaaaggtccacaaatagacatatttggcaggaatccgagtaaaagctctgaagacaatccaccaaatatgataaaaatcatggtaatcaacgagtctaatagcctaggctataactcctacaattaccaaaataagcttataacatgataaagagaatgactactaataaaccagtcatctcaaattaacccaaacagcttttgcaacctaaaaaagcttacaaaaatagtataacacttttctgttgggtaccttttatctgcatcgtagtaattccaaagaattatctaaccgcattaaaaaggattttagcagcatcgggtcacatcattgtgagcacaaattgacaaagcaaaaagcgcctaagtccctagggatcacaacgggccacgctggtaataatattgggctaaagtaccgtacaggcccaggcctgttagcactcccgataccctaacaaaacactgaagtccaagtgacacttcatcttccccgctgagactctcgccatttccccactccttgctacagttctaaaccgcaccgacgaagctagggttcatcaatccgctccaatccatcctcaaaaattccacgaaatttctccgcgcgtccaacgcaccgatttcccatcaccttccaaccatatctcggactaaattaaaccatctagttcacattcatggcggaattgagagaaagcttcgagagtcagtgggcgccctccgatgtaatggaagaaaatctgaaaaaaatggtggcgcacggcgttcttccggcgaaggaaatcatcgggtggcgaccagcgttcggcgaagcgttcccgacccccgatacacacgagatcgtggtattttctcacttcttctatggcggattttctcttccaacctcaagattcttctgaggaattctgaacttctacgggattagcttgcatcatttgaatccaaactccatagttcacattgccaattttattcatgcttgcgaagcttttctgggcattaagcctcattttgccttgttccgccgcatctttttcctcaagccccaaccgaacaagaacaaaccatgtgtcgttgggggggctggtttccaactcaggggaaccttgagccaaaaatatttctccatgccctttaaaacctcaaacaaaggctggcatgcaaactggttttatgttcaaaatcctgagcccacactccccgagtactgctgcctccctccagtttatcaggacacatggaactcactgcctatggggaatgaagcttctcaggcagtagaactgatggaccgcatgataaagctgaaagaacaaggtctgcaaggagaacagatcacccgacatttcattaagagccggctggccccaatcaaagaaagatctcgcacgacctttgaattcgacggcaaacatgaccccaaccgtgaagatcctgaatctcttgatttcaaggtcatgaaggagagaatgtacaaaattttctcgaatgcaattgtagtcagctattcgcacttgctgctagtggtgccgtacaacgccttcaaccctcctccaccggtaagtatcgatcatctcaacctttctataaagcatgcctttatcttctaccaaactgacggaaaacttgaaatataggaatttgctttgatgaaatctgagcccccaattgctcaacaccgctcacctcatgggaaaactagccaagttagtggagggccgaaaatttggtctgttgatcaatcggacatttcaaaacctaccagccagtcggacttccgcaagaggaaactagccttgagtgatgatgaaggcgatgacgctaaaaaaactggtggcgaggaaacagctggaaaacaaccacggcaggctaatccaaagaaaaaaacatccagtcgtcccatgccgaaaatcagaaagtcttccaggtacaaatcatttgacagtcttccttgtattgaagctcattcattaaaatcatactgacaatataattcaaacttgtaggaaaccatccgacatagatccttctaaaaaagaccccaagccgactggcatggagagaagttcttcaaaagagaccaggtcgactgcaggggatcgcccgagtgacgaacagccggtgaccgacaatgtagatcccagcaacgagcccccgattgggagccagtgggccgaagctgggatcggtgctaatcaggagcccccgactggaaaccagtcggatatggagcaaaacaaggacatccctgaagtagaagctcgagctgacaaccctcctaaaaaagatgccaacgtcgacccagggtccagctctcctgctaaagtacaagggcctgctcgtccccgaccggaaataatcataggtaaatacatccttcgaactcaatctgatcaacaaacttttcttcaattgcttcatctttatttataaatgcctaaggcccaatggtcggcgatgaagaagaaatcctgaggatccagtcagccgaggattcacacccacccactttaatcaagtggtgggacgatgataagcaacctcagggaatcataataaacaggcaaaaagaagatgaggaagtgtgcttgctgaaaaaggcactcagccaagccactcgcattgtaaacgtaagtttccctatgctcagctccaactatcctgttttccattttacttaaatgccaataaatttgtattgcagagaatccatctcaggaacgaggcgaagaccgtaactcttgaaaagttagttcctcatctcggaactctcgaggcgaccagaaaccagctgcacgaagttaaggagctcgccaggaaaactgagcatgatctaagagattgagttgctgagctccaagagtccaacttcgaactaatcggttcatcaaaaggtaaacacaatctctgcctggcctacttgtgctaccatccttgtcatatcgattaatcaaaaaacaatacagtaaaagctgccaggatttctgaattagagaagcgggtccagactctggagaaggacaaagccgaattggcaaagcagagagactcggctctgaaagatgttgaaggtactgatgactaatacctcctatcttcgtgaccacttgttgatgtgaatatatctgtgcagaccgcaaagtcaagtcctaagtccaatttgacgtcctggttaacaaaatcaagaggcttgagggagttagagatgaggttgccaacaccgctgcaccactcgtccaagccatgttctataataacaatggtccgagttcattcgatgctactgaaattttcgacaagctgagaattgctccaaatacttattttaagaatatcaaagaggctggaagtatgggagcaagcctagcgttggcgatgaccaagtccttgtacccgaagattgatattgacgccgttgacggctttgcggacaggacaagcgaagaagctgctctcgacctcatcaatgacgcgcagaaagccgccgacaagatagctggtgacatagttaggagattccaggacaacgacctccggccggctggatctaacaattctgatgatgaaaaaactgatactgattgatgttgtattgtaatagtgattctgataaaaatgatgatgatggaggtacaatttgtacaatactgatgaatttatgctgtgcatgatatttcaaacttagctcctgatttcttaaaagtttttgtcaaactttgttgagcctaaaacccgcaaaagttgttaaaaaactttcagtcctcattgactaaaccaaaaaatcaaacagaacaatgataaatcaagtaagcaaattgaattgataaaaatcacactccattattatagtagtcaagaaaaggcttggtgttagcagtcaaagaggaaaatacagaagtaatgcctatgcataaaaacgacgaagatgttcaatattccaagagttgtcgatatgggtaccatcctcacgtttgagtcgataagaacctggccgagtgacttcagatatgataaacggtccttctcacaaaggagataacttgtgccgatcccgtgtagtctgaatttttctcagaaccagatcgccgactaaaaaagctcgtgagcgaacattgcgattgtgataacggcgcaacccttgcaaataccgagccgactgaattaaagctgcttcacggcctttgtcacaccccaaaaattcaaaatatatataaattgttgtttaaatggaatttttagaaataatttttttaaaagcctagaagagaagatctgtttttaataaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcctcttttggctttgggccgaaagccggcccaaaaccctctctctctctttccctcggcccagttcggcccagtccgcagccgcccgcgcgcgcgcgcgttcggtcgctgacaggtgggtcccacctgtcaggcccgtcgtcttcctcgggctgaaaccctagtttcgcgccgccgccgccgctttccaatccggccgcccccttccgtttccggccgaattgatagaggggaaacaatctccgggatctcctctaccttttctcctttggaatcatcggctaaatcggtttggaaatcgagggattcgagttcgtctcggattcgtttttcccgaaccttccttcctcgtcgccggccgccgtgggccttcgccttcgcctccgagcccctttaaaagcctccccggtgtctcctctacccgccgccaccctcgccttcgcctctcgtcgtcggaatcgctttagcgccgtgagccctagcttcgccgtcgccgccgccgctccagccgtgctccgccgtcgctccagccgtcgccgtcgctcgggaaggacgtcatcgtggtcgccgttgcgtcgccgtcctcgtctgcctcttcgccgtcgccggagatcatcggagcaacatcgccgtcgtcgacccgaagagcttcgccgtttcctcctcgtcgccgtcgccgtccgttgatcttccgccgccgttttggtcaccggtgagttcgccgcgtcgtcctctacgtgctggtgccctccgtttgtgccgtagtgccgccgttcgccggcgagcgtgcgccgcccgagccgtttgccccgccgagccgccgccgccgtcggtgacgtcattgccgacgtcatcggggtcgtccgccgtgagccgccgtggacccgatcgatctcggccgtccgatttggattggttcgatctcggccgtctgttcgcgtgaaccgccgcccgtgcgcccggtccaccgaaaccctagcccgctgacgcaataaatccccttttccttttcaaaaataattcaatattacgtcataattcaatttaaaccgatttaagtgttttaatctgatttaatctttaaaaattcataactaattcatcttagctccgttttagttggttcaagtctctaattttttctaaaattgagatctacatgttaaaaatatccacatgtactgttcatgcttgtttatgtgctgttttggtgattttgttcttttctgcttagattccgtcgtttccggagagtccgttttcgccgaagaagagtttgaagagttccaaggccagcaaggcaagtcacacagatcccaaacaaccctttgagcatgttgatcctatttaaagctattatttcttttcaactattgcatttattttcgaatgtcattgggtggaattaacctattgtttgttatagcccttttgttcttgtttaccttattccttgataccttgggttattataacttgactagttgagctttatatattggttcaactagatattagaaataattgcttagccctgcttagaaacattagcacacttatgggataactaatgactcactgttatttaatgatggcttaatgatagttcacgatggttaatcgtgaatagttaattaattaatgtgccaactaaaacctggtaatggtgggttgtgagcacatggttttgctggtcgtgctcatgacaattaaggaccggttcacgagtttcggttgtgaaacattaatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttgtataaggggtattgtcacaactcctttccgaggtaccgtggtggtattgaggcacatggtgacatgatgtggagttgtgtcttgtgggtacagtggtacacctctgatcagagtaaaactattcgaatagccgtgcccgcggttatgggcaggtctaacaatgtctttcgtgattagtctcacccttctcatcataataaaagatgctttaactggtaataatttgattagctcctggtttggaatggtacatttttggtttggagatagaactgtgcagccgggatggttgttcagaatggttgggcctatgcaacagggtatgttgtatagcgttggattaatattatttaattacttaactgttttattaaattctcaaatgtttgctaaatgctgcttctgcaaatgaaaccctattatgccatcctttgttatcctgtgcacttgcatatttgctgcgtggcttgctaagtatgtcatatactcaccttgcaatcattcatcagaggaagagttctacaatgaggctgatggcgtggaggattaggtgtagccttggtcaagctgcctgtggagtggagccgtctgcgccgtttattttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagccttcttccagtcggttcatatcatctactcggtcctcttcatagcgctcctcgttgaagttccgaaatcgtagcgattcaaattccacttcactcggcaacattgcttctgctccataaactaggaaaaaaggcgactggccagtagctcaactaggggtggtgcgcaaggaccgaagtacggacagcagctgttctacccacttgctggcgtaaggacgcagccggtcgaaaactcgcggttttattccttgaagtaccatgccattagcacattcaacctatccattgctcatgggatgcgctacagaggcataacaaactttgatgccgaagtcctcacaaaaatctttgaatactccgcccgtaaattgggtgccgttctcagtgatgatccgattgggtaccccgaaccggtgtacaatgttaatgaagaaatctctagctttgtctgccgtaattttaatgaccggtttagcttcgatccacttggaaaatttgtcgacagccacaaagagatgagtataaccgccgactgcctttttgaacgggccaaccatatcaagcccccaaactgcaaacagccaagacaatgggatggtttgcaactcctaggctggtaaatgagtttgtcaggcgaaaaattgacaaccctcgcatgttcgcacaattttgtcggcgtcggatacagctgtagaccagaaaaaaccctgccgataagccttgccaacgatggttcgcgcggcagcgtgattgccacaaatgcctgaatgtatatcctttaacaattgtcttccttcttccaaagacacgcagcgttgcaggattcctgatggacttttcttgtataactcggtttcatgtatgacataaagtctgctgcaccaggagatccgctcggcttcgtctttatccgaagggagttcttgcatggtcaaaaatcttatgaggggctctctccagtcggcttcaatcatgcttacatcttgggtgtccgtagcctcgattatttctttccttcgtacagtcggctcataaagatgttcgacgaatacgtcagaaggagctgcttctcggtttgaaccgaaattagccaatctgtcagctgcttcgttgttgtgttgaagaacatgggtgagctcaagtccatcgaatttgtcttccaacttgcgtacttcctgccgataagcagccatattatcatcaaggcagggccattccttcatgacttgattgacaaccaactgagagtctccacgtacgatcaaacgccgaatgcccaaagagatcgcaatacttaatccatgaagaagcacctcatactctgccacgttatgggatgcagaaaaatgtatccacaatacatagctgaatctttctccaatcggggagattaagacgacccccgctccactgcctgaaagcctcttcaacccgtcaaaatgcatagtccaatactccaccttctcctcgggtatgtcttcttggcactcggtccactcggcgacaaagtcggctaaagcttgggatttgatcgaagttcgtggcttgaaggatatatccagggacatcaattctaaggcccactttgcaattcgtccatttgcttcgcgattatgaagtatatccccaagtgggaatgatgtgaccaccgtgaccgagtgaccttggaagtagtgagataatttcctaacggtaattaaggcaccatataatagcttttgaacttgaggatatcttgcattggagtcggccaaaacctcactaacgaagtagattggtcgttggactttttgaacatggccttcttcttcacgctctacaaccaggactgtgctcacaacttgggaagtcgccgacacgtataacaacagcggctcttgcggatgtggtgaggccaaaactggtggagtagtgagaagtttcttgaaatcttcaaaggctttttttgcttcgggtccccactggaaattgtcggcttttttcaacagcttaaaaaagggcatcccccgctctccgagtcgtgaaacgaaccggctgagcgccgccatgcaaccagtcagcttttggacatctttctgggagctcggcggtttcatgttgagaatgtcgttgattttctctgggttggcctgtatgcctctatgagacaccatgaatccaagcagcttccctgacggtactccgaagatgcacttttcagggtttagtttcatcttgaaagcgcggatgctagcaaaggtttcttctaaatccgcaatcagatcatccttctgcttggtcttgacgactacatcatcaacgtaagcttcaacattgaggccgatctgagttgaaaaacatctctgaatcatgcgttgataggtggctcccgcgtttttcaatccaaagggcatggtgatgtagcagtaggccccaaaaggcgtaataaatggggtcttcaagcaattggattcttttagtcgaaaaaactgagtagcaatccaaaaaactgagtagctcgcagccggccgttgagtcaactacctggtcaatgcgaggtaacccaaaaggatctttgggacaagacttgttgaggtcggtataatcgacacacatgcgccattgccccgtctttttccgaaccaggactaggttagccagccagtcgggatgaaggacttctttaatgaagcccgctgctaacagcttggtcaattcctccttgatcgcatccttcctatcctgtgcaaaacggcggagtcgttgcttgatgggtttaacgtcttccttaacgtgtaaagagtgctcattcacctctctaggaataccaggcatatcagatggtttccacgcaaagatacctttattattttgaagaaaggtgatgagcgcgctttcctatttacaatctaactcagcgcctattacagcagtcttagttggatcagagggatctaaaggaatctttttggtcttggcatcgctttctccgctcttgggcatcttggttgcgggcacttctccttcgcctgctgtggacgcggccagtcggatttcttctcgggagagcgcgatctcatgggtctgggatatgacacgtgacggcttgtttgatgtcactccgaagggatatgactcctcgaggacccggcatcttcatcatcatgtaggtatagtgcggaacggccatgaacttggctagcgctggtcgaccaagtatggcatgatacgccgtctcgaaatcagcaacctcaaaacaaatgttttccgtgcggtagttctcccgagtgccaaaagtaaccggaagagtgatctggccgagtagtgtagcagatagttcttcacgagggatctgcatgtcgtccaaggtcttggcaaaaaggatgttgactgcgctgccaccatcgatgagggatctgcggagcttgacgttgcgaatcactgggtctagtaccagggggttccgccccgggtggaccactcggtcgggatgatccgagcggtcaaacttgattgtcgtttctgaccaccgaagatattggggcgtgttgggctggacagcattgatctctcgttcagtcaacttttgttttctcttggattcatatgccaggggtccgccaaagatgtggttgagttccttgcaatagtcctgaaaaccagtcgaggcatcatcttcgtcatccttcttctttgacgtactttgatctccgtcaatacttttgtgtgtattctcggcatactgctctgcaaattgtttgtagacgaagcaatctttggctacgtgattagaatttggatggtgcggacattgggagttcatgatcttatcgaaggtgttgatgcgcgaacgttgtcgggaggatggtgcagtagttgccacgagttcctcgggcttacgcttgcggtccttgtgactggtacttccactccctccagtagtcggcgtatctttcttcggcttccaggtggtgcccgactgcttggacgcagaaatagcatcttcggctttggcatactcaatagctttttcaaacatctgcttgactgtcctcggaggcttatgcccgaacttgccgactaggtcttcgtggcgaatgcccttggtgaaggcggcgatgatgacgtcatcggtgatgtcggagatcttattgcgctgttcagagaaacgtcggatgtaatctcacagggattctctagacttctggacaacgttgtagagatcaaactgggtactagggcattcgaaggtgccctggaaattggcgatgaagtgttcgcgaagttccgcccaagatccaattgtgccacgcggtaacccgtggagccaggaccgggcggaatctgctagggccacaggcagataattcgccatggctttgctatctcctcctgctgcacggattgcgagcccgtagacggtgagccaagactccaggttagtggtgccgtcatacttctcgattccagtcggtttgaagccggctggccaatccactcaacgcaggtcggctgtgaaggcagcaactccatccgcatcatcgtcgtagcggtctggtgaacggtagggagcatagcctcttgccgcacggcgctggttgatagttttgcgaagatcgatggggtgcctgtgaggtcgttcgactcggcgctacctgtgtcgttcgggaggtgagtggacggatcgctcatcgtgacccctgtccctacgactggatcctgcaccggcgatgctgaggcttggttggtgataatcttgagatcgaagagcgggaactcagctaccagtcggcgtgcgagtgcttgtggagttagccgggactgaggcggcgatcatggtcttcgtctgattcaagatgttgacgacgtgatcagcctgattgagcgcatcttcctagaggagggtgtcgaggagggtgattgctacaaccgcgttttgctggggcgtgcggaaaaccgctgtcccatcgacgtcttgctgtccgatgagatcacgtgctcgtcgcccagattccaaggcgcgctgtcgtcgatcctcagcctcctttgcagcccgttcacgatcttgttgttcacgctgtagtcattcttgctcttgtcgttgttgttcttcctccagtcggcgacgttcagcttcttgtcgggtgcgctcttcttctgcttctcgggctcggcgctattctgccgtctcattgtcagccatgaatacgccaaagaaaaggggtgtgtagtcgtcctcgtagctgtcgtcaaagtcgtcgaagtcaccgtagtcgtagtgatagccaaagtcgtcgtactcgaggatctccgttggtcgggaactgacaccgggggagctgaggtagccatccaattcttccgtcaagactgtcccgaggggttggagtatgacgccgacctccctagagctagattggatctgtgccgaagccggaccccgtctaggtcttcgggttggagacgccttggtcgtgaagacagcagctagatcatcggggagtctcatcaggattgggggataggacccatcatcttgatctggtcgtgttgaagtagattggatctcgtccgagtggtttggagccaacttgggagagatgatcttggggtagacctcggctgagttcgggataccgaacggagcggagatccgacctcttcccgactggtttgaatccgagtcgaggagagaaatcttgccaaagtcgttggtgatgaagtcgaggctgccgaatcggaacacctgcccgggagggaagacgaagtcgtcgatgccggagacagaacccatcgtactagtcggcgaagaacttgacgctacccctacctggtgcaccaactgtcgaaacaagatttcggcaatactaaaagggggtggctatcaagctggaatagtagatgagtttggagacaaggaattttatataggttcaggccttcttattcaagaagtaataccctactcctgtccggggattgatccgctgagtctgttattgaacgtatgatctgggagaaaaatcatgtcccaaagggacccggacccctccttatataaaggaaggggtccgtattacaaaatacagtccatatccctaacggaatatgagattacagataaaatacaatcgtaaccgactaggatcctgggtatttcctcgacatacaagtttagaaaccaacccgagtcctcatacagatattctatctaaatttggtaccctgtacccagctagattatacctgccgtgtagatatggggtatccataatctccacacatatatatctcctcacatggcgctacttcacaaggctgataggattctgtgttctttgcagccgttgtagtcatagcgatggtcatgtcatcttctcgtgcatatgatagtatgatattgtatgcccacctttatttctattttacaatatttactttttacgaaatttaaaataccatatcagttttattgtgttaaacttgttcaagactgttttgtttttgcgcgaagaaaatgccacatatatagtataacaaaccgcagctctaaggcggcaaaaggccaaaagctaaccacattttggttatgctattccctcgcaacaacctcgtttattagctaggctctattgatgtttaaggctctgttcaaatagaaggattgcctgatcttatcaaataggcatgcaaaacaagatgagtgattagtgtattggtaattaagtatactactataaacttggagaacgggtttatttgattttttttagagaaacttcaatactgtaaatgctggtaaaaagacacaccgtttagcatgtagtttcaaggaaatgtgcccactgtaaacgaagaagttgctctccctaaaggcagaaccgatcgtaacctcaatcttacacaaagtttgatggaggcggatttgagaggcaaatgaaaagtaatatgaaggcagtatatatatgcagctggtcttatacaaattactcgcacaatttcatatttaatttctctcgtatttatacaagcatataaacattttgtttcatttggatatgcgtacaaatacagactagatctgaccttacactgcattctggaatcatgcgtgcagcaaattgctatccgttgaaaccatgcacgctttcgaaatgcgaagagttctgcaagagcatcaatttcaagagcatcgctgccgacatgcaacattactataccaggcccggactatgacacatgctgctgctatacattgcacgacagcaaccatgcacgccaattgatgctgtccagttgaccttggtttttacttgctataattcacagtgacaagacgtgatctactcaagaaacagcctataatgcacgccaattcacagtagcatcctaatactgtcagggaacccaaggatcgtgaggatcccggacgaacacctcacactcacacactgtagcgatccggcaaagacgcaaaacagaggaataagaggatttttgtgcagcgtaaccaactgctgcttttctgatcttgctccatatatagaaacggaaattgcaactgaaaaaacaacaaccaacaccgcttctcacgccggcaatttgctgcgtccatccccgtccttgcctccgtgcagctgctgccggcttccctcgtcgcctcctcgccggccccggtcgtcatcgtcgtcgtcctctcgtcgttcccggtcgtcgtggcgctcgtccctccgttgagccgttctcgtccatcgtccgcgtccgtcaagcgagccgcggcagccccgtcatcatcttcgtcctcggctccgcgtcgtcaagcgttgcgccggccgcgtctcgccttcgtccaaggatcgccgccgaagtcgtctcctcgccgttcgtccgtcgttctcggccgcctctgccgcgcccgttcgtcattgtcgttcccacgcctcgtcgcgtggtggtaaggatccgtcctctcgctgccccatcctcgtcctttcggtgtcgccccgtacccgttgtgcggttgtcgaccccggtacccgtgtaccggtgtcggtagtcgttcgcttgtgcgtgtggtgaccatgttagtgtgcccgctcggtagccacgtggtttccacgtgtgcagcccgtgtggtgtctagtggagtccgtttgtcggccactcgcctcggttgacacacgggatctgtttctgtcgacccgtggaccgtctctgtgtacccggtccaccgtggtcccttaggttgacatgtggagttcgcatgtcaacagtgcagccttcctgtcttttccaggctagcgcttacacatgttttatagttgcaaagcttaattataataatccgcaaatcttcatataacagcattaaacttcggatgatcatatcttgatcatacgaaccccgaatcgacccgttcaagtctcctaatgtttgttaaaacctaaagaaccgtgtgctttctttttatgtattgttattgcttctttataggcttgtagctttgcttgtgtgcttcgcgtagcttctgtcgttccggaggttcccaaagcgtggttcgcggtcgtcgccgaaggttcggaaggccgttctctctgagcaaggcaagtcacatcatctttgaacatattggatcccagtttgtgaaattattttgatttaaattaatgcattatcgctttatttaaattcccgcattatcactgttttatttagccatgcctatttacctttgttatgaccttattattattgctattgttattattaccttgttcaccctagaataaacaaaaccccaactagtgggtactctatttatggttccactagtatgaatttaggtagatgcttcgctgattaattatgcaacattaggtggttttataactttagactttgggaattctcatatcattaggacagtatggaatggctggcttatgttggaattggacacacacctccccctcttttcaaaacccctaaaacggttttaggctgggcacaaggtgcgtggttgggttttgttagtcgtacctcgggtactataaggattaagctcgggcctctcttgcaaagcactaccgtacttccacatgtctagtgggtaaggcttagtttgtggctcagtctggttataaacaaaggtacacggatggagatggacgaagtcaggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggacggtactcttgtatatggctaggatgggttggaaactatgtcatgtcttccgtccgtatgccgtggtggtatgtggcacgtggttacacgtgaggaagacgtgtcttgtgggtaaagatgtacacctctgatcagagtataatctattcgaatagccgcgccctcggttatgggcaagcctagcaatgtacccaagttagtgttttaaattcttaaaacctgcttaacaactaaaatgtggaatggttggcctgggttggcttgggactagctgggacccagggtcgggttgccagttcggtctgaatcatcgtaggccttgggttaaggcaggttcgtgtgggttcacggccttgattaataatactgtatagcactaggatcatctttataaaatggctttgggcaactaagtgacttttaaatgctgtttactgcaaaacttaacccctatattattatccccttgtactcccttgcattaattatgcatctccggtgtgacttgctgagtactgtggttgtactcattcttgctcaatctttcccccttcagtaagagaagctttggagaagatgtcttaggtggagtcctggcttataccccagttgagcgcttgtgaagatggagccgtaggcccgctagtccgctgctgtttatttttgtttgtcaagcctgaagtgcctctgtaataatgtaaatattatcgatataataaagatgtgcgttttgtatcatgtttatttggtgtaccccggcttttccttggacagggattaatacactagcgtttgggaaaaggcaattttctcggtcgcgaaattagggcacattattgtgattgaaggagtggcaactgatccagccaaaattcaggcagtccagcaatggtcaccaccaaagactcagaggcaactacgaggatttctgggacttgctgggtactacagaaagttcatacaacactatggcatattggcaaaacctcgtactgaattattgaagaaagatgtgccatacaagtggactaaagttgaacaacaggcttttgacatgatcaaacagaaattggttcaagctccagttctggcattaccagacttttctaaagaatttgtggttgagacagatgctagtggtgtaggcattggggcagtcctgatgcaaggtgggcatccactagctttcattagtaaggctctcagtcccagatctcaagctatgtcaacttatgaaaaagaatgtatggttgttttgttggcagtagataagtggaggcagtatttgcaacatgcgccctttgtcattcacactgatcacaagagtttgatccatctgaatgagcaacggctgacaccaagtattcaacacaaagcttttatcaaattgatgggtttacaatacaagatcagatacaagaaaggggaagacgatagggttgctgatgatctgtcttggaaagatgagcagcaagaaatctatgcaatttcaacaagtcagcctaaatggttggagatggttgtggaaagttatcacaaagatccagccactatgcagctgatgcagaaactagctcttcagcctgagggcatggatgattttgctttggtggatggggtgattaggtttaagggaaaattttggctaggcaactatcatgaggccaaacaggcagtattgttatcattgcacagtagtgggattggaggtcactctggcatacaggctacctacaaaaggatcaagcacctgttcatgtggccaaaaatgaagaaatatgtcattgagtatgtgcaaacctgatcaatctgccagcaggctaaaactgaacattgcaagacaccaggtacacttcaaccactacctgttcccttgcaggcttgccacacagttagcatggactttgtggaaggcttgcccaaatctggaggatatgatactatacttgttgtggtagataaattcaccaagtttgccaagtttatccctttgactcacccatttacagctctcacagtagcaaaagctttcattcaccatatttacgatgtgtttggaatgcctcaagttataatttcagatagagatagagtgttcaccggtgcactttggcaggagctattttggttggccgatgtgaagctgaacatgagttcatcctatcacccccaaacagatgggcaaacagagagacttaaccagtgtttggagtcatatctgaggtgtacaattcatgcttgtcccacaaaatgggcagactggttagtccaggctcagcattggtataatacatcttccacagtgctttgggcaaatctccatatgaagtaatgtttgccaagcaaccaaatcagtttggtctagtgaatcttggagaaagcacagtacctggtatccaagtttggcttcaaaacagagtccatctcaatgacatcctccaacagcaacttctaagagcacagcaacgaatgaaagcacaagcagataaacatcgctcagagcgtcagtttgaagttggtgatatggtctttttgaaacttcagccctatgttcagatgtcagtagctcgacactcttgtcagaaactctgttttcgatattttggaccatacaaggtgctggctcgagttggtgcagtggcatatagattggaattacccacgggcagtgcagttcatcctgttgtgcatgtgtcgttgctgaagaaggtgctgaaacccaacatacctgtaagtaatgatttacccttaaattgctttgataatcctgatactgtccaacctgaagcagttctacggagacaattgattaaacgtggcaagttagctgttccatatggtttggtgcaattgtcggggcttcctgcttctctggcgacttgggaaaatcttcgtcaacttcaagcacgttttccgtcatcaccagcttggggacaagctgatacttaaggaggggagaaatgtcgtgatccttaagtctattagatacttcgtcggtgattctttgaattgggttgtattctgtgatgggccgtagatgggccggttgcgtgtatgtgtatcgatatgccgtgctggttcggcggtggcatcggacacatgtgcgttgtgcggccatttatatggcgagctgagctgtaaagcatttatcaaataagaaaaactcaaaccaacaacctctcatcgtatacctctgttctgctctactcctcctctcgttcctcaatcgcgaacctgattccccttcaatctccgagcgtttcgccggaatccgagagttcgtgacactgctgtagtgctgcaccaccctccccaatgaccgggtgaccggcttctcttctctatacacagcgcgcaatctgacctgtacatccatcctctcagtctcaatggggtaatccaggtgaggtggcgacgaggccccagctcttgcccctttgccgcccgctgccggatttgagcagattaggcacttacttcctttctcccgaatgatagattcagcacaagcgccaatctatcattcgccggccaatgctaatcgggttatcagatttattggaacttaattgtactactacctccgtttcaagttataaaactttcagattcattaacatatatatgaatgtgagcaatgctagaaagtcttataacctgaaacggaggaagtaatttataatgcatttgtagcacctattctcaagttaagcagatagggtgcactagtgccatagtagttccttcctgttcccacaatgccacagaacaattgatggtttatttggaaatcccatggcatttctaaacaactgatggttgcagaagtgagcactactttgtgctaatgggattaaaaacttattaatagttaataataggcttagtcagtatacaccctagttgacatctaaccactgctattctattccattttgaaaagacaacaaccgtggtgtctgctcccgtgactgccaggctgacttgtgggcccacattgtcggtgagagggggagcgtctccggccgcgcacgtgtggggcagagaggtggtgggatacacgcggtctgcaaggatggaggagggtgcgccggatctgcccctcccgtcgccgacgccggaggatcctcacggttgtatgctgtcgtcgtcgcccgagctcactgccgccctcgtcgacgagccgctgccgccgctctcgcctcgcccactgctcgagcctgtcgcaccgtcgcgaggagtggtagagggagaacgaggagacaggggaggagcaggagagcgatggtgagctcctggtcgccgagcgggcgccggatctgccccacccatggccatcactgatggatccatgcgcatggggggcggacaggcggcgggatccgtcgatgagaggggggacagagaagggcaggagcaccagccactcgaactgctcaaagacggcgcgcctgattggtcagagttgtgtctttgatattatttttctttattcttcctccgattatgtgaacttctcgtataaattatattttaccaagtacaagtaaaaatagattattcttaaataaatatgcatgcaagcattgctagttttctcttattttcggatatactgacggtcgaaattggtctgtaacgaccgtcaacaataagctaaggttataatccaccctagtattgttgtgctcaagccccaagaggccctttagttctaaagcagagaacataatccgcagtcagctagttctgccgtagatcgtcttggttttctatgtttattgactgtggcattctcttcttctggcacgattagctagattgtattactatcatgaggaatgtgatagtgccatctgagaatgagaaagcttgaacaaggttaagcgggttgtttaatcaataggacgccatgagcaaggcaagtcagtatatgcttccctccttgagcatgtgtatccctttttaataaatgtgttgattgcaaataaaattgcatgttacttacaaaatgtgtacccaaaacttgattataagccaccttgaaagtgttaaccaaactccttgttgcgttcgtcttatattatgcattggtcaattaatgatatggcttagcaatgatagtttagactttcgtatactccatgcttgaaatatggatgtgaacacaatgattactctcggatgggtgattatcggaaagtggattgcgtgggtgattatcagaaagcggatggagacatgggcaccaaccgatgtttcaaaacctttgggaaaccaaacacttaatcaaatgatttgttttctactagggtggcacagatggaatttggatggctctacgaaatggctagtcaccgaccttggtcagtcaaggactgacttctaagctatgcagtaaacaaatagagtacaattgtatttcttgaatgggtatagacccagtggattcagtaatccgagtggggcgacatcccatacatggttggttctgtactcaaattgttgtgacgttgcatccaagtgtcgtagtgatatcaatgtcaaacctaaaatgcaccatagttatatataaaactaggtgaaaccccgcacgttgttgcgggagcttggtatgataataataaattgaaataatgtgtaagatagctagacgacagaaacttgcataatttgatgtggtttatcataatttaaatagtatatagaatgatgatccaaatgtaaaattaacgtgatgtgactttatgagagaagaaaatgagggagatcattccaatgatagattaatcatttgagagctagaaacaattgagatgatatagcttaatgagataagagagaaataacattaactaattaagtgaggatgaattgtgtaggtatatagatattatacaaaatgatggagagatatattgaaatattttgataattacatggaatgatgatttaatatgcttggattttaaaagctctaaaatttaagtgaggatgaactatatatgcatataggatattataagaagtgatggaaagatatattgaaatattatgtgaattatgtaggatgataatttaattaacatgcttgtattttaaagctctaaaacttaataaattagcatgcttgcatgaggtttgagatgtaataattgttagtggatgtgatagctttgcatgttaagtttagtgggccttaactttatagaaagataggatgtaaccatctggatgcccgggtttgaggtctcctctcaccgctagctcgagttagggatgggcacttggagtgcatgagggttatagtgtcatgcgttgggtgcattactgactgtgagtaaatcatacatccactatgtgaataaaacaaatctatcgaattgcggtgctcgcgattaaagaatctccgagacttgtaatactcctgaccagccttagatattttaaacttgtttacattaggatttggaagctatgtggcctatccactctttgcatgcgggaaggttggcattggtgatgatatatggtaagttggatacgagggtaaaacgaacctagagaagcttgggaaggtgaatggagctctcgttgatggttaacaacttgaacttaacgttgttttcagttaaaacaactaagtcatagatttatgaattaatttgcgaaaattagctttatgcaaaaaaaaaaaaactaagccatccttgaatcccagtatacactgatacatcttgtagtgttgtcttgatgagtacgtttgtactcactgttgctcgtttacatttttagcattggagcaggttagaagcgaagaccttgctagcatgctcgcttgcttagtgggatgatcggagtggtagttgatactaagtcatgatcccaatcaacggtttgtgagcatgttgcctgggtctagcattaatctggatttccattgttgtttatgtgataggatgtggcattattagccttattaaaggtattaaactcttttagtttaattttattttgttatatgtttcttactggttacacttgtttttaccacctaataattgagggattgatatagggaaacttaataggtttccagtttcctaaactgggggataacaaggcctagcatgaaaaaatccgccaatgggcaccattaggccgcatttagatccttgtcctcttaccaccacttgaaactccttgtttgcctcacgctaccaccataggggtgtcgtaggctctccggaccttccattacaattgagacatgaagtgaataattcaagtcatcaaacaagtataatgaaatatcaaacgtctcgagagaggaatatcggagacattgctgggcctttagtctgccagctaacttcagtctgagatgtgcccgtcaaactactcgaaggcggcgacaagatgtgttacacattcaggagacttgacaaaaatggctaaagatctacaacatctcatatgtttttaactcatactcatgtgaatctagctcctaagatatgcactagattcacactttcatcttaaggatggttacacatagcaaacacaataagatgagagcaattaaaatttacaactaatttagagatacataggccgatcggccaaataaatattagataacagcggaagcttgactacccaatcacaagcacaccgactaggggtttaccccattaagttctcattctagaagaagcaatcagaacccacatcactcaaagactaagtctaaacctgcaaacaaaaggttatatcaacagcaagaacccacatcactcaaagactaagtctaaacctgcaaacaaaaggttatatcaacagcaagagtcagtacattaaacaagttaatgtactggcaagcacaagtcaatcataacatactacatgtaaatgtaaggcatatattcaaaggaaggcaatatgtagttcaatttcaccataaagcaagttttattttcgcaaatcctttgtaaaggagttgatgcttcaattaacaaagataagtttttaagtttgtaacatttagttcatcataattccatcatagtcaatctcttgatgtcatccttgacaacaagtcataatatatcatcacacttacacaactcaacacattttatcaatttcaaaccaagtcacatgttcacatttttaaaacatagtctatactcatgacacttcaccaaagcgctcatgaccatgagaacggctaatcgattagtttaaagaactcctgcagagtttgtacgggtttacccacataatgtgatagaagcccggaggctacactctagttggttcagtgccggccaagcaccccacactctacattatgagtgcggactagaggtcacaatgaagcctttacactacttagaatctagccttgcaccagcacgatatgtgttcatcctaggcatacttggaaatatgtctagaaccgttaagtggcgggcccacgccttaaacttaaggccgtggtggcggacacgacaggaacccaccacgtggcacaataccgttgtattggacagacttagtcacctaaactaccacatcggggtaaataggaagttcctctgaatcatcgactaattccttagaattatcgactaactaatacacaccggccaaacagaatgcaaggctagtcctaaatagattaattagcttaggccatcccatactagcacatgtggatgtacgaataactttaagttggtgacacaagttcggtccttacggacttgagcaaacactcccccctatcggtatgcaactaacaccatatgcacaccacttgccgcccaagtctaaaatcacattttacacattttagtccacaaatacccatcacattcattttattccagaaaaggttcatgtgtcaaaatcatattttaatcataggtggaatgagcatttgcatatttctaagcatggttaagcaagtagttgcatatagagcatatataaacccatttgagcacaaaagagtgtactctaaccatttctaggggttcaagcagcaaggatcacaattattcaaggtaaggaatgcaacaaataggtaataactaccttatcccaattttaaataccgatatagtctaagttcatatgcatctttgcaaacaaatattttcatttatcaaatcatgggattcaatgtgttcaaaggatgtgaggagaaaacttgccttaatactaagaaatgttagcgcctaatccactccttcaccgattatgcaatgacctaaataaaggacacgctatgcaattaaacaccgaaataggtaaaaatccaaaatgctctaaaatgcatgatttgtacacagtgtgttggtactggtttaaaatgaatttaggtgaaagaatttctattttatcactttttatttgggagttatgaattttagaaattatgtcggtatataatagtataggtttaggcaatgctaccaagtatttttgcaaagtggtatttattagattagacttctcaggggtgtagagatgtgttttataatactaacacatttggtttcacaatttttagagttattatgaattctttatgcattttacaggttataacatgttataggtgtatagtgtcctacatgcacatgcctttggtatttgaggttcagaatttattctacttttgttgcgatgaatgaagcaaataattttgttaattaatctatccttagttcacaagtttagggcctttattattttagttcatattttataatatagaggggttctatatggatgactttataaatatcaacctaggaattatcatttgagctaagttcctctaagttttggtgaatggggatggaactatggcctcactggtctatcaagttttatttaggtttatttagagctaagtgcatatatacttatacatatctatgtattaccttaacaacactatgtgtttaaattcttatttcactaagttaagattttgagctatgttctctacaaaaggtgtcaagttttattttactatattgaagctcactattttctggttctatagaaactttcttcattccaattggactaaaaatgaattttctacaaattttacaaattaaaggctgctctatgttggttattccttacataaatatttagaggcttttattataaaaaaatatatatttttattttaccaattggaaatacatgttttggtgatcctacagaacttaagtttactcaaattaaagctaagttgaattttgtatgaatttataaagtttagcttatctaaaactagtcattttaaagataatagttttagaggcatttgatacaaagcaagtgattacttttatttcagctaaccagagagtgcatgatgatgaatttgtagaatttgagtttgtcccaaaacaagttaaattaaattttctatgcattttataagtttgtgtatgtgttacgtatgctttaccttagacaaatttttgagacaaagtttgaacagtgagtgtcaagttttatatttctaaattaaatttcataactttgtgaatctatagcgactggaatcatctcaaaatgagttatatttgattttatatgaattttcaactttgagtgtttttctgttgaaaatataatgttttaagtgtttttcttttatattctcagattttagaagggatgggtccacctgttagtgagagatcaatatgcaaaaaggcctctagggttccagagattagatcgtgaggtccctagaacgtgttttaaccaaatttattaggaatcctcgagttttacagtttttactaatagattcttggtcccacatgtcaatctaacatattttacattttaaaccttacatgttttaaaatatctaaacgagatccctagcgcctaatgacgtggggcccattcgtcagcgagtcagcgcctgggagagacagggcagacagagcagcggcggcttggcgagctcctcgcctgcgccggcgatgaacggcggccgatctcgtgatgtgaccaaaagagaagattttcctaagcttcttgcgcatctatccgtggttgtctcaaggttagaggtggtcggaatcaatggtgacggcggtgcgagcggcggtggttctcggggtggtggtgcatgtgtgcatggaggtcgtttagaagcgaatgcaaagcatgcatgaggtcttcaagactacagggtgctcaccgtgggtcaagctagggttgtcgaggtcttggcagcagcgtcgacttgcggaacggctcggcgacggcgctcctcctcaggtgaacggcgatggctcgaacggtacgacgagctgctaaaagtaggcatgcacgagggctgtgaggtcatagagatggtgtctgcgcgaggaatcgaacaatggctcaccggagcggcaggaatcgaagatcgacgttggcggccggagttggggaagaaatcggtgatctcagtgtacaggctcctggggtcgagccgatgacgatggcgcagcggcttgctccgggatggactagggtggtcgggcgacgatgatgccgaagcggcggcgttccgaagctcccgtgggcacggtcgcgttccggcgtcaccactgcatgtcaagaggagagattaggtggaatggatatggcattgataggaggtttcagatcgggaaaggagtcgagacgaccgcggcacgatggcgatggcgacggtcgtcgtctccacggccgccggcgagaatgaggatgacagagaggcagagggcctttctccctcggcttcttcggctctagagtgttgaatggtgaagggcgactgagttggcggagttgaaggtgaaactcggcgtcggcacgtcagctccacgcgtcgagcactccctccgccaacgatctctctctctctctcgtctgttcaatcggctggagcggtggagaagtggtttgacagagctagagctagctctagtggctgtcaggtggggcaaggacgaagtatactagtaggtggaagggagaggtgtgggtaaatacatgggtaaacttgattttggatgaattttcggaattattttctcctctaactttgtagcttcatagcttaatgtgtggatcagattaagtagtgttgattttactggaagtagatgtttatacttagttgccattttttttggttgcacttaaaaattatggatagattgatcacagaaattaaacaaagatcggttatctaagagctagattgaattttgaggaggcttaaacagaggaataaaattctagaaaaattatattgagatatgataaataatatagtatttatataaattatttacctcatatacttttatgcattttaattcacttttgggtgaagtatggttttagccaataaaggattttaattagtctactatgtgactgttttgattaatttatttgaggtatcaacttgagtgttaatatctgaccaaaattacagtgaatagtttgtgctaatcattgtctacataaattttcccatgattttatcttgtacaaaatattttagagaattaggatgaccttttctttgtatatgagttccctcttcataattgcatctaatattattataggaattactttaaacttctttcgaactgagaagatgatatttgagtaaatattatgtccacatattatcacccaagattaactataagtttatttagtaatttaacccttttaagttatgctcatgggacctattgtaaaatgcgagaccaaaatccaaatgcacaagggactcgagtcaaggcatgcattatgcacatgtatgctcatttgcttggtggaatttatggtctaatgttaggaatgaaaaggttttattttgttgtcaaattttatttatgcaatggtttagattggtctcacctaagttaaaacggaaatttttggctctcaaaattgtaaaagtttgcctatatctattttgtctagaaatttttaagtcctaaaatttcgggtatgttacaaggggggagctcatcggcggttatgaatgaggctaaagtatgagacagagagagatagagagagagagagggggggaatgagaacggatttgaggatggtagacgaggtgagacggtaacatgtggttgtggtgattgctatggccaccttatcttttccagcacacaggtgacaccgccatcttcaatgttggccaagaggcagcgtccgcatcatcgtcatcaccatcgcaatcctcattgatcttcataggtgagttcgggggggggggggggggggagg

SEQ ID NO: 61188 - DNA, 7721 bp, Oryza sativa
tggtgggggaggggggcgcaatggcgtgaggtcgaagtcatcgtggtgcgacagatgcacgcatgctcactgctgccacggtttcgtcgttgacctctagcttcactaggcccccatgctatcctagagtgctaccgcctcgtcaaggtttgcctccacctagatttgactccgcaatttgcttctctcttatggcagcgccaactcacagaggctggagccgcaagggaagctcgtggaggacgcttgatggtaagcggttgaacttgtacgtgtaggacctgggggcatggttgtgcaactggcggtgaggtgggctcatggccaatggaggggaaggccacacaagaggaggcgagagaagagagagtatagaggaaaagagagtgtagagtttctggtatgacagtaaattgaacttttgtggtagttgagggggaaaaatattcaaacttaacccttttaacaatgagtagatttgcattggtcgttactgccagattttgttttaaagtagaagagataaagacgtacttatccttggatggtctgcgacttaattaggactctccaaacaagcaccaaaggggatattattcaaatgttgcatctgcacacatttatcgccttaccctagtggcctaatccacttctgctaccacaactatccattcatctaaaaaccaaattagaaaaaataaatacattctgacagaaaaggaatatatccaactaatgaatgacagttggaagataaataaaacgataattgagtagaaaattcttttagaaaacaattgagtagatagaatattaataactacccaatttggttcagccttctaactctatataaacacgcccacaaaggcatatgtttcaacccccacaccaaaacataataaggtttgctttggcctttgcatcattatatatatctcctcccatggcgcatctcaagaaggatgctagggttctcttacttacagccattgcagtcatggcgatgatcttctcaccttgtaacgcagaaggtacaataatctattctcttcagatttctatcttgcactaatttctaataatacacaaaactgtaaatactacaaacatcttatattcaaacacaatgatactcaatttaaaaataatggagtctttttatgcaccattaatttatttcttatatctatgtataaaacgtactccaacacttatttatcctatttacaggcataaaattttgtttcagcctatgcatgcatttatacgcaaatatataacatactgatttagtggcattactacacgtaactactcggtgtactgagcacctctaggtgttttaggtcacattaatcgtaataatatattacataaaaatttagaggatccctgtaagttttgttgtggattcgtcactgctgatgctattgatattacagttgcagacaagtgctacaccgtatatagatgcactcttccagcatgcaacgactactgcatcaagctgggtgtacataacccacaagtgacatgcaagctcagcttcccaccctccgactactatgacacgtgctgctgcggcacgtgggacgacaaaagcgtgggcgcacgccgtctgctgtcccgttgacattataaactagccgtgcccccccgcgcgatgcgcgggcatcatccaagatctttaatcataaaagaaaaaaaaagcatgattgaaaacaacatagcttgcaacagtgctatacaacaacaactcgatcagaaaaagaatatcacgatagaatatcacgatgttctaaattttgattgatgtaatcgtaccataatttttttataatcaatgttacactaacaatgggtatctcggtgcatagtacaattacaacaacgtgagtaaaataaacaacatttgtatttcaatacctagctgtacccaggaagaccaatggggcgatgattaattggaaggatagtcaatcaaaactgtgtcagcacatcacaggtagtaattgcaacttatattgtacatattttacaatctatactaagacggccatgaaaaaaaaacaaatagaaatcaaggtttacttctccatgatccagaacctatgaatttgtagccagttctgcagatatgagagttcaatattcttgccagcttgtcaataattagcatcaatctactttagccaccaataaaagaaaaagggaagtagatccaccttttaaccttgatgaagagcatcaatatgttcttagtacatgatatataaaataatgaacaccatgcatatcccacgtaactgttaaaaatatattttcaacggaatgaaacagtttctaattttgtaaatcatgttgagtaatatgtagcatcagtatatatataatagcttgaaattacctggctggtggtcgtagaagaatcaatgaaaacgtgtatcaaaccataaatccatgatttacaaaatatggaacaaaccattaaaatgctatcacaatatttggttatcctgttagttaaggtccaatgcttgcctcttattgtgctctttgcaatcccagagaacgaaaatggctagtgagaaactgccaaatatatatatatacatagacacatacaaaaatatatgctatagtttaactgaataacagtttatgcatactacttggtgcaataaaaaatagagtagggaatgatgtttaccagtacaattaaatgatgatcatgtatacggagataaagattagacaacaaataagaattcccaaggaactactaaaataactgaaataataccaggaaataacaggtagaggaacaccaaagagcaattgccatgcagctggaacctacaagccttgaacctgaagtatgaataaaaggagaagaattagcaaatgaagcctcccatgtgaagcaagagcatttttgtgagaaaaataaatgaaatgaaatatgcagtgtgttgttgtgtacgctagaaatgttgatatagcatgatgggcatatgaatctaggtatttaagaaaaaggaaaatcacactgcacatatttgctctagtaataaactgagctgctcatagaggcacggggccatatgtaccaaaacaaagttgcttatgtgaggcaaggacgtagaatatgcatgtaattaagcgtatggcaagattatatgaaaaatagtttgtaggcgatacaatacagcaggaagaaagtgaatttgacaaaccttagtggagataggactgaacatgtaaacacaaacagaatgggacctgtggaaaacatatatgaatatattgtctgcagcttatagctagcacactaacctgaagctggagagtccggcaaaggctcctttcgtttatgctgtgatgtagttgtcgatggcccagaagagcatgacatcgtgtgaaagctcaatgaagagtgacaaggccttgctgaaacaataataatccaatgcaatatagctttagtacacatatacacaggatacaatatatctaaaggaaagtatatacatatgcaatatttggctagaagcactaacagattgataaattaagcggcagtaaatatactctcatagccgacgaaatagagcataagacaataagacaatgataaaattgattgaatatttacgaataggctggccatggtagggagctattttagcagcaaaacatgaaagaagcaagtatggtgccaataccttgatgtccccccaatgtacagcagctgtaacctctgccattgctggcttttaagacctctggtctagcatgcagtaacccataatgcaaatagctgtaaagaaatgtatatataagtggtccaatggctaaaaattttaaataggtaatgtgattcattttctacagctaacaaccaaaaaaaaagtaatagagtataaactgatcgttctatgtgagattaagagtttgctgtagaacacttcatagacattcgcgtgatatagagtatgccttgggaatggagagcacaaattataggccgaccatgaacaaaggaacatgtattagatctcagatatgaactgagtgctacctgcaagcaaagctcctgaatgagactcacaaagcaacgccaggttcaagttgtttggggacacacattatgcaacattttcaataactccgggggtgaattgatgtcgcttttcgatatttctgcactgaaatcaggcaagacctgcaacaatgctttgccttcattgcttgcaaccaaagaagtggcaatagtcgaaatgatttttgaatcaagagctatattctttgttatcatttcacgaattaacttgagaacttgggtaaggggacagagaggcagatcgggatagtggtggtggcgccgtgcttcgtagccgccacagtcaccgagctccggcagcgacgggccaaaggaatgaatccgcaaaaggcggtgccggcggcgacggtcgggcgtcgcggagggagacggcgtggcggcgactgccgggcgccgcgtgaggaagacggcgcggcggcgacggccgggacccgcgggacgaagacggcgccgtccgggcgccgcgggacgaagacggcgccggccgggcgtcgcgggaggaaggcggcgctgcggcgtggcgggaggaagacagcgcggcggcggcggcgagaagaggaggatttggggatttttggcagggaggcagcgaggatgtctaggcggtggctggtgtggtgattgcgtggactaaatatagcgaggacggaggggatggagggatggagcgatgaccgtgtggacggctggatggaatcaccagctggacatctgacggcacatgcatggcgagggactgtagtactgtagcagcatttctctggcctgagatgaatcgcaacactgttggtagtgggtcacgaatgatatgattggttgcaatgatatatgttgatttgatatcgatcaagaggtgattataatttgtgataattcaaccattgtgattaataaattgtgatggaagcgcttgtgcttttcgtatgaaataaaacaagtcgcattgcatttttcttttaattccactaaaagttttcgatttttggtgttcctaccattcaccctccttcttgtaggcttagttattattgttcgatcctgcgtatctgtttatccataattaagttttacttcgtttggaaccttcgataaataaggtttttgtcatctactaaacttatgactctagtagtgtatacttggggtggtgtcagagtttggtttcgttggccctcacatatgcatgttgagactatgttctttttacatgtttagggcctccttagggtaataaactaacattctattttttgtgtttatatgtatatggatgtgtacaaagcacaagacatgtgaagcaaaagctctagtaaatatctaaccaactatcttgtcgggatccacttattggaaacttgtagcgagttgtcctgtggttgacgactcgacttctctgctctagttgtctggttttgtattgacatctgaataggctcaaccttctatcgtggtagcggtatagaaattggggaaaatgttatgatagaataagagcaatcatggtagggcttatgttggactaggtctcatatccttatcaaggacttattacttatttgttgtagacgtactctattcttgtttgagtattgtctctgcacataacaggtatgtggtattcctaccgaggtatgtccatgtctgtggggttatacattggtagtagttcctgaactgtattcaaataagaaccacttgttttcactttcactatctcaagaccaccatgagggttgtaggaggctcaccgagctttctatttgggctagcgaagtcagggcagctccagcagcaacaatggtgcgatggtcagaacaacatacccatgagatgggaggctacactatggctttctataggtgcaaggaagtccacataagatcaatacaacagatggaggagtaaattccctgtatgcacctcaaaactgactcaatcccttccatgccctccaattttgaccaatcccctgtgtgccctcgagattttgttgtgttccctcccatgtccctaccgttaggcatctgttagttctgttagtgcatacatccattacattgtgagaaaatcccctgtgtacccctaaaagttcacctaattccttctgtacccctgaatttttctcaatcccttacatactcctgaattttagtttggatcccttccatgccctttccgctagttgaccgttagttgaccgttaaattcttatgaaaaagtccattttgccctttggtataaagaagcatataaattaatagagtatattgttgaagtatagaaatttgttatatgagactattatgtttatgagatagttatgcaccatattatttgcgataaatgtacttttagatatgacataaaaaaattaatacttatttattagttattaaaagattttttttagcatatgtgttatgatagtaataaacaaatctgttgtattactatgaaaacacatatgctacataaaagaacttttaataactaataaataagtattaactttttatatcatatgtaaaagtaaatttgtcacaaataatatggtgcatcacatactcataaatataatagtctcatccaacaaatttttacattccaataatatgcttcattaatttattatgtttcttcatagcaaagggcaaaatggaccttttcaaaagaatttaacggtcaactagcggaaagggcatggaaggaatccaaactaaaattcaggggtatgtaagggattgagcaaaattcagggatatataagggattaggtgaactttcatgggtacataggggattttctcttacattgtcagtaatttcaaaaaagaccaaaatgcccagcaaaaccctaggtaacaaccagcaaggcagcaacagtgagaaatccccaaataatatccaatctcttgtctcccgtcgacgcaggcagcgctgtgcgccgccgccgtcctttcgcggccgtcgctgccgttctgtcacgccctgaagttcccctttccagctttaaaatttgtaaaataaatcgtctgaagaaattgttcaatttaacctagagctaattcctcaaattaataaatgcaaataataatcgaaatcgacatatggaatttttcttgggttctacatgtcaaaatatgctaacaggaattttagtggaattttcagagccttggaaataattttaaccaattaaaataagcaaagtgcaatattaaatccctgggaaaatcctttttcctttttatcttttcttttccctcctttttccttttcttgggccgccggcccatttcttcccgcgccggcccgctcctccctcccactcccaaagttcacccggcctccctctccctctcgggtgctgacaggtggggcccacctatcagccctttccctaacctctggctgcccacgcccgcaccaaccgccgccgaaaccaccgcccacgccgccacgtatcccgctgctcccgcgcccactccacgccccgcgcccacgtcgccgcgacgccgcccacgccctcgccttcccgcccgcgccgcgagcccaccaggggtggattcaaattttgaatcccctcccactctct

SEQ ID NO: 61189 - DNA, 2364 bp, Oryza sativa
  unsure (1)..(2364): unsure at all n locations
tctctctctcttagccgcacagaaaagtgattagtatacgattaattaagcatttattattaaaaaaattaaaattttattttcaaagtactaattttttatatagaaaaatttcacactaaacacacggtctaatcgagaaagcagccaaaccaaccccactttataacagacccaaagctatttgttaagatcatttcttaattaaaatgtttaatttatccctatatttaagtagataatccgagacaatatcaattattatagtagattatttgtttcgcattctaaaagttatgtttcttataactattgtactccttctttataccatttgtcctaactttttttattaagtccatttcttaagagtggatcatttatttcattttacgcgttcatcaaaccttggtcactgttttcggcagcctgagtacttttgcactggagacgaccaacgtggtcacactatctctagctgtgtgctacaaccgtggcaatgtgttctttcaaaaaaaaaaacaaccgtggcaatgtggcattcagctgcttattgattatgcagtccgttaggaagtactatctccgtcccaaaataagtgcagccgtagatatccgtgtccaacgtttggccgtccatcttatttgaaaattttgtgaaaaatttaaaaatatttagtcacacataaaaaatttttcatgttttatcatctaatggcaataaaaatactaatcataaaaaaatttaaaataagatgaacggtcaaacgttgaacgtgaatagtgtaaaactacacttattttggaacggagggaataccgaaatggtatcaggaggacaccaggagaagatcaccgaattatagtagaaatcaggcacgagcttgtcctggatttttcacattttggttcttttgaaaaacttatttcgcaaatagacccctagaaaaacttatcccaaaaattgtcctttttggggcgccagagtggctggcgccctcnattcaacaagacggcgccagcctttttagtgccgtccccctgtatacgtggcggggcgatgctgaggtggctagggggagtaccccagaatggcttggcgccacccccccctcgaaattttaaatttttgtttaatttggttgatatttttttcacgcttagggacacacaagaaccaaccatagaaaaattgaactcaaatggacataatatgtgacctgtaaaatttttcctctcctctcctctcctctctctcccaactagtgcaaaggaaaaagatgtgcaacttttttatttttattttatttttttgatacttttttcacacttagaaactcacaggaaacaaccatgtaaaaaataaactcaaacggacgaaatatgtggcatgtggaattttccaaagctccaccgaaaaacttctctcctcgaaaacacaatcttgcaagcggaatttggaggttttaatatcgccgccgaacccgacaaagctggggagaatcagatataactttttctgtagatgtccgtgcatatattatttgcctgattccgagtccgtaagataaagttacgcttgttttaatagatgacatattttgtccgtttcgatagagttttggaaaattctacatgtcatatattttgtccgtttgagtttattttttatacagttagtttctatgttctcctaagtgtgaaaaaagtatcaaaaaaatgaaataaaaataaaaaaaattgcatctctatgtactgtttaacttatatatgtcatttcatgtggttatattttgaattagattaagtaatttcatatagtggtagagtgcattatgtttaacatgctgatcaaagggttttactaaaggagttatggtctaattttagtgaatgtgcaaagtagactaagtggaatgctagctattttcagatttagctaagtgatagttcgagtttaaattttttttgcggttggttatatcgtgatcctgagtgtgaaaaaacatccgacaaaataaaataaaaacaacaccgttgcaactccatacagaaaaacaggaatggaggcggcggcgccagccatgcttgcgcccttcttcctggggcggcgccagcatggctggcgcccttctcctgccacgtaggttcgcgtgcgccatggtggcaggaggacgactacagagaggctggcgccgccccgttggatgacggcgccagcccctcttgggccctaaaaaggaccatttctgggataaagttttttaggggtctatttgggaaataaagtttctaaaaaattacaaatgggaaaaatcggccgatcaaccacagtgggtttcatagttcattaaccctactgtt

SEQ ID NO: 61190 - DNA, 8784 bp, Oryza sativa
  unsure (1)..(8784): unsure at all n locations
gcccacttatatagagagcgggcctgttaaaatgaactagatgtttagaaaagactcatgtgtcaataaagctagggggtgggtggtgcatcttttgtgtaattctccaagtgtacccgacggcaaaattttgaaaaaaaaaacctaattttaggcgggggggtaaagtggggaaccgtatatgaccttcttgaagggagctagggagtttgttttaaagaattcgatacacccccttaccggccattttgcagcggccccccggcacagtacaaattcgccctcgcgaaggcgggcaaggggcccaccttcaaatttagttgagggctgtcgcccaagaacgaacggccgtttgccacgtcattttccccgccctctggaaggccgatttttaaaaatcgccttcccagaggccggtaggttttatnttgggtccagccactctggcgccctaaaaaggaccatttctgggataagtttttttaggggtctatttgcgaaataagtttttcaaaagaatcaaaatgtgaaaaatcggccgatcaacccatgtggcttccatagttccatcagcctaactgttgtgtcatatcatatcaacaacgatacaaaaaggttcctgtctagatatgctccgtggggcccatggaaaagtgactcaaagaagaagaagaagaagaagaagagatggtactcgtggcgaaggaaggatcgacggggagaaagcggcagcggcaggagagccaaaaagggcgcgtctttccttcttttttttttcttccttttttctgtctgagcatatattcttgagagattatactggtttagtttaatgaccccactatcagactacccgttatagtgcaagagacatctttgctttttcagagtctttcggatgcagaaagagactagtttaaagcgctccgcttcttgacttctttcagtaaggacatccttgttggcactcaaatgttctagagataatcttctggacgaagaaatgtgcataaaactattacattcagggtgactagttatacccattaaactagctactagtagtactagtacattcttaaagaaaatgttctactactaattactccttgctgctagtactatcctggacttgatgactgaatattcacaggccgtgttactacagatcgagcttagtagtactcccaagttaattactgggacatattcagatttgccgtaactaccgtgccagttttgtacagagatgtcatcgacgtaaaaggaccggagatcattccctcacatgcctcctccaaaagttctgaatttgtctgtgcatgagcaaaaaagcaagagttactacctcactttctttgcaccttcacatgctgcctccatcaagttactcgtgtccgatttcatgaactcaacaacccgagttacatactcgtgcgcaacatcacgagcagttattaatgcgagtgcttgtgatcactcggaagaagtggccggtgcgtctctcggatggagccaagtaactgtgacctgtgaaatcccattggcacgatacgttttgtggttgcagcttaaagagcggctagctttcatgctttgaattgaaagttcgaattacatgagtggaccgattgattaggttatctttcgagctctgttattactctatctaagttataactggagtactatagtaaggaagacactgtagttagttaatactagtatagtaatagtactgaattttggtatagaacattatattgggttggtacatgtgcttgtgtacatgtttgtataactttccatgcctacctattggatgcattcatggacaaagaaaactgctttcagtgtctagattaacatatctcaaacttcatatgcacggaagaggatgcatgtggcacaaagcaatgcaaattcggtacagattgctcagggatatgcctcttctagccaaccaagtaatgctagtttatttccgttttgagtacctgaccatacctgatcagctaggaatgtgctacacaaaaaaaaagtgtttgcacaaaagaaacaaagttttgctttgtcaggtacgtgcaaaggagaatgattgaaagggcagatgaattctgatatgagtgaattctgagaccggtcagtaggaagcaataataattgtacacaatcctgtgcttgaacggtaactgctttggaaaagcttgacagttgcagcgcaaagcacaacactttatcgtgcttacagaacaaaaagaaatgattaatcgagtgtttctgagtagatttaagccctggtaggaagcagtatggagggattatcttaggggtttgtgctaacaaagcaagataataatcagcacaaacgtaacttggacggcaaagtcaggtaagccatgattaattaacaaagggttaatgatgattacaagttctttggacgccgctccttccactgagtgacagacaacggcttcggagcgggtagtgactcgtctccctccacttgttattttccatcacttttataagtaaaagaacactgaaatgccggtagtctcagcttgttcttcactcccatccattcaacaggttacatgaatgaatatacaacaaacattaagtactgaaaaaacagatttaataaatctgtcaggccatatgtgatgaattaagggatggaaacggtcaggaactttatcatttctaaaaaatggttctccatctattgagaatcttttatatttatcaatttaacgacgatctcagtacatcgttaatacaaactagaaaagtcaaaatttatgtataataaaaaatgtaaatggtcgaaaacggtgctcccttcgtttcacaatataagtcattttagtatttttcatatttatattaatgttaatgaatctagaaagtacattgtgaaacgaaggaagtactatttttacgaaaacaatactcggtctaccacgacgtcactatattcatcattttcagtagtaacatggataaagagtacactggtacaagaacaggatcctgtcacaatcggctttgagtacacagtggtagtatttcttagatgcagatatcaacgccgtattagcgtgtcacggacaattctagccaaggaccacgcaaaacgttctagacttctagtaaggtgtgcacctgcattatgccggcatccagcccccattccacccggttttccccgtgaatccacgccgatatcgttgggctggcgcctgctggcttcgcaaccgtctcgccgcagcctcggattgaccaacgcggcgcatcacgcgcgcgaagcaagcaagcacgcctgccttccaatccgtcccgattttgcacgacgatgaggaggtcgttttcgcggccacgaccacgtcgtttttgcaccggattctcccgtgcgcacggggcgaggcgtactgccctacttgggcgaccgatcgatcgaaatggggcaccacgaccaccgttgtggtgcgtggccgtatctatccggctttcccggatgttccaccactaacagcgatcttatctcatctttcagattgtttcgtcaagctaatcatcatggtcgacgcattcgttggattatacgatcctgtgatcctacaagggtaggtttaagttaaccgtgggggttgattattgctgtctcttgttgagcccgtgaacattaggtggtgataaaaacagaggggaacagactacagagacaggcccagcgcaatctcggactcgcccaatcatcgccgatcccgtcgttacgcatcgtactcgcacaagtaagcgacgcgaagccattaaactgggaagaaaaactagccacacccgtgagcgaagaagatcagattaaatatagacacccagctgcgtcgttgcaacgggtgtgattcggcgccagttaatcgcgcagcaagcaactgatcggaggagctcgtagccttctcgatcacttgacgcgacgcttgccgctcgcgatctcgcatagtggcaacagctaagtgtggcaagtgacgacgacgacgacgaggctagctaaaagggatttaggtcttgtatccatccgtatcctatcctagctatatcatcattccgtcgtgatcctgggattcgtgtacggcacttctccaacatacataaatacattatatgcatactttcttgtatattgcccaatttttctcttcttttctttggtccctccctgccctacataattccacagtatcctcatcatcgatcgatctccttaatttggagtttgatagatagagttaggttgctcgacgggtggcagagtacttcccctgcctgaacaatgtgtaattagtgcagaaaagcaacgtactacgcatatccaatggaatacagtaaagcgtggtgtatatcttcaaggttcagcaaagacgataggcattagtatatctttactgatgcccccacatccagcggcgcacgtcaaagctagacatacatgcaaagatgcagtggtacactacacatactgcaaagacaacaaattaaagcaatagataggatggatggatacatgaatacggttggtctcggtttgccgaatgccaggctggtcacatacatgcgagaggatgtgaggtagagatgccacatggacaaaagtacgtgctcgcctacaaagctatgtccggggaggtcatctttatcggctagtctagctagctacgcgaagaagaagaatttagcccggaaagtgacggcccaccggccgcttcgatcgaccgggcgccgcgccgatcgatcgacggacgcattcggatgcagcgcacaactgcacaccacttcattttttttttctgtatgtagcacgtactgttgtctccaagcatgtacaggacagagttcacgtgcaggtgaagtgtagacctgggcacctggccgtagaacacaagaggacagagaagagacaaacagagttagctcctctggaagaagctacctcttaatccaagggtgtgtttagttccacgttaaaattagaagtttgaaaaaattaaaacgatgtaacgaaaaagttaaaaatttacgtgtatagaaaagttcgatgtgatgtttttagggttcaaactttgaattacacacggcccatgtcaattttgacggcatcgtaaaatcggttttggccgcgagccagccgtcctgcaaaatccgccgcgtccgcgcacgcccgcggccgtcggtttttctgtctgcctggtccaggagaaagcctgtctggctggctgcctgcctgcctgaatgcgttgataggggaagagatgagaacgagatggtggtgggcactggacagggtagcgagcctgtacatctgcatgcagagtagtagagtatttctcagcgtcttctctacgtccctggtcgctacgttactagtacgttaatcaatccgagttttggaatgtttcgcacttgccaaccaagtatgtcggaatgttgtggtggtagtacacagtagtacacgctgtgtgcttgtcctgtagctgtagtccgtgatgacaacttagttcgacagtacattattcatccaagttttcacctacagattataataaacttctactctcagttaaaagccctggcaaatcaaggccaaggacggcagagcttatctagtggagtactagtatatccactagttggtggcgacacgcatgacccgatgcgacgctgggtgtggatgactgctaggttgtgagttgtgactgatcgacatcgatcatgatccactgtcataagcttgcctaggactgatcttggatagatgaactccaacttgagatcatattgaagctgtgctgtgattgtgagatatatatgggcccagtaggcctgctgggctgtgctccacaaaacaggccaagacagagatgtaggttgggctcctggccgactgacctgattagactagctcaattagccgacactgatgatgacatttagggttggtttggtttgtggtctaaataggccttaccaaattttgtcagtgttaaattttggcacgttttggcatgactaattttggtaaggcaaagttgtgtttgtattgaagccaaaatagcctaagttcactattgaaatggtctattttcttatgcatgtcaaaatttggcttcaaactaaatagacactaaacactattgaaattgctaaatattggtaagcataatttagacctcaaaccaaaccagcccttagagcccttcaatccagagatgacgacggaagtaccagctaactgaaaattgtatatcttggagattaattagacagaccccaaccgatcgttttcaggctgcttgatcgtataactggcctaaacacgatcgatttcttttttcggatacgtaaggaacatacttttttctattaaaagaaataaaagttatttacatgtaaaaggaaaaacagcatgagactgatacagtcgatcatgctgggtgtgctgtagttacgtacacgatttgagcagtcagttagtgagacaccagcgctgaactcgttgctaattaagcattttggtatcttaagcttctatgtgtttttttaaacagaagagcagagctcctcccctttccattaaggaaaagcacatgttcagttcagcatcttaagcttccatgtagcagtggcatgccgaatttggaatggttttagtggcaacaggctagcatgataggcaattgtgcaaggattagttatagctgtggaagagcttaaacctttataaactctctccctggcttctcttcaactataaacacaatagtagtttgaaaatcatttgacaaggtatccaattgcacgaggccatttcaggaaggatttaactaacactagagccagttaaatccagactataacacggggcttgtactttctattgacatatttttttcaatcttgttttatatattgagtttggatttgatttttttttggttgtagagatgtcgtttactctgtgttgtcaatttttctcaaaactctttatgcctatttgtattgtatttgaggattaactgtgtgtctgttcgtaaaaaccggaaatgtaaattatttccattattaaaaagtatatatatttgagggataaaggtgcacgatgggatatcctagaggggtcaaaaccacttctaggaccaactgtggcctccaaccaaataatcttctataccataataacaaagaaatccacaaagtcaatagtgaaatggtagaaaaaagtcatgcattaaatatgcagagactttttcattccaacactagctcattctagttaatagatggagaatgactcctaacaacactataaatgtggtcgtgtgcatccccttgttgtagaggcaccacaggagaaacgatctttaataccggttataagaaccgagactagtaaatcaagactaaagatgtggaatgctaggattcgaactcaagatctcttagctctcatacgcgttaacatcctatctactacacacatctaacttggatggagatgctttctttttgaattaacactggagacatatttaatacgggttggtgttaccaaccggtactaaatatgcatctttagtaccggttggtaacatcaacctggactaaagatcctccagcattagtctcggttagtgttaccacccggtagtaaatacacatttttagtaaaagatatttttagagacttgagcttttagaatcggtactaaaacactaaaacatctttagtacttatttttaatcttgctaggatatttgtgttttgggtttaggataaaaaatcgcttctctcttggtgaggccgagttttattaaatccattattacaaaaacaacactaaattaaagtatactatatcatattgcaaatatgtccacctttcatggctgtgctgagccaacgaggtaagagtgattcaagatgcattttacacaacattcttcagaatgattcaagatgcatttaacacagcatttttccgcgttatttcaagcagtaccattactgacagtctgacactgcaagttgtgacattgtggctgtgtttagataagtttggattaaatttcagtacttttccattacatcaacctgtcatacacataacttttcagtcacatcatcttcaatttcaaccaaaatccaaactttgcgctgaactaaacacagcctgtatctacttgtatatcatgcatgcatcacgactcattccatggcaataattaatggaggactggatgtttctcgtggtctagctagtgacactatataattaattagtgtaacaataattaggttggattaaccatgatagatgatattttatatatattgtctccatctataaatataacagatttcgagttcgaatttatccatagatataacgaattctaacataccactttcataatccatccaaagcacaagtttactcacgaaaattgcatcataggtgtaatctttggagaatgcaatacgtacgctagggattgagatcctctgacagaacttccctctaacttggtagatgatatgtaggcctaagagtgatgggtccacatgttagtcacagtgaacagtaacgtcagaggatccctctctgtacgccaaatacccgacgctaacgaaattatcgagcgtccacagccactggttccccctctatctccctacacgcctactctctcactctatctcacacacaaaacatgctcccttct

SEQ ID NO: 61191 - DNA, 995 bp, Oryza sativa
  unsure (1)..(995): unsure at all n locations
gtcgatcacatgtatgtaganctgttgtgatgantttttcgtctagacgtttgtgatgtgtcatttgtgaatgatttagataatatcactctcncccnnnccgcggttgagatcnaatacnctatgccgcagccgacantagaggatcccgcctcacagncaanacaaaancngacaaaccaacaccatctggacacaaaccatattttctttaccggaactatctgaaatgtgaccttacttgacattgcgcctgatgaaaacaataactgcggtaacctcgcatttcgtgtactacgccactaagtttacatgactttacagatattgttcccctaaaattgttaaagattacccttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatacaaaagatgtatgggagcatacctgtgatgaattgagcgaaccaacagggcttcgccgctccccttttgctgccctaccctctctctcttttgttttttttggatttttagtgaatataatgaaatttcacagaggagggactgggctttatagggggagaggcaaaaatcgccctcccccagggcggcaagggggccgcctgtaaaattccatgccccctcgccgcccatttgcaggcggcccccccccacagtacaaaatcgtcctagcggagggcggcaagggggccgcctccaaaaatccatgcccccccttcgccgcccatttgcaagccggcctcccgcacagtataaaatctgccctagcggagggccgcaaggggggccgcttgcaaatttcgttgacggccgttcccccagagcgaacgggcgtctggcaacttattttcc

SEQ ID NO: 61192 - DNA, 5119 bp, Oryza sativa
  unsure (1)..(5119): unsure at all n locations
aggccggtagccgactccttccgtcaattttcantatgaaaatttatttttgtaaaccttttaataaaaaaaattataaataaaaaaatttcatcttgctccgngggcaaaggtgcgtatagatggccaaacgggtggccgggcctggcggcccgacttacacaccgggtcatgccgtgccagcccacgggccgcacacacaatctaggcacggcccaacacgactcgggtcgtgccgggctggcccgaaggcatgatggcctatcgtgcttttccacagaataagtctaattttcctccctcctcctggactgtaacatacctagctaaaaaagtctatattttctccctcttctttgggctgtgacatattaatagctaataagtctattttaggtccctattctttggacagtgatattcatatgtctatttttagtccatatactttgtgtgccgggcctagcctaccggcctatcgtgccgggccagcccaacgtgtcggtggagaggcccaagcacggcccgatggttgggctgggctatcacgggcccgacccaagtcgtgacgtgccgtgcttgggtcgggtcaaaatgtcgtaccgtgggccgggccttcgggcctcgggcgttatggccatctataaaggtgcggggaaaagtacaccgaaggtccctcaacttgtcgtccggataaaaaatgtcctcgaaccgcaaaaccagatatgcgaggtccttcgatggttttgaaccggttttggtctatgtggtggctgagtcagcgtgggacccatgtgagccccacatgtcaggtgtccacgtcaccctctctctttcctatcttctctcccttcctcatctctctctctcacttctctgcaagctcgcgggggcaaggcgggagggcggcgccgcaacggccgccggcggaggcggcgtgcgagcgcggcggcttctccgctttcttcacctcctcgtcccgctcgggcgacgtgggctgagcatctgcggcagcaatgcggtcgcggcgccggcgttgcctgcggacgacgacatcgactccgccgccccgcgcgaggaggaggaggaggagacgggcaccgcgcgcgccgccggcgcgtcgtcatcgggcgggtcggggagcaggagcgggagctacccgccgttcaagcgggggagggacgagcttgttgacagccttagcaagtttgccgacgaaacccggccgtcgaagcggccggcggcgaagcaccggactcgcgccaccgaggtccataacctgtcggagtgggtaaaacctcaagaacaccaaccaaccattgatggatagatggtgttgcctcatttgcaacaaggtgaatgttacttgattttttctgttcttgctgcagagaagaagggatcggatcaaggtaaaatattttttgcgaaaaattgtgggaaattttgttattctgtttctgaaagggtttttgtctagagcaattatatggtctatgaggtaccaaaaatttagtgtaaaatttggtacctcatagtacttgggtacctaagaggtactaaatttacaatagaaaaaatgatacctcatggtatcttcttaaggactgtaaaattgctcttttgtctatgggagatgaactggaggatccctttgcatagataatcaagacaacaggaaaatgcttcatatgatgctacatgtatggaaatgacatgcaccggcaatatatgaagaatatagtggctgtgtggattcagcttgagccggcatagcagcagctgcacaagaacatcataacagtgacagtttcactcttcttttagctgatgttacagttatatgatgcctgagggacctgcatctggtgagtccttacaagaaaaattctaggaaccaaatgacagttttggttgctatgttgatttttcaactggataagcataaccatcggttcttcaagattgcacatggcctgaagcagaaagaaccttcaagaacttaggtagactgaaccatgtgcggagcgcggtggcttctccgcgaacgcccggcaccccaccaccgtgttccaccgggcgtacgcgtcgccggctccgctgacagggctgacgcgttcgtcggcgcgcgcgacgacacgagcgcgcccacgtcggccgagcgggacgaggaggcggagaaagtggagaagccggcgtgctcgcgcgccgncttcgncggggggcgtcgcggggcanccctcttacctcggcccgggcagcttgccgttgcanagaagtgagagagagagagattaggaagggagaagaaaggggaaagaagaagaagaggatgacgtggacacctaacatgtgggacccacgtggggcccacattaactcagccgccacgtagattaaaaccagggtaaaatcatcgaagaacatcgagtgaccggtttttgtaaagttaagaaaccccgtatatcttgttttatggttcgagatgttttttatcctgataacaagttgagggaccttcggtgtacttcttcctaaaggtgcgtatgactccttttttgctttgcagatgctctcttgttattgtttgttccctgtgatccatgtgttttgttgctaatatttgtatatagtagtgtgggtgatgttcataaatatatggatcagactatgcacttgtatatggtagcgggctgatgttctggtctagtagcgtctcgcagatctgaaaccttctgatgagttcatgtttttggggtttctgtttgggttgaaactgaatcgaagcattaattttctagccatgatgtaggattgaaatttttgctttttgttcagccaaaactagctgggtggcccgtgcaattgcgcggctagcacttaaacaaaatcatatatttttagtatgattttatttaaaatttattaaatagctatctcattttcttaagagtttgaaagaccaaaccttatcatctctgtgtttctaattatatagttttttaaaagtcacaccaattgctaccccttatgtcatctccttttttatttgcttgttcgatctaccactatttctattcattcttcttggaacctttaaaaattggatcttatagtttttagagtttttttttgtcacgttgggttttgtttttataatttctaggcgtcccgtcaaacgttgccattatactcctctatggtccgttcactatctcttctctttattgtcattgagattttaaaaatcgaacataattatcgtttgggttcatttttactttctaaaagtcctgtcaaaccgtcagcggctttgccattgtacttctctatggctcgcccgctgtctcccttctttattatcattgagattttaaaattaaacatgattatcattgtttttgttttactttttagaagttccgaacctttaaaaattgaaccttatagtttttagagtttattgtcttgttgggttttatttttaataatttttagaagtctcgtcacacgatgccactatgctcctctatggcccgtacgccgcttactctttattgtcattgtgattttaaaaatcgaacataactatcgttggaattcattttttatttcctagaagtcccgtcaaccgtcggcggctctgcaactatactcctgtacaccccgcccgctgcttctcctttttattatcattgagattttaaaaatcgaatatgattatcattggggtttttttttactttttagaagtcccgacaatcaccttgttcgtttgcttcacggccttcctaccgtccctccttttaatcgttattaggattctatttggtgttttattaacagtttttatatgttgtatcaaccgccaccactctactctactataggcctattacttaatttatctcgtcaggtcttttagatggtcttttctttcaatagtctttatttttatcataaattttatttaattataaattgaaaagttattttttgttttgtaattttataaaaatttttcctaaattttaattaatatcgtattgtgttcttttaatatttttattttttattttcaagagaaaagcccgtgcgctgcaacggatgacaactattttagtcttaattcactgtgagaattcgcttggatctatatatttctataaaatcataagctgcggttaggagtctgttcgtctaaagtcagcatgcgaatttttttatacgactcctatatttccaaaagcggacgaacttaagaatcaactcaaaggatatatattttttcaaaagcgaacaaatttataaaccgactcatacacggatgacataccaaaataccgacaaaagaacatcttaaatttttcataatagtagaggttttttcaaaaaaaaaagtagaagtagaagagaagagaagattacggacaaaaagtcattttcgaggcaatcgtacttttttttgaggaatcggtcgtttttattttttttatacggtagaagttttttttctctttttttattttttcttgccttttttctccacagatagtcggacttttttatggagtcggacgtttttttttaacatagaatttctttttctcattttttcttttttttccaccggaggagtcggtcgtttttttagatagaagttttttttttctgtttttttgataccggcaaaaacatcttcaatttttataataatatagatttcggttgtttcaaaattgtattcctacttgaactctcttttaatttatctaattttggatattattttattttttattctgaattttaattaatcacatattgggttcttatgtggattcttctttcaatattattttttttaattccgaatttcagctaattttaaattgtactcctatttgaactcttcttcttttttttctaattttggattttatttttatttttattcccaattttaattaatctcgtattgtgttcttatatggacttttcttctaatattccctatttttaattccgaattttagctattttaaaattgtattcctacttggactatccttttttttaattttggattttattttatttgtatttcgaattttgatta

SEQ ID NO: 61193 - DNA, 1611 bp, Oryza sativa
  unsure (1)..(1611): unsure at all n locations
ttcgaattttgattaatctcatattgggttcttatatggactcttatttaaatattgcatatttttaattctgaattttagctatttttagattgtatttctacttggtctctccttttcttttttttctttttctccgattaatgtgggaatttctagcccttacagcgaacgcggtgcctcttttcaaagctgttttaataatataacaaatgttagttattaattatttttaatatcaaattttagttatttgtaaattatatatattcctacatggactctagactcgtcttttaatatttcttttttttaattccaaattttctgtaaattgtatttctatatagactctatgctcttcttccaatattatttatttttatttatgaatttttattatttataattgtatttctatgtggactctaaactcatctttcaatattttttaattttaatttcgaatttcagttacttctaaattgtatttctatatttgtatttctatattgaccttaaattcttcttcccatgtttttcttaatttcaaattttacttatttgtaaattgtatttttatacatactctaaactctacttttaattttattatgtttatttcaaattttagttagttttaaattcctatatggactctatactctacttctaatattccttattttttaattccgaatttctattttttttctaaattgtatttctatatggattctatactttacttctaatattccttattttttaattctaaatttatattatttcctatttgtatttctatatgtactctatactctacttctaatattccttatttttaatttcgaatttcagttttttcctaattgtatttctatatgtactctatactctacttctaatattcttttttttttaattctgaatttcagttatttcctaattgtatttctatatgaactctatactctacttctaatattccttttttataattcggaatttcagttatttcctaattgtatttctatatggactctagtctcctcgtccaatattccttattctttaattccgaattttagctatttttaaattgtatttctatatgtactctgtcttttctttttctccgattaatgtgagaatttctagaccatgagagcgaacgtggagtctcctttttctattcctttaataatataatagatagatttgaacgatgtgtagctctagcccctttagtaggtctcattaccttctgaggaagagctaaactcatactcctacatgtctgttgtgtgccaaaatatttgcttttttttttgctcagcgccaaaatcaatgcctctttggcacaggtcagcgcggctacaacagtcatcaaggcaggcatagcgtgatagcgactccctccgtgagtcctgattgattttgtttataattttgtggcattacattcatcatcagaaatgagcatagtttctgttcagaccagtgtcaattttgtatttttgtcattttttaaaacttctaaaaataagtggttttgtcatatttgtatttttatattttgttgttnagtggaatngcattcaaacccac

SEQ ID NO: 61194 - DNA, 17325 bp, Oryza sativa
tttcaccacacttgaaacactctcccctagctcttcttgcagctttcagagagtcaaacctctcttcccacttgggtttttcttccaacttcttaccctcttcaggaggtgcacccaaaatgcctttcccctgatatggagtcttgttgaaagtcttgtagctctcttaaatgtctgcttcgctggtgccttcttgttcatttcccccaaaagctcctcctgtgtttttgcaagagacaacgcagcatcaacagaacgaggcctgtgcagcttgattgctgccttaatttctgttttaagccctcccacaaattttgtaacaaagaaagtctcatcataccccttgttatacactagcaccttatgcataagctcttcaaacttgctgtaatactcttctacactacccatttggctatgaccatctagttcctcaaggtgttgctggtacctatccctccaaacttactatgcactgctacacacagttcataccagctttcaacactatgcatttcctcataagtctgcaaccacaaagcagcattccccgtgaagtgtaaggtggcaaaggctgaccaagtttcatagggcacatggtacatactaaagtatttctcgctattggttttccacaatttaggattattgttaacgaccaaatttggtaatatcagcatcggagatggagattagattgaagtggaatcgaagataagggttctcgcggaaacagagtaagaatcggctggagtccggattggctacgactgagatcggctaagtctgagtcagactgggttaagtgatacagccgattccgacaatatgactcgtatacgacatcgggtttgagttgatgtgcttcaagatgattgccgtacatggatagagtcctgagaaggcaattatatttattaattaggatattttatgtaaattccttagagataaatatgtgcaaaagtctgccgcaaagacttatggtatcttagagtttgttagagataatagttgtgtccgatatggacatatcttgtaattcttgggtataaatagaccccgaggcctatgtagtaatttacacacgcgttcaatacaatctcggtgcatcgccaccctttttacttttgttttgtttcgacgagttcttgctttcgggttgagctgcatcggtttcgatcttcaacaagaggtaaaacttgttatggcggcttgcgttctcgggattagtgcttccatctgtatgatactctaatcttgtctatgtaattcgtcgagttatcatatatcttatataacctctgacaatatcgtcatctaacctacaatcggctaacatctgttaatagaaggcagccgattaggttaaataacgatgttggcttagattatataggatatctaccactctatgacacatccagcgacttgattgtctagatattgttcttcttttcatacttaatgctgcatcagttgagtttgatctattaagtcgtgcttagaatttcaatctctagcctgccttctggttgccgattagggtagtatcggagtttcagccgatcttatctgatttaactacttttaccctatatgcttgactgatatgttaaatcagccctttatattaaatatcttgttgcatctaaatatattaggcttctgttttagtatattctacttgctttaatatcttaatatagagtggtatcggagtattagccgatacatgctagatctatctgatcggctatgctatgaatatatatataatctcattattaatatatatttcgatctaagtgatttatactgtctcggcaaggtgaccgatctatcccaatcatttgatttaagtatatatcgatataaggattatataccattaatatctacagccgatcgagtagatttagttctgatttgtttattaatacttgctgatcgatgtacatatgacatcggcctaaagataaatgatatgtcatcggctcctagctaatcggctatcgtttttggatttaaccacagtttctttgtctttgtttcttgttgattacaagatcaaatcaactggcacgctcatacatccgaaggtgagttttggacctgcactggagttaagcagatctcccaagcctcgtgttttctgtcaacaattatcaccatcaaattttgggaaatcagttttaggcaacctagaatttccaactcgtccaccactctgagatcccggagccccacgctcagaactctccccaatttcaaaattaactggcgaattgcgaaaaattggcttacccttcaccagggttcgatcctgaaccgaattggctccagaatcaaaaccatggtgatgttcttctccgcggtgcccatcgggcattggcgtcgccattgctgatgtcgcctggggccttgcttcaagatccgtcacgcgagcggcaattccttccaccgtgctccgcaggtccttgatccctgcatcaacacttggaatccacttctcgagcccttgcatggttcccagcaagatgttgatgttggtggtgagctcggtgacgcgctctcccaacgtctcgatctcttcttccgccgcccccattctctgagtaagagttgcttgagatttcttcctcgccaggatgcgcccaacctgagctctgataccagatgtcacgaactctcggattccggcgaaacgctcggagattgaaggggaatcaggttcgcgattgaggaatgagaggaggagtagagcagaacagaggtagacgatgagaggttgttggtttgagtttttcttattcgataaatgctttatagctcagctcgccatataaatggcagcacaacgcacatgtgtctgatgccaccgccgaaccagcacggcacatcgatacacatacacgcaactggcccatctgcggcccatcacagaatacaacccaattcaaagaatcaccgaagtatctaataaggatcacgacaagccggtggccgtggggcgtacaggaggagccaagaggactgtgctggcgagagagagagacgcgcggggcgaagaccgcaagacaacggcagtggcgcgaggaggaagatgacggtcgatgcccctgcttggcacggcacagcccacttcaccagctgtgcaacgacgcctttacgggatgtgccgcgcgaaacatttgggctgcactatgggagaggagagaagtggattgatatacacatgaatcttcatgctaaatactccctccgtccctaaatatttgacgccgttgactcttttaaacatgtttaaccgtttgttttattcagaaacttttgtgaaatatgtaaaactatatgtatacatagaagtatatttaacaatgaatcaaatgataggaaaaataataataattacttaaattttttaataagacgaatggtcaaacatgtttaaaaaagtcaacgacgtcaaacatttagagacggagggagagggttttataaaaaagaaataagataacacttcgaattgtgtaaaccaaccggactaagatctgcaggggtgactgttgttgtactcattgccaccgacatgtgagcccaaatgtcattggtagtgactgcacagtggtcaccgcactggatcctacccaataaaccaacatattatgtctaagtgccacttaaaaacaatttgattgtgtcccattttttttcaatttagtttgtattgtattgcagtgaaggttttacaaatcatattactcgacctatttgcactcactacacacaattttgtatactatgatcaattaactaggcaacattttaaacataaacatatgctcagcatacaacattcaatggtctagaattagcatgttgtcccagatccctgcccatgctcttctggagtggtaagacatttggtggtccatgatcgaggtggagaacagtcccccatgcgtcatctgcagtcggacaaaaaaaaaactgcatttaaatttcaaagttgcgtgatacgggacatctctaaatttaaagtacactttcaaatatacatttaaattgcaaatatatgtgatactggacgtccctaaattaagaacactctagtctagactagactagaggtgcgataatgatgtcagagtagagacttcaaataaataacaaatgatgccaaaatttttttttacaggggctaattgagttgggtcacgatttaaatctcatcgtattcgtacctcgtttgcaaagcaggcagcagagcaacctcatcaactgtaatagcttacgctctctctgtatctgccatatccaccgtgagcactctccttgattatctgtaatcacaagatcactccggttcacctatttctgaaaggatagctgcatccacattgaccaattaaacaatagtaattgatggtccaatcctagctatatactacagagaaaacaaggattaccttagtaagaaggaacttggacctgttcaccgaattctctcccaaatatttttgtggattactcgaacagtgactttccttatgtaattgatcttcagaagatctttacttggttccccaccttttcgccgaagcttctctatgagatcctcgcttacttgttcaagatgaagttcctccagagctgctaggtgctcaatgccatcaggaattgtcatcagttctggacagtcacgaagtgttagccttgcaaggctttgcattgcactttcttctatttcaatttgtctgagatttggagcatcccacactcgtaatgtccggagtttcgggaaggattctgcacaaaaatgcagtttctccccttcaaaagctctcataaggtgaagaaagcatagaccatgcaacatctgaaggctgtaaagagagtcttggtcaagctttgagaatgccattaccaacttggataggttgtggaggtgtgataaggatgatagactctgatggattgactccttctccagctgccccttcagttcgagaatcgagagagttggaggcaaacgaagtgcttccactttcaacacttgttcgtcatctaacgctgaaatcctcaaatggacaagatggatcatcttcatgatagagttgcataatccagaaaagtgttcagttcttgtgttggcaacaccaaggtttcttatctctgtgaaaacaccgaggtgactcaaaattgtttcatttgactcaacatactgaagtgagtgcaatcctgtcaagtgcactatgccttcaggaacccttgttccagtgaaaactgcgactttgtacttgtcctctaaaaataaattgccaacatacaggtatcgcaacttccggagcttcgctataacttttgggatagtcgataatccagcattaaacacatccaaaacctctaagttctgcaatcgtccaatttcctcggagagaatttcaataccagtatgcctaaggcacaagaaacgaagattaaacaagttaaatatctcattcggcagtgacttgatacgaacacgtgacaaatccaaagtagacagcatgttcgaacatttcaggaaggaattcaacaggtgaatgcagatatcgttattgaaaacatacagtgcacggagatgatgagtcgcccctgataaactcaattgttcaatgtctgcacattggattgataagcgacgtgctccctctactgaaaatgttctagttccatcaaaaattgtacagaagcattcctcgtttgctttggtgatggcaagaatccggataatatcatgcattctacaaccggtcactttcccagccacattcatgtccactacctgaagtaggcttcgatttacaagttcattaaggtatccctctgcaacttcttcaaatgtcttattctccttttccggtataaatccagcagacatccagtgccttgttaccttacccctttttattttataatcctctggatataatgcacacagcagaaaacaattcttgagattgtatgggaggtcctctaagctgactttcaggataatattgacatcaattatcacattattcgtcagctgcacctccaactcattatacacatcttcccactcagaataagtaggggttttgcacgataacaggcggccgatgcatgcaattgcaatgggcaaacctttacacctgtccacaaatttgtgagctagagtctctatatctgctgggcatattttctgttcatgtttccaaaatgcttccttgcaaaacagttgccatgaatgctcctcttctagaggtttcatttctattatacaattttttgttgctagcaatgctacctgatgatttcttgaggtaataacaaatcggctgtttttatccataggaaatgcatcccttatattgaaccacacatcaacaccccaaacatcatcgagaattagaaggtatcttttaccttgtaaatggttatgaatattctccatcaacttggtagcattggaaggtatgccaaattcactagtaatatgcttcagcaaatcctcaacttggtagctgtttgagacagttaaccatgcagtagcatcaaagtccactttaatagtgtggtacacatgggaaactaaagtggtcttacccactccacccatcccccaaactgttgtaatcatactactctgttccaaatcatctccgagccaattcaacagcaactccttattcgtcttgatccccacaaggttgtcttctcttgcaacataaaaggcttcatatttatattttgaatgatcagtgctcctcctagctgattcttggtcaaaacctctcatgatgtaccgaacattcctcctatcagctctttcaagcttggccttgatctcatgcagcttgtgcgcaagacggtgccaggtcttaacatgggtgatcctcttcttcatcttggctgcaatccctccatgcctgtcgttcagcttgtaggtgaactcatcgacgacatcctcgatctcgaaagtgaggccccgcattttcttgacgaaaatgccggttgtctcatccgtgtccttgaaccgctcaacgccatggagaaaggcttgcatgctctccagttcctccttgacctcatggatctcaccaaagagccttgcaagagcagacgcttcatggcagacaattgatgaggcgaagctagctgcctcatttgctaaggcagaacccaacttcccaatcagggctcctacaacgccttcagccatggagttatgcttcgacctgagagttgagagtgctagctacttcaaagttcggtagagccagtgttgacaggaggaagatgacacagtgagggggcgcttttcaggactatcaaataccaaatgcgaatcattattgaggaagtttcgtagacatttcctgaacaattattcaaaaggggtatcttctattcaaatgtcatataccccagtctttaggatacatggagacgttatgttaaacttcggagagtattgtgctccattcatttgttcagtttacaaatgatatcattttcagtgctctgacgtcttgacaaggatttaattttcacttggctaaaccgtggtgacgtggtggtcggcatgcagaaataagcaaatcaatggtacacaggatgctctttgacggcattttcatctacacgttgctggaatatttggctgcagggtaacgacaggattttcaataatagtttttactccttagtaacaatagtttttactccttagtttttactctttttagggatgccgtacactgaaagacgaaaaaaaaaagtaacacaatagttaaaggagcatggtagtacgtaaatatttttagaggcaccaaaagagacaaattaaagcaactaaaaaatgagaagcctcgatcccaacctgagtccatcatgtgatcggaagggcctcttgtctggcagcaagctagaatcatctgtttggtattgtcactacaaaaaaaaaaagaaaaaaaaaagaaaaagcaacattgtgccagctggggaaaccacatagatactagatttcccagccgacgcccagcagacggcacgatgaggcagaacaaaagtgccagtttttagaaccgtcacttttgagcttccatgcatataaaaaaaaaaggccagttcaatgcatcggcttgattcgagcggatgcatcaagcggctcgagtagctcccgatcgccaacacccaagaacacaatcacataatcaacattgaaaaaaacaaaatcaatatccaatgccatccccagataccaccgtcgcctctgctcccgtcatcgatggtgaatgcagtcacccactgttagttgattttatcggctaatgccggttagttaggagaaggttaaaatcccaccggttttcttatcctaacaagaaacaaactaagagataaatctgttttgtgtgatcggtacaaaatagattcgaattttagattgagataagccctcgagccccaccagtgtcgcttatataaagaaagagaaggagggaggcagggtgacgactcgactctctctaatctcaaaccctaaatcaatcgcccgatcgattagacaatggaagaggttcgtgaggtatctctagaagaagaagaaagaagaacagcaatggcttcaaacacaggtcagtagatcaattaatttccacataagcaagaggtgatcatgtttaggctaagactcaatgaattaattggattaaattccaacattgtgatatcagagcttagcttagccttcatgttccctcataatcacatgatccctgtgattagaagccacccttacaaagttcaagattgattcggcctgaacaattttgaattagattagattaatttttttaagtcttggttgcatattaagccatgctatactgttggtctcggtcaacagtagaagaagcaaagttattgaagaatttaatttcgttgcttagtagtagaatttaagagaagaagaggattgggataagcgagattgaaattcccaattctcacactaggaattcctagactgaagctaagctttcggctagcactcagcaaacaagaaagaggataaactagattgaaattccccactattaagcaaagggaataaacaagattgaaatttcccgaaattcccaataaggcggagcaaatcggcccaaaatccccaaaattcgaagaaccctaatttttgttttaagaaccctaagaccaaaacctgaattaaatccaaattaaactcaagattagggttttgagttcgggaatttaccggattttgaagcccctaaatccaccggaatttttccgggaagcggcatcgccgccacttcacctccttgcggccgcgtcggtcttctcgtgcgcgtgccatcttggaccgtccctcgccgggaatgggaagcatcagcttggcgtcgcctccttggcttcttccccctcaatttcctcgcaaggggaaataaaattgcctctatgtcctatgtatgctactcttgaaattttcttgtgtaagttctttgcaagaaatagggacatgcttaatgtcctgattcaagaaagtagttaaataagaagattaatagcattattttgggttgaatcattatgaaacgttgtcgaaattatggccttatttttcggccatatttctaggggagaatatacgtctcattaaggtcgagacacttcacccatagaaatttttgacatctatcattactgagatgataattcgctaagaaaagctaaagtaaaatcaagtgattcaagttcataaggtattatgcttccattacataaattataaaatcagtgggagctcatcaagagctctaataagagaagattattctaccttatttatgactcatagctccattatgtggatgctagaattttgtatctcttaatttgtgacttgcacaattaaatatacataacatagcttgagagttttgttatggaaagacaagtcacatatagggtgcagacacaagaaatccatttgtggacttaatcaaacattgatgatgttttaaattccgctgtgtcattagtgaactaagcttaaacaagaatgaggagaataattattctataatgatggaagtaagacgtctttgaatttgtgtcattgtcgcttatgtcacataactaggggagtttgaaacgtctcatgaggtagagatattctttcccttagattttaatggcgttgtttagctttaagtgaaaatttcactaagttaagaaattagccaacaaatgatcatttatggctatgtttacccataagcgacctcccatttcctttaagaaatttaagacactaatgctaaaatcaaatgaagttatgagattggattatggtgctaaacactaaataaagcttgttcaccttattagacattaaaaataaacgttcatccaaatggttttcgaaccatgtaagaataaattgagatggatgaacaaaataagacattaaagtgttcatctaaatggttttcgaaccatataagaataattgagattgatgaataaaataaagaatttagtagaagtttctaaatgagtcaaaatgtttaggctatgactcaattaattaattggattaaattccaacacccccaagcacgtggtggcagatcgacaagccccgagctcgcattggtggatctgcccaggcccgtgctcatggcgacaaatccggccaccctagtgggtggaggaacaggtgtaggaaagcacggcgtacaaagagcgcaccagctagagcccgcgccattcaccgtgccttcaaaccatctatatcgaagaggtggaatgaagagggcggggggggggggggggagagaagggagcaagtcggtgaaaacacgtgagggggagaggatacgctcgagataaagcgctcggctcctcttccattcactcgacaaaatttctaaatctccggttcggtcagtttatgtgccggattttttaaaaaaaccagcacacacatttataatggtcttttcatcttgtggattatgtaagcgtcatctagaccaaaatttggcacctttggttcccggtaaacagcaatagcgaactcttgggtgaatacaaacatttccatgttcatgtacggtgtagatcagaacatctccggtctgagattggactgcgaactttctaatgatttaattcattttggataatttttagaccaaattttaattaagtgatttgaataatcatgcacagtatagtgcttcaatgagagagggagaccaccttctcagggattgtagggtcccccggagcaaaggtaagttagttgtttttatggatgcaaaaagctatgttgttccgtgggaatcttccattgattgaatggattggttgggtatagctattctttagtctaatatgtaaaattatcctttagtaaagtcaaactatctgcagcgaggtaattttagataatgaaaccattctattatctctactattataaaagtttaagatgtttttgcataacttttcgtacgtcagccaattccgaatcggtgtacgtctgggtattttgccttgtgtttttcgtctccctcggatcagcttactatccgattaatttccatatccgtaactgcgctcgcgtatgaaaaagccccgcctggcccaagctaccaactgggcagcccatgaactgctcctgtcaggcacaagtttgcagtccgcacaccacagcacacgtgcatatgcaaatcgacatcttaggccaatctgccgttgtcctcaagtcagcccgtgcatgcacgttgaccaagtcattaggataagcaccagtaacctagaccaagccgtcctcttgtttatctttactattataaaaattgaaaatatttttgtcggtattttgttatgttatctgtgtttgagtcagtttttaaattcgtgcgcgtttgaaaatatagatccatatttgagttggattttaagcttgtttgcttttgaaaatataaaaggagttgtataagaaatctctttaaaaaaaactcgcatgctaacttaagatgaaatacatactcctcattgcagctcatgattttctaaaaaaatatatatcaaagagaattcctacagtcaattttgccctacctaaaccgtataacaataacaaaattaaaatagcatttacccgttgcaacgcacgggcattttttctagttactactaatgcagaaaaatacgacctctctatacgagacaagaccacccctccggactcagcagaaccctaatacctcagttgtcaaaaacaatctagtacttgttttttcttcatgcctagggttatgttagtagtaatgtagttctctttgttgatacgtttgttaatcatctgttcatttccaccaatgtaatatactccctccgtttcataatgtaagtcattctatcatttctcacattcatagtgatgttaatgaatctagacatatacatccatctaaattcattaacatcaatatgaatgtaggaaatgctagaataacttatattgtgaaatggaggaagtagttctcttcgctgatactacctccgtttcaggttataagactttctagcgttgcccacattcatataaatgttaatgaatctaggcacatatatatgtctagattcattaacatatatatgaatgtggacaatgctagaaagtcttataatatgaaacggaggaagtatgtcctaaaattcatccatgcaacttcacgagagcatgatagctatcaattctcatatactagatgataccccgtgtgttactacatactattcatatgtgcaatgcagttataaaatgttaatgcatagaaataagtaatattatgaacctataaaacatctcacatatgaaaagtaaaatacttcttatagtgatttttatagcatactacactaagtggtgaatgaatgttgagttgcctcataataaatgaaaaataataaccgttaatatttaatatcctattggattaatcatgaaaatgatccaatggctcttgttttgtggatgatgtggctcaatgcatgtttaacttttatgtttagtttttttgccaactatataggatatatagattggtgagttctcgccattctgacatactgtgaggtgtcatattttgtacgataaactcggtttctcgataccttgtaaaattttagttttggttgtattgctacttaagacttaaggaccataaacttttctcgtatatatacacacacgcaagcatttaactcaggaaaagttgaacgatttgaagcagcggatgtacaataatttcaaattgttctgatttaagcaaataaagaaaccagggccggcaatcagtgttgcattagtctccgtcgaatgccgagtagatgatcgacgacttgtgaggccaggtgtctcgttgacacacgaagcaaggacaccctaatatcttagagaaatatattctgcaaactactccatccgtttctaaatatttgacaccattgaccttttagcacatatttgaccgttcgtcttattcaaaaatttttgtgaaatatgtaaaactatatgtatacatataagtatatttaacaatgaatcaaatgatatgaaaagtaattattatttgaattagacgaacggtcaaacatatttaaaaaagtcaatggcgtaaaatatttagaaacgggagagtatataatatgcgaatggggcaaaatatattattgcacgagataacgatatgtactaggccagatgttaactgcacataggatgatatttttaaactctcgacgatttcattcatgccagcgatcgaagtcgacctatattttaactaggctaatttaatcatgagaaaacctcacctaatatgattcaagttgcacaaaatcacagtgatattgggacgtgacatataacttgcgtattatggtcataaagttttacaagaccacaccattaatcattttgacatatttctatatcaaaatacaaaaggatagatataacatttatactatatatggataaacatgccataaatttgagatgtgattaattttataccttaaaatatagaaaaattatgaataatgcggttttgtaaaactttatgactataatatctatggttttgtaaaactttatgactataatatcttcaacattggtttgaagtttatgaattcatcaatataggaacattgggacaagctaaacctcaatgagagggtataatgccacatacacgcatgtattggacctagttgttgcatggattgtgtaagacaaaagcattgacccatctaaaggttatgcgaagttcgaactgatttgaacagaacaaacatcttcttcctaaagtcattctctttccttctctcccctagcccccttattccctgcagtgtgtaaatcccatatcttttttgagaattacacagtacaacgcagacactcacaatgcacgcacactcatccctatgaatgcacgcacgcaaccctacccctatgaacatcttcgaagactgggcggcaaatcctgaagattgacgaagtcatcacaggcgcctcgttgtcgacggcaaactcctattagtagagtttcgtgttactcatgttaattatatggtgttggcgtgtggtcagttctacaaagagagtttaagatagattcagaccaaaatacaaacttatgtgtttcgaaacctttggttcaattgttatttcatatgaagcttggaacgaaaatgtattgtggtgcaatactaacgagggtttattcatcagaagagatgggcttctgcaagttaaggtgttacagaaccactagttcttattttgatattgcatttctccgactaaagggtttcgggaggtaaggtggggatgttgtataaccgttgattcttaatggtagcatgtcacacaccaatatgttatctttaccgaaatagagatgtgagacaagatgtaaaatcaaggagttgatttagatttgtgtgatgaaaacattggtggtatgcgatattctttatgtgaaagactggtctcttgtgatgagatttcggagtttaatagatgattggttttgtcaagtgatggttgctgttggccttggcggtcagactggccgggtgccatcagtcataccgcatgttatgcggcagtcaaatcagcgaacctgacggtctaaccggcgggattctattcgatgtcagtttcaggttgtcttgtcggttttggatattacccattttgatgtagatcggtctaacaggagtagatgtgccggtctgactgcttgaagacctcctgtctaactagtgtagttgctctagtttgtccgcctgtcgccgccgctggtctgaccgccatggagccgtcggtctgaccgggccgatgacgtcgatctgaccgcccatgtcccaccgattggaccatcgcacctgagaaaacacaaatcgaagatctctcaaaagtagattgaactttattacttctattcgtgtttacaaagtgcaataataacactcctctcaaaactctcaactaaactcgaaaccctaacttttctctaagctcaactccccctctttctatttatacctgaggtaagtagcataaagccacgaacccaacttgtacaagaagtcctataacttaggaaaactttcgtacaagaaacaatcttttgaaactccaatcacatcaaatttggacttcttccaaattcgactccacatcccatatgcacacattatctccatcgtataccatatgaaatcttcaccaaccacgcatattgatatttagcctaagcatctcgcatgatatcctaatcatccagacgtcatcttctcccaaaatgactcccgatccatcaccggcaaacactctccggaggtatatcaagacttacccacacatgaatcaaccaagaaaccatatctgagcacatgttctctccaacttgagtcaacattagcacacaattgtatcacatacgcatagtatcgatctagaagtcataaacatgaaccaatcatgagtatccaaataaacaacccgaaactgaaactgacacagagccggccggtcagaccatcacgccggctagtctgaccggcctagtccatccgatctaaccggttacacaatcagcaacccatttcgccaattatctccaaatattaaaatccaatcatcacgcatgctaattattcatcacaaagtaataatcaaacacactttgattctacagttttcttctcttacaaagtcatatttaccttagttttatctttccatgattaatctatgttgtctaccttcttttctttctctcattgagccatatcacctcaagcttatttttgaatgatcaatctatatatgatttaagtggttataaaccacatcatcttaattgcttatagatttctctcagtagtcaatcaactatgaaaattataaaaattacataaagttacgtcgtctagctaccttacatgttatttatactattgtcatacaaaacttccgtagtaacgcatagggtttcatacagttatctaaatatcaatgatcatccaaaataagctagaatcatttctctagcaacgccatgtcatcctcaatgagttcacttttatgttcatagagtacaatatagttgcaagctaataagttctaacttaaataacaaccaatgaaattatcttgaaccttatccacccatggttacaaataaagtaaacattaatgatgaattaatagctgtcatctcgagcatattcatttaatttctgtcatttttagtcttccgaagtactataaataaacatattttgaccctgccttcctaccctcaattagtcactcaagttttcacaatggtttgcaagattgtaatagttgtctacgtgttcatattcgcgctcctcttctcccatggtaagtattcaacacttgttaaatcgtcgtttctacccacagggctctcccatgcatgatataatatatcttctcccatgcaaagatatccgcctatgtaaatatattttcccgatgggttcttgatgcacttgcaaaaatttaagatttacatagtccctggttgtaggcagagaggaaaactccgtgtaaacataggtgcatgtacttttataccctcatcaatcgatatttaattgatgcttgttccaacacaggaatgtcgctcaacgagcattgcgataatg

SEQ ID NO: 61195 - DNA, 2927 bp, Oryza sativa
agcaagatttagaagggctatttaatagcttggaggatccaaacaaggccatcggtacgatgctcgatgagcattgtgatcagggatggagctagaattttgagtcattggggtcagacctgtacaatatacaaacgttgtgtttggaaggtatttagtttgggagcattgtagtataaagtcacgtacactagattcaaaaaaattagcttagaactatgagtggtttaagattatttcagtgaggtttagtttaagattatttcagtgaggtttaaattactttatttaaaactatctaagaatttgtgagtgggagccattgaaaagttggggctaacaaacgcttaggctgtgttcgggaggtatgtttctcacctcctatgcatgcaaaagggagcaacgcattttcttataattaattaagtatttactaatttttctaaaaaatgaattaatatgattttctaaagcaacttttgtattttttatttggcaaaatatacaccgtttagtagtttgaaaagcgtacgcacggaaaacgagtgagatgagtagggaaagttaggcaaagaactcagccttaattccttcggcaattttttgtttgctaatttaaaggcctaatgtgtagtagttgattactagcaaattaaactactaatctaattgcatggatcgatcggatagacacagtacatagctaaaattgctaacttgttaacagatcaaatatggtaaagctggctgggcaacgatccataacctacatgttagatattaattaatatgcgctgatacaccaatttaattgggactcgggagtagtgagtgcataaattttcaaagaactgagcaaactgttttaacgttttcctctgtgactgagatttctgttcggcaggcttcagcttctggggtcaccgcctacaaaatgctgacgaatacacagggttggctaagtccatcagggtcatctgacccagagctacgtacaactgtggatccgcccctgattgcgataatgaacgtgcacccgctccaactggctgtccaggaggacacttcaactgtcgccaagtttgtatccaaaacgggtacaagggtgggtattgcctagataattgctagcaagagaaactgcaggtcggccgaagcaaattgctccttgaacatgcatgagaggatggatgtagtagtacgccaccttggaaagagttgaaatttcatagaagattttttttttctttgtatcttggtatttaattgttggtttgtttgtgattgataaatccaatttttgattcttatgttgctagtcgatttctcaaacggccgtgaaactagctaagttttgagaagaattcataaagagcaaagggtcatcgttcttttcttccatgccttcatacttaatgtgctctctatctttacctgaattaaatttgaaaatatactgttaattcaatttgttattagaaatattcgggatgcaaaatctttcgcacaaatataccatcggtctcgcacaaccattgcacgaaaataatgttgaaatgacgtcgtgaccggtatcgcgcagcggtctcgctcaagcaaacagcgataccactcaagcaatcaacgctatcgctcacgcaaagagcgataccgtgccttgccgatttaattagcagttaattatcttgattagcgattaattagttaggataattaaacactaattattattagttaattgttaattatgtacttaatcactaatcaaatagatcccattgaacagtgtcgctgatggcttctgcgagaccattcggtctcgctcttccattccgcgagaccgcacggtctcgcactgctgccgcgcgagatcatgtctcgcgctttcgccgtggatatcgtccacgatgtcatccccacgtcattttcgtgcaacggaattgcgacactgatgatatatttctgcacaagtttttgcatcccgaatattcctaagaaaaaattgaatgaacagtatatttttaaatttaattcatctctacctcactcagtcattgatagtgttggcaaagctagaagatgcagcctgtggaggggttagccataaattcaagaaatccatggataaagtttgtcaaccactgagaaaagcggtttagggaaacctagggctggatatcgagctggctcggctcggctcggctcggctcggtcaggctcggtaagataacgagctggctcggctcggctcgttaaccctaacgagctaaaaagctagctcggctcggctcggcaaaaagctcgagctagctcgtttggctcgtgagccagggacaaaaaaatgtaaaatgtaaactaccatacatttcaatgagtcatataacacatatttatccatcatgcaggctagcagcaagcatcatgcgcatacacgcaatagagtacaaattaggtccatcgtccatgtctccatcacatattcatctatcaactatcatccatgcaaattgcaaagtacgactacatcagctagacaggaagggcgcataaacataactacataagttaacatagcagaatgacacattgtttaagttccatcattctgtatttccatgcaaacacacaaaaggcatggtcagttaacacttctcatccatggtaaaatgtctctccttcagtcctcctccctttcctatagggtcaataatagtacaacaaacagcactgtgttaacaagatgataagcaacaacaacaagccaacaaataacaaaaaaaggacaataagcacatatacccactagacactaattgcttgccaccacgcattttgggaattcaatagactcaacatcatcttcaccatctccaatctaaataaatatagacaaatattagtatgtcacaagacaaataaagtcaaac

SEQ ID NO: 61196 - DNA, 8172 bp, Oryza sativa
tatcttgactgctattatttccagctaatctaatatgtcaagtttcagatgtgaacaaattaattttagtttcgcagttgcttattatttggatggagtatttggtgaatctaaggtctgatttggaatgtacaaatttaggacaacttctgtggaaattgaactaatttacacgaaactcttgaaaaattcctaccttttctaaaggaggcctaaaaattttggactcaaccacctcctccccaaagagataacattaccttgatttttacaaccattgctttctcaaaatttcccagttttttatttcatattttactcccatgtttatatttctgggtcatgtgcagcccattagggctgaaagcagcaggcgacctccctagggccagcagcactgcaggttaacagtaccattgtggttatcattcatgcgtggttactgtttacagtcggtgttcaaattaaaggtagaaatgagatcgattagttagctacttcctctgttccgtattataagtcattttaggtttgtcctaagtcaaacttctttaagtttggtcaagtactaatattttcaacacagaacagatgtactacaataatatattcaatggttgattcaatttgaggttgtagatgttgctacatttttctataaaattcgttaaacttgaagaagtttgacttaggacgaacccaatatggaatggagggagtgtttccttaaacttagcgatatgtgccttaagagtcaagttatcccatctgtatgaagataggggttatatcctctttctcccttgcccttgtggtgcactgcctcaatggcattttcatgatacttgggtccagggacaccttacttggactgagggttctagtcccagcatgctcattatattatatataaacgttgtacaagtagcaacgatcatgaatacacaacataactttatatatggttgtaagtaaagcatgcaataaacttgtaaccattatctgttaagtttcgttgtaaataattggactggtgcatgagaagttccaccattagaattgaatatatatcatttcacatttagtttcagggtcaggcactatgtacccaactacccattttatagttcattatgttgagatttcagcagtatgccaagctaatctccaaatttattcagcaggtgaggtgaagaacacaattagatagcacttcccattgagaaagtatggcagaagctgcagtagtccaggccctcatcaagattggcacgacttttggagacgcggcattgcaatcgctcaaagacatcataaagaaagaagtagctctgttacaggaactaccagagctcgcaaaatccattgggagggaactggacatgatcaatagcttccttatgcaagtgcgggcgaagatccacagcactgacaatgaagttctgaaacgctgggtggtgagagtacgccaggtggcctaccatgttgaggacataatagatgagtactcctacaatgttgctctgctgcaggaggaaagctatttaagtagaatgatgcgtgcgacctactatggtgtaactttccatggcattgctactggactgaaagatgtacaaaatgatatcaagcaattgtcggatactaagacaaaatttgcagagttcttcaatgagttacatagcaacactggtagtaacacacaatctcatctatcacgtgatagatccctccatacagttaaagaaggtattgttggtatgacagaagaggtagatttactgaattcatggttatcacccaatgatctcactagagtagttttatctgtgtggggtctgtttgggctggggaaaacaactctggtgagaaaggtgtatgaatctgtgaaagagcagaagatctttgactgctattcttggattgaggtaccacacgagtacaacaatgatgtaatgttaaggcagttaataagggacctatcacaagaccaaagccaaatacctggaaacctggacagtatgtatggcagccagctggttgatatattatgtgtggtgttatccggcagaaggtacttgattgtgctcgataatgtctgggatgccgatgcatttcatggcatatcaagctttttgatcgacaatggtaatgctagtcggataatcatcacgactaggacaagtgatgttgcttcactggctcaagacacatacaagctcaagcttaagcccttgggtgatgaggctgcaatggaactattttgcagaagggcttttcataataaagacatgagatgccccccacacctgaaggatctgtgcgaacagattgtgagaaagtgtggtggcttaccatcggccatctatgctataggcaatgtgcttgctgtcagagaacagacagaagtagcatggaaaataatgaatgatcagttccagtgtatgttagaggacaaccctggcttgggagaagtgaggagtgccctgagtgttagcatcttgttccttccaaggcatctcaagaactgcttcctctattgcagcttgttcccacagaactaccggttgtcacgtgaaagccttgtgaagctgtggacagcagaaggattcataacgaagagaggaagcagcactctggaagaagttgcagatgaatacctgatggagctgatccgaggaagcttgttgcaactcctggagacagatgaaattggcagagtagccttctgcaagatgcatgacattgtgcgtgacttggctctgtcctactccagaaaggagatgtttggcctgagtgatggagacctccaaacagatcaaaaggaagatgttcgtcgcctgtcaatatccaagtgcaacaagaatgtgggatcaatcttggagtttcctcgccttcggaccttcgtcgctaccaatggaggcgcagagtcagacctgttacattctctcatacaaaaatcgaagtaccttgctgttctggagctgcaagactcacccatcgacataattccagcaaatattggagagttgttcaacctgcactatcttggattgcggaggaccaatgtgaaatcacttccaaaatctatcgagaaacttaccaatctggagactctggacctgaaatacaccggggtagatgtgctgcccaaggagatctgtaaactgaagaagctgaggcacttgttcgccgagaaactcattgaccgtaatcgccaagtgttcagatacttcaaaggtatgcagctgccacatggattttcacacatgaatgaaattcaaacccttgaaacagttgaggcaacgaaggactccattgagctgctggggaagctgactgcactgagaaccctgtgggttgagaatgtgcatcgcgctgactgcacaaagttgtttgattcattgtcagaaatggagaatctctcaagcctgctcgttagtgccagcgatgaatatgaggtccttaactttgatgcattcagtccttctgagatgaagctccagaagctcatcattagaggctgcctcgagaatgacacatttgacaagcttatgttcaaaaaccttggctcacacatcaaatacttgtcactaagttcctcgagactcggcaatgatccgttcccgctcctcgcaaagaacatgaagaacctcatctacctgagcatcaggaagtggtgctgtgctgaggaggtggctctccgtgaagggtggttccctcgcctgacaacactcttccttggtgacatgaagcaggtgcacactattgtcatcgagccgtcagcggttgagagcttggaggcgctgtacttggtttctctgacggctatgacagcggttccgacaggcttggagctcgttgggtcgctcaggaagctcgttgtgtgggggcagtcagacgatttcaagctggagtggaagagggagaactgggaaacgaagctgcgccatattccggaaattcgcatttaattgatcaagaactgcttaaaatatggatggattatatcttgcatgactactgaatcggtctctggactgattcctcctgctttggttccacctgagtgtgatttgtttctctttgtctgaattttacgtttgtaatatgtctgaagttactgaacttctatgatgtaatctaaattctgaattttcttgtaccaaactaccgattcttgtttgtgtactacatatattgcttcttaaggtccgtttggtatggctccaaactccaattcctagctcctaacttcaattctagctagaacactcttataggagctgaagtgggtgtgaaagtgtttggataaattggctagcttcacgccaccacgttccttgttagcatttcatcgaacacctagttggcgtcgccctgccgctgccgccaccattcaacccgcacgccgccgctcacccccgtcccccgccgccggcggttagcccatgggctgccgcggccgccgcacgcataccaccccgttgctcgcgcaggtctacccgcacgcatgctcgtccagccgctcgcgcccctcccgtgcgccgcctgcctcctcggcggccgccattgcacacgcgccacgcctccgctaccagtgcgcctgcagtgaggagagagaacaagagtacaggggtgtgaaagggggagttgagtggtatttttgtataaatagactaaaaaataaaaggctagttggtcttttggggtgaagtgaagctgtggagcagtaaaaacccagatccacccccatagtaaaaattagtggagcagctctcccaactttgttccaaaaaaatagtgaatctgtaccgtttggcacagcttcagctctaggtaagttggagttcggagttataactgtatagtgtcaaactgggccttatataaagctgtgaagcttcgtgttataagacctaacaaattttgattgttgcacctgatttatatgctacctgttgtttaggctttgttaatgtagttaagtgagaatatatatatatatatatatagtaaatttgtttggtgctccaaggtgcccgggcaccattgttgaaattgagcatatacccaattcaaatgagtatgaaactttttcaattacttaggtattaatattaactactttactaactagttcaaaacaaatttgaactgaatttgaacttgtttttgttagattttgattctaggtatatagtatctatacatataattagttaggtatgtaatcatggattatgaaataaagttaaatttgagttgttttgttgataagtataggtatgaatcaaattattataactaggtatatactcacaatttgaaaattttgaaaaatttgagtgattttgtgcatttgataccatggtgcccgggcaccatggtgccccatatgagtgtcatatatatatatatatatatatatatatatatatatatatatatatataactgtgcttttgtgaagcacccccgcccaaaaaacctgatttatgaaatttggtcttgaataaaatcctgaaactttaataccacacgtattgctttcagatcgcctataattatcagttactgatggtagcttttggagtactttcatttgtctcgtttctgcttgtacctgctgcagtcttataataaaacccccaaggtccttttgaaacaaaggatttgcagataagttttgtaggatttaaatcctactgaaaattttccattttgactgctcgtggattttagaggaaagttagcaagtgctttaaccttgtatttccgcggcctgtttaaacatctcgtatttcttttttgtgttttgtaattctctattttgcatatgcatttcttttgaaagtctttccgtttctatattttctcaatacttcaatccgaaggagtcctaaaataaaattctgaaatttaaatgcaacttatcaatcctacatgagaaattctgttaccaaagtacttactccatataagcttcacataggacagaggaagtctgttatataacttatgcaagtttttcataggaacagcattattttgcattccaagattggtttccctagggctggacggaaaactcgaagctcgttagctcgctcggctcgtagcaggctcggctcgactcgactcggctcattaggataacgagccgagccgagccaagattttagctcgttagtataacgagccgagccgagctaactcgcgagctgctcgcgagctgaacgagctgcgctttctggactgcaggccgcatccacctgtgtccgcaggccacaacccagtagcccaaaagcccccccagcccacacgcacatataggagaaaaaaaaaccctaagcctcttgcccttctcacttcctcagtcctcagagtctcacgcgtggccgcacaggcacctggccgccgcaagcttgcggctagggttactgcaacagcgccagcacgcgacgcggcgcgccggcgccgcgaccagcgcctctccgtccgtgagtccacgagcaggtccggttccgatcctcactcggtcactcatctttcctttttcctctagatagatctacatttgctgattgccgaactgctactaaactgctgactactatgctccaggtccaagccctcagtcggggtcgcagccatggagggtgagaataatgcatcgccgcatcctccaagtttggagtcgaggagtaagcttcgtggacgacgaggaacaagcactcggtcttcatcgaatcccactgtgtccttggaagtggtggtatgttatctaatttaaaattgctagttcgtacagtatagacttgaatgttgatttaattattgctatccagagtgctgtccagattatttagttacttccatgtagatgtagataatgaatttatccccaaaaatgaagaatgtcacacttaattttaatgcaatggcaacgattcagctatacattaatacatgtatatttccttatgcagccattggagaaagtttcagaagatgaagacgatgataacagcttcgaccatagggatgatatgtctgaaagcctacctacagttgatggtggaagtggaagccagaagggtgatgatgagtttgatgatggtggatcaaaggctaagaaggcaaagacaggagggaaaaaagctggtgttacagtgtctcccaagtgcaagatagcaagaggcaaaagagctgagtgctggaaacattttaaggttatcaatgtcccatccaagaaggagagaggtgtcatggtgacaaaggcaaagtgtaagttctgccatagaagctatgtgtatcatccaggtggtgctacaacaactctgaaccggcacctggctggttgcacacaatatcagaacaagttgacaaaggctaaagctcaaggtacactaaactttggtccagaagatgacaactctcttattgttaatcctactgagtataatcatgagcacactagagaactgattgccaagatgataattgctcatgagtattcatttcggatggtagaacataaatggtttaatatcttgatgaaatggatgaatggtaactacgagtttattggtaggaagtctataaaaaatgaatgcatgagggtttatgaatctgaaaaaaatcaacaaaagaggagtttgaaagaggcataatcaataagtttaaccactgatttatggacgtctaatcaaaaccttcagtacatgtgtttggtggcacattatatagatgagaattgggttatgcaatgccgtgtcttgaactttatcgaggtggatcctccccacactggaattgtcatagcttaggctgtttttgaatgtatggtagaatggaaaatagaagacaaggtcacaacaataactcttgataatgctacaaacaatgatactgctgttacaaatttgaaggcaaagcttcttgctagaaagaattcagtatttgatcctagttacattcatattcgttgtgctgctcacatagtcaatttggttgttaatgatggccttcaaccaatagataatttgataagttgcttgaggaacacagtgaaatactttaagaggtctccatctcgcatgtataagtttgtggaagtatgcaacaattattctgtcaaagtgggcaggggtttagctctggatgtta

SEQ ID NO: 61197 - DNA, 4295 bp, Oryza sativa
attatacaaatacacttgttcaacttgctccaagacagttattgacatgatacatcagtgaacgttgttagatcaagaggtatctatttcttctctacagattatatgtgaagtggcatggacgtcatgcaaacttggtaatgactactaactgaaaagataagcatattcacacagctgtgctcctgctaccgctttcatggctcaagtttctgttttttggtttgctgttacttcacactgtgcaaagtgcaaaagcaggaattgtttcaattcttaggaattgtttcaattcttctgttcagatatgcctgatcattgtgcaaactactattttgtcctgtgtttttgcggtgagcatttgtaagcatcttgtgttgtcctcttattttcagccaaacaaaacggatttgaggttttgtaagtatattgtgttggcctcttattttcagccaaacaaaacgggtattaagtccagatccagcaagctgggccatatgggggacacgtagacttattgggctaccgggctcttttgaaatgacaaaacgggcttttaaaaaattacctaacccaacaaaatgatcggagacaagtacaccacgcacatcatgctctacgcgcacgtgaggacaggcaggggatgagcgacacgtgggggtatcctgcggtagaaaattcggctgcaaactaaaattttttcagctggctgtcagctactccctccgctcaaaaagagacaacctaagtggagatttgacctcacctaaaacaacgaatctggacataaggttatctttggggggggggacggagggagtagacagtcccgaaattttcccctttttttctctgaaagaaaaaaagacggaaatttattcacattgcatgggagtaacaatgggcctgttcggctggctggtacagccactatacgcagccgttactactgcagctatagactcaacttactgtttgtaaagtaaagttaaatgcagccgaacaggcgcaatgtcgatagcaccgtaaaaacaacagtctgaaagactgaaacgcagactgtttctatggaaggttctggagatttcagaaagactcaagcaaaaatgaattttattttcataaattgacgaaatttaagtgaaaaagtaccggacgaagccgtgccaagccacagtgttcaaaacaagttgagctacgcaacaaaaacgagcgctcaaaagatctctctctgctctagaacgtttcaccaaagccattcgcatttggccacgtggtcgttttctcatctcaagataagccttcttctactacctaagcttcgagttctcttctccctcttcctcgctgcagcaatccaagacgaagctgagagaaagaagacgaatcgagagcaaaagctcaatctaagctcgcaagaaagctcgagtagcagccatggctttagcacccacgtctctccggtgctttctcaccggaaggccactgtgcagtgcgggcagcacggcggccgtgctcccggcgccgaagccgacgaggcggcggccatcggcgaggctctcgtgcagggcggccaatgaggcgccgtcgacgcggggtgatccttcggtgaagcttggcaagctggcgatggtcgcgctggccgccggagtgctcgcgctctcgcctgtcgacgatgccatggcggccaagtccggcgggagggtcggcgggcaggcgttccggtctgcgccacggtccgcgccacggccgtctggtccacggataaacaattcgaggtaataaacgatgattggttccatgtcaaatgaaaatttcatcacattcaccatggataaacaatgatttgttcaggctagttgttgtttctttcagtacgagatcgatcagattttgactgaatgttcacatcgtagtagtgttgattcatatcgatctctcaattcgttctcaactcgatcatgagcagctgaaagtctgaaccctcgaaagatcaaaattttcgtgatacgagtttctaatatctgaaggttgtatgctaatgttctgaatattcagtctggttgatttttaattttcagtacgaagatctgacttaactgaatgttacaattgtatgttttgctcatctcgatgatgaacagataaatgaaagtctgaaacctcgaaagataatggttttcttcatgatatatcaatttctgaaacctgaaggctgctgatgctctgaacattttgtgacgcattggcgcaggacgaacatctacatcaacccaccggtggcgccgcctctggtcggcggttacggctatggctacggctacggttggtcgccgttctcgttcttcgctcccggcccgagcgtggccgtcggtgtcggcggcggcttcgacacgctggtgctgttcatcgtgctcggaacgatcgttggcgctgtcaggcggtttctcaacaggaacgacgacgactacgatgattactgaattaattactgtgttgctgatactgttaggaacgatgtcatcagatcataccgtgtgtaatgtgatatagcgaggctattttttttcatgtcaattctaagggaacagatcggtaagctagaagtgaaatacattaattggtgcatgaggagcaacctgtatgtataattttgttcttgtggagtaaaacgagagtagatttgtatatctggagttaatcgatctgaaattgtctgaagaactgatggtttaatttgcaccagtgtttccctagtattgcagcgggcggtgcagcatgtcgtataattgtataaacatcacggcattcgtgtcagtttcaacaagccattagctaaaaccgtacgtagatcaattcacaaaattactgcccacctactaacaacaagcataagtgcagaagatatggggatttttttcacacaactagaaagataactcgcgcatcgtagattgtatttggaaaacttatatagatgggatatcaaccggatgatacctaccatgtttgaaaagcaatatttctcaataaattttctacatcgcattgcttagataatttttccaaactatttgctagcttataaaatatatgatatttaatacatccctataaataattatctatgatctcttcagtacatagctatatttaatttgtttagaaaccatttctaatttaaaagtaaggtgttttgtcttatttaattgaatgtttagtgtcatttttttaacaaatcaaaaaaaactattattattagtaaatgtgttttatttgtagaatcaagttagtcatccttttagttggttcttattgacgcaagttattacatacttagtatacactgctaccttagtgtggcttcttatatatgtaacaatatgtggaaaaactcatagtcctatggtatggtacagtatagatgtaaggccattaatatctaaacatttaaaaattgttatgaaaataaaacatgcaaaggttggtccaattttagtaaaaagtaagaactattttttttgaacttattagactttctccaaataattcaatttagtccttttggcatttggcattttacttctatcattatagatataatttaattattgtgcagttatatactccgtagaacgataaaatatatatcatttttttcataatttcataattgtttgaatgtcatggtaaagtaaaaaaaaatataaccccaaagtggcatatgaaaagttaaattacagtgaatatgggtttctaaatgtaaaacaatctaaagacatgaatggatcgcgtgatttagatgctatagttatttattttgtagtataagtttggcagcattgctcatagttatattcattttgcttttctgattgtaaatctaatttaaataatgaagttatgtacgattattattattattattattattattattattattattattattattattattaaaagtctaaaaataaaacccaaaatgacatttcttttcagagttgaattatagttaaatttgttcttcaatcgaaaatttagtcataagatataagcggatcaaaattagttatatgatttagattttataaaacataatttttgcttttctaactaataaaacatgaaaataggagaagtaacagggagaaaataggtcatatttttccttaaaaaaagtaacatacgtaagtacatacatgcctaggtgggcccaatgttaggaggtaactttttttctttaagataattataggggtaccgagctcgaatttcaattcaatgcccgg

SEQ ID NO: 61198 - DNA, 1118 bp, Oryza sativa
  unsure (1)..(1118): unsure at all n locations
ttgggcgacttgaatgctttgatatcgagctcgtacccgtttagatataaattttgctttccaactaatagaaggaaaaaataagagagataatggagtgaaaagagaagaacataataggatggtacggagtacgtacatatacaaacgtccatacaaatagggtgggttcagtttagaggtagattgggtttttttttcattctaatctaacggtttaaagaatggatccatcaatttaaatgaaaatcgatggttatatagttttcttccacgtgacagcttaggaccgtttgtagggtgccacataacggtctaggagcgtttgtagaaagtttaataaactttttaatatataatagattgcaatagaaattaattggagacaaacagttcaattcaatatctcatacattatacattcatacataagtggatgaattgaatgctttgtaaacaagcattgatgttacatcagtgtgacgttcagacttcagaatcgatcatacggctgctgcagctggccgactccaacaagggtcttcttcctcctctggttctctctgttccatgtgagaacttctcccatgagacctccgagcaaaccgtcgccaccttcgtcttccaatcatggagaggattccattttgctaatccaagaagatccaataactctcatacattcgcatcaaccaacgtcacaatttagcttcttcttcctctttttcttggtctgttcttgtgctggctagctccgatgtgagtcagtatagatcaccatgtcaccaacaccacagcagcatcatccaaaagcttctttgatgatctttgcacgcgcagcaattgcagttgactccgatcaaacgatctttgcgccaatccatgctgatcagtgatcacgcacggactcgctggtgaagcacgccgcgccgatcgtcctcgagcttttcccagacggggaacgggaccatggccgtgccgggcgtncagagcctcgccgccggcgcccgcttgtacgcctcgtggcacagcgcgtcggccacctggttcccctcgcggtaggcgtgctgcacctcgcacacgcggaaggagtcgagcagccagaggatgtcgtcgag

SEQ ID NO: 61199 - DNA, 1953 bp, Oryza sativa
  unsure (1)..(1953): unsure at all n locations
tggtggccgaatgcttgaaatcaaggtgaaattaataaagatgagctgaaaccgaatcaaacttggagtcggattgtgttacgaatcggagtcggagatcgggctactcccgcgctcgatcacgccgctacgtcaaggtgcggaacgccgtctcgtactgcgtgaggatggacgtccaggatttttgcttagatgctaggaagggaaaatagaagaattcaaaggatttgttggattcaaattttgaacttaactttgaaccagggtttcggaagaggggcttttgatggaatttttaaacaaggaggtattcaatgaatgatttcggaggggaaatttgaatagcaaaaattcaaatttcgagatttgaattcggatatggttttttgaatttagtactaaggaggaatctaattgagatatttggcgcttattccttaatgacacagagagaaccaactttttgtaattagggtttatgtaaaatatagtattttttaatgacttaaaaattggggtgttacatatatcaagaaattaaaaaaaagtaacaccccaattttcaagtcattaaaaaaagtatatctagtgcacagcccaatctatatttgtttttctccctttaatatgtacgttgattttaaagatgatttttttgaacgactcgcacgagacgatgtgaagttctattaatagagtaggaaaaaaaatacaagattataacccaggaaggtcgtaaccagaaaaaaaagaaaaaaatataccaccacccacacaccgacagcaccaacacacaggtccagaagaaggctagaaccagaccggccgtaactaagcgtaaccggacgccgctaggccaacaacggatcacagacgagatcacccaaaaaaacgcccttacaaccaacacaaagcccaactctatccacatcttccggatttagggagaaagagtgagagagaagatggaacacctctccccctaggccctccgacgtggccaacttgtagaaactaggacaccgtcataagaggatgagaatctagagcgtgcttgcaccaattgctcgagtggttttagcaaggggatgcctaaacgacgtctccaaggacagaagcgacggaaaaccgccgtcgccgtccatcaaggtctcaaaggagctaagactaggcttttgcccggcaaccacccttttgaagatgatttttggtcgagttagatgtcagtgtcactatactctacagccaatttttttaatcaaatttattttacaatcacttagtcgaatttgaatgaaaacgttatacaagtagtacaacccccttgagtatcggcaaaattagtagtagtagaatcaatttccaagtttgcaacagatcggaaaggtgttcgcgccgcgtcctcatgcccctcttgctggcgccgccgccgagcgccgcccgcccgctgatcgccccgaccgtgccccacctcgcgcgcacccttctcgccggcgcgccggagaccccgccgctcctcctcgcgatactccaggcctcgccgcctctcctcacgccgctcctctgccacctcctcctctcccactccccgccccttccggcgctctacctcttccgtcgncttcctcgccctcccgggcttccccgtgccggaggcctccctccccgccctcctccgcctgctcgcgcgctcccgccgacacgccgtactcttgatcaagctgctcgactccttcccgtccaacgaccaggacctcctatacactacggcgctcgctgtgctgctctacaccgcgcttttcgcgttcgacccgggcgcgttcttcgacgccgctgtcaccttgttttacttctccacgcgcgtgttgtctgcgcccccgacacaaatttagagtccgncaacataaacgggctgatccgngcagtctgcgccccgaggtcgacgtagacgag

SEQ ID NO: 61200 - DNA, 2408 bp, Oryza sativa
aaattctactacatttgtttttttatttaacgttggttagtttaaaatgaaacttttgaactaaccaatgtcatctaaataaaaatggagggagtaaaatttaatttttaagctgtggcagacaagccaatgatcagcacaatggcaagttgaattagccgcaagagcatttgttctgggcttctggccgaagttcacacacgcctatgatcagtagctctacgtaactgtaaagctgatttctgacgaagaaacggcccgtaataagagtgccacaagcccacaatgtacatatctgtagaacggccggtggcttgcattgcttcagtactccatgcggctttggcaagttagaatgagctgtgaattagtcaccgacataatctgctacttgcatatcactttaaccagactctccaattaattacaaagcacatggttactgtatatacagtagtactaagtgcagcttcagcttaaattaaccaaacagtttaagaccatcgaagcccagcacattctcaaccctcacgccaccctacactatatatacccatgtaaatgcgattgccaaacatcacgtcactttcacagatcatcatcctgatcaatcgaaacagaaactgtatctagctagctgcctatcttgatcgccagccaagcttttggaagactcacgcaacagctagctagctagcacgaagcagatagagtcgtcactgagcaagcaagcaagaagagtgatcgatcgatcgatcaatggcggcgagccttgctgggttggcattcctcgccgtcacgtcggccgcgctgctgtcgccgctcgccgtggttggccagctgaggacggactactactccaccatctgccccaacctggagaccatcgtccggagctccgtcaagcagtccatggccgcgtcaccgatctccgcgccggcgacgctcaggctcttcttccacgactgcgccgtcagggtacatctagagattgcaacagataatgatcgatcgaccgccatagatcgatgcaagcaatgtggtgatcagaatatcagatcagtagaagtaagcagtgatcactgcagtgtgtgatttcgattgcagggttgtgacgcgtcgatcatgatcgtgaactcgaacggcgacgacgagtggcggaactcagacaaccagtcgctgaagccggaggggttcacgacggtgctcaacgccaaggccgccgtcgacagcgatccacagtgccgctacaaggtgtcctgcgccgacatattggcgctcgccgcaagagaatccgtctaccaggttagcatagcaagaaattttacagcacttcgagataccaaaattttcagtttaaatttaagtgattttatagtttttaaggagataccatgttttctattttctactgtttttttagatgaaggcattacgcccagctttcactaaaaagcataagagttcatacattgaaaaaagaggaaaagcagtaaaaactagggaaactgttttaagcactcgggtggatgtccacccgtttcttgcatgtcatctaaatagttatggaaatttttttataaaattaacatgataggttaatatgtaatatatcatttcacaatactaagatatacggaaatttgcactaaaattttgttatcttttagtacttttaagaactgtagaatatatttgcaaattttcatatatcttataatattgaagatattgggagatactccctccatactcataaaggaagtcgtttaggacagcaacacggtctccaaaacataattttgactttttatttctataaaaatatttattgaaaagtgatatatgtatacttttatgaaagtatttttcaagacaaatctatacgtataatttttacattttgaaactcaacaacttaagagttattcatgatttatatttttagggtttgacttaaatattgtcctaaacgactttctttatgagtatggagggaacgactttctttatgagtattaagggagtaccaaattttacattaaaaaatattatacctccggacggtaaactcactttagcatagcagattaaatttgcacacatgggcatgcatgcatgatgggtaaaaaaattgatcgtgagatcgcgcgttcaacgctgtaactaatcctgcatggatgcatgcattggctggttggtgcagagcggagggcccaactaccaggtggagctggggagatacgacggcagggtgtcaaccagagacagcgtagtgctgccgcatgccaacttcaacctggaccagctcaacgctttcttcgccggcctcggcctctcccagactgacatgatcgctctctcaggtactccaaaaatgtctaatcaactcaactcatcgtcgtcat

SEQ ID NO: 61201 - DNA, 1083 bp, Oryza sativa
  unsure (1)..(1083): unsure at all n locations
ggacaagccgttgcacgcagaccagcggtcgcgcggcaccgtcgattactacgcgtggagcaagagcgcttcttcggcgggcttcgccgcngccatgacaaggctcggnaaggtcggcgtcaagacgncggccaccggcggcgagatacgccgcgactgcagattcccgaattgatcggctaactcgcaccgtacgtgcgtgcacggtgcactactacttgtacatgcaaacattcaatcttgctcggttcatggacttcttactacagtacttagttgacgatgaacacgacgactgtcactgtaataattaatctcgatcaattcaataattcatacgtaatagatgtccgtaactgattttttagataatggaatataatcccggcttttgattaaagagctacagccaattattacaccaatttaacaaaacacacgtctaaagaaatagaagcacacacaacctactaaaaactcccacatcataacaagatcacactgctatacaaaccgtctttaaccccgatatgcaactccttcagtcccgggtagcatactgagattacgaatcaaaaaattattgaattccatttgtaaatctcatctaagtatatggcgtaggtgttttctttttcctttgtttcaatctcgatccatgactttatacagtacacgttgataaactagatagattaatttactcctagcgataaatttgatttgaccttagaaactacaggcccattaatagcaaagaagcccatgggctagtacagaaagtggattctaaattgtcgaggaacgttctctcgttgtttgcatatactccatccgtttcaaaatgtttgacactattgactttttagcacatgtttgaccgttcgttttattaaaaaaaatttgtgaaatatgtaaaactatatgtgtacatggaagtatatttaacaataaatcaaatgatatgaaaagaataaataattacttaaattttttgaataagacgaatgatcaaacacatactaaaaaattaacggtgtcaaacattttaaagggtaccgagctggagtatctaangcgcct

SEQ ID NO: 61202 - DNA, 7257 bp, Oryza sativa
taaataaaatgctgactggactgccacgtatacgtcacgtagaccaaaaccactgcggattgggtcgagaggggtaattcatccggtttacatagttgggggtgaagaatgtccggttttgtgcttcaggggggtaattcggacgaccgcgatagttcgggagtgtaattcgtactttttccttatttttattcctgactgttgtcttttcaaggtgctagccttataatttttattcaatgaaacaacgcatggtctggtgctgttttttaaaaaagaaacgtaggtagatagtgatcaatccattgttcttacgctcaattagccgcaaaaggtgaaacgaatggtttttgttaggtactacctccgtcccaaaacactcatcgctttaagtttttttttcaatgtttgattattcgtcttattcaaaaattataaaattattatttattttgtttgtgacttgctttattattaaaactagcatggtggcccgcgtgcggctagctaccaatattccttacttttaattccgaatttcagctatttaaaattatatttatatatttactctattgttatttttaatctgagtttttgatatttctaaattatatttctacctagactcttcttcaaattttcttcattttatattcctaattttagatatattaaattttatttctatttctaaatagttttctttttctctaggtagttgaagataattctttattctgaatttcagatatattgaaatatatttccatttgaactctatttttctttttctctaattaatatggaaatttatagaaagtgggagcgaatatggtggcttttttcttttacattaagatataatctctactattataaaaattgaagatgattttgccggtaatttgatacgtcatccgtgtattagtcagattttaagtttgttcgcttttagaaatagatatatgtatttgagtaggtttttaagttcattcttttttgaaaatactgatggagtcatataagaaatctaatttaaaaaaattcgcatgctaagttacacggttggactctttactgcagctcataatttttttaaaaaaacatatatatcaaagcgaattcctgcagtgaattttaccttaataactataatccatataataataataaggttaaaatagtttttacccgttgcaacgcacgagcacttttgtagtatagatagacatataaatgcatcaggagtgtgcacgtatgaacctgccattagagatttggtttgttgtaacggagagaatagatcgagatatgcaatggaaccaatacctattacggatgcacacttgtgatttgtattgtacacggtcactgtagccagcttaggttttctttcctagcaaaagactaatcgttctatgcagctgtccgatcggacacaatttttctctaaaaaggaaagagaaagagtccttatctacgatgaattctccttatatatattttttattttattttacttcaattaatatggaaatttttagacgttgagagttaacgtggaggcttctttttatattatttattaagttgatagatttttaattcccaattttgctatttttaaattgtatttctatattgactctattttcttttttctcgattaatatgagaatttttaggcatgagagcaaatatggagacttctttttctattactttaataagataatagttattttaaaatatgacttattttttttatatttgcactaatttttcaaataagacgaatgatcaaacattgcaagcaaaaagtcaaagcgaccattaatttaggacggaggtagtagtgatcaattcacttatacctcatcatcagtgcgccctactttgtactccctctatcttaaaatataaggattttctggataggctagaatgtatcacatctctttaaaatttcttgtattttgagacggagggagtagttagctagtgatctatttgccttggcgaactgtgtacattacatcggcgataataacatagcaattatatactctctccgtactcgtaaaggaagtcatttaggacaatgtttaagtcaaaccttaggaatataaatcatgaataactctcaagttgttgaatttgaaaatgtaaaaaattatatgaatatatttgtcttgaaaaatactttcataaaaatatacatatatcactttttaataaatatttttatagaaataaaaagttaaaattgtattttagagaccgtgttactgtcctaaaggattttttttttacgattacggaggtagtatatgccacaaggactacgtactttaaggtctaagctaatactagcagtacactgctgctgcctgctaccatcatcgttgcctgcatcagaggcagcagctacttgggtcttgaattgcgtcttcgtgaacctacgtcctcctgccgctgggaagaggaacagaagaagtgcaagcaagcaaataaacaaagaggaaagagggaagttttaattgtgctttttattttttgctttttttttctgtcttgctgcaggggaatagtagtggataaaaaaaagtagacatagctaggcaggaaatttactggcaaagcggtatataggtgaggtggtcgccgtcccttccttaatctggaagcctgccttttcaccgaacaccaaactaatttattaaccaacatgttgatactatatatatgctgaaataatttaatattacagcctataggttacttgtatatcgtgctagttgatgtcatggattaattttgcacaagtacgtatacgtagtgctcgcttgcgtagttgctttggccctggtccaatgagaggaatagaggtaaaaaggatccatcatcgaatgatcgcggccgggggcctgccggggtgggacaatggcagatgggtagctattagccaggtagttaagggcttggtcagttcattgcccaaaaaaaaaaaacttaccattcgttcgtatgccaaatttaataatgttaaaattttgaaaaaaaaaataaagatgtgaaggtagtgtttagtttgacaccttgccattggtagtggtgcaatttttgatataattttgtgagtagaagtttctaaaattacaaaatgttagtaggaattgacaaaattgtgatggtaaaatatcatttagtttaggaaaaagtacgaattagctcctgaaccacaaaaccagacttccttaccaataacttatgcaacagacaaataatcctcatggctcaatctgcggtagttttggtcctacgaggcagtccagtcaacattttttttaaaaaaaaaaatcggctgccctcacctgtcagtttctcaccctctttatctctacctattttatttctttccccaatcccctttatctcttctccctcccctaacctccatcactcactggcactgaggacggcggtaggaggggacggaggtagctgtgtggcgatggagggggagccgaggacggcggcgggcggtggcggagggggagctgaggaaggtggcgagcaggggcgtgttgggaaattttatgtcttggcatggaaatcgagaggaaatcccacacgattgttttccacccgctacctgtgggattaacgcgattaatttgtgattatttccataattacgtgattacgtgcattgatcggtagcactaaatctttccatgttttggattgcccccgactccctcagtgccatattaataggggagaccagtttcgtggaaagatgacgatctctccacgaacatcttctcgaaaaacctaaaaccctatccgatcagttgagcattggagggagaacgtgcggctgttccgggacagcgtagatggtgaccggaaggccgctgctaccccacaagtgatcgccggcaaccccttcgggatcaagctgctacgactacttccgctacgccgacgatcactggagcagttcgaaggacttcgtcctctacttccactttgactgacggcattgcagagggaacaaggagaagcacatcaatggcttcaaacaacggtcagtaaccctaagaattccgcagtagggtgatcatgtttaggataaccagtcatgttagtatatcacaaattctagagggtggagctagctgggagcggcggagggggagccaagggcgacatcagaactccacccgagcgagctctgcctccttcgccagccgcccgagttcgctatgcctccgcctctatctccaccgccggctactcgagcaagctctgcctccgtcgttggtcacccgagagagagagagagagagagagagagtagggggattggagagggattttgttgagggagagggatgacgggtaggtccagagaggttatttattttctttgctgactagattactacgttggctacgtgtggaagctcaagtgaaaatcgctcagaacaatgttaagggtggttatttttccgatatgaatagacgagggtgtaaaatgtctgttatttgagtttatgggataattcgatcggccgtgatagtttagggggtgattcgtactctctcattttagtttattgcttttaacaataccaaaaattagtatggttgatttttccacatgtaggtggactttcaacaagactttagtgaaatcagggaaatgtgcttgtttctgtttcttagagcatgtgtcaggggacgcatttacgggtgtgtgagtgtggtgttgtgtgtgtagtgatgtgtgcgcctatgtgtctgcagtgtaattaaaaaaagttgggactagctatatttatggcgtcatatttttcatcaaaaaatagtcggtatgtatttacattgtaaatctctaaattacatatgtaattttagtatatttatagtgtaagtcctaaaattacatataattacatatctaggtcttaaaattacatatgtaaatcccaaaattacatatgtaagtgatgtgtaagtggggtgtaactagtatttaaatttgtataaaaacataattacaacaacaaaattgactgctacaaaaccatagcaattccggatcaacaaataaagtaaaaaaattgcaaagggataaacaggtggagaaacggatatgcatcgtgcacacgatgtccagcgcagcgcatcccagccgttaaaattcgactgtactcagccacataatgtggcgacactttttcagcaaatccgaaaaagtttagtgtggttgattttgacagcaaactttaacaagtcctaacatcctagatcttcactataggtctatagctcgtgcgaaacgggcgtagaaaaaagtaatcgaagaaggggctagcttagctgcgtcgcggtcacgagctaggcggcaatttggttggcgaaattggacatatattcgacgagaaaacgacccccggcgaccgagatgtgatggacgcgacccgcgcgcggccggccccctctccctgtactgtctgaccgaccgaccggccgcccccgcccctctccgtgtcgatcgcaaaactagagatcatcatgcataccgatgaacgacttgaagctccgatcgatataacgacccatcgcggttacgtgctggaacgggcatgcacatcagatcaatctatcgtccatcacccggggggtggctagtgtggcttctagtctactactagtactagtagtagtaccctgaatgacacgacgtacgcccgtactgcaccctcgcgttatatagctggccgtagcggaaaacgcgatcgcgatcgcgatcgcgagatggacgatgtgcgtgagtgcggcgaggaaaaaaaaatgagaagacgatgtggctgggtcgtcggtgtcaaagagctataagagcatcgctttcagcgagcacggggttgtcccctcccgtgtcgcctgcgtgtgtccccctgccgcggcaaggcgctgccgctgtgtcaaccacgtccccctcatctcccccccccgctaccgcccgcccgcccgcccgcgcatgcattcacccaaccacgaacgtacgtacgtagagtacgactacacacgccgctagcctaactgctccctccgtaagtacctatttcctcatgtttaggccggataagttcaattacaacttcatttttcaacaccttttcaaagttatttttttattatgaggtaaaattcataaaactgcatatatttcttcaaaactgtcaatttgttataactttagcgcatattgggcaaaagaacgtataatgatagctaataattttataagagaactgcacactttgttggataggttaggtccattcttaaacattgtaaatactcacaagtttgcataagttgggtccatccttgaacgcgcatgtaaatactcacaagtgtataacatgagccccttacatgtcaaacacatatcacataagtgagataaggttatgtttttttttaaaaaaaatagtttgctattattgtagtattgtgaaatgtttatctaaagttactctaaggtactcctttctaactgcatcataccaccactactacatattcgatttttccgttcggtcaaaatggattttcccgtgcggaggtccagtccatctgcgccaggtgtctgcgaaaatcaacatttttatgtgcgggtggcccaaccgtgttacgtggtccgcactggataatcgattatccatgcgaaccgtcgatcacgtgacgaacgggtccgatcgatcattcgtcaggtgtgtgtgtgtgtgtgtatatatatatatatatatatatatatatatatatatatatatatatatatatatatatatatatatatatatatgtggatagatctgacggacgaacgcacactgttggttagcttcatttattccgagcgcgcacacatgattgatggctgtttggcatcgtatccatgatcgatcacacaagaggagcacgcacgctatctaaataaccaaagcttggtgtacaagcgggagaggggctcacacagggagattttggttgtggtggtggtggtggtgtcacatccgctgcactcgagtgcgtcccgtaccaaccaaacacgtccgctgtcatgggtggcaatctattgggcgatcgattagtttatgcttaacactaattgcactgctcccacaccttaatcgatcttcattaatcgctaacctttatgtcatgtctagctag

SEQ ID NO: 61203 - DNA, 960 bp, Oryza sativa
agtcagaagttcttaatttttcttctgtataagagagggcgtcgtgaccaataattaatttttgatgtacactcctataaatatgtttcagaaatgctagaagtattgcgaggactggattagtagtttttattgtcggaaaatgataataaccacccgtgccatttcagcctcgtgatgcatgaactgattgacagatcgatcgattagtcccaaaagcaagaaagcgattctgtctcaatttaatcgcgacataacctctctggctagctaaagctacaaagcttactaggacaatcaggcaggtaggcacacgctaaactcaaatgacccattatggtacgtacaactgaaaacgggctgggggaggacgaatatatgaacggtcctttaatttgcgccatctgatcgacgatcaatcagttgggttacggcctgtcgcgataatgctgccactgagtgcatgaaatccaattaagcgctgacaaagaaagaactcacgccatcgtgtatccaggccctacaccaattaatttagcactgctttgcaagaaactccatgagagaacttccagtgctcaccaaattatcatgtgtagactgaagcaagggcatgcaaacagcccacctgcagctgcctagctacattataatttataagaatttctcatttcaaatgttgcaattctgttaggaaaaagtacgaattaccacccaccaccgaactatcgtggtcgaccgaattaccctaataaacttgaaaaccagacatcattcaccctcaactttcaataccggacaattaccctcctcgacccaatccagatcggttttgttctacgtgacgtacgcgtggcaatccagtcagtattttatttattaaaaaatataggacccacctgtcatactcctcttcccctcttattctctctcttctctctcctatcttcctctctctcg

SEQ ID NO: 61204 - DNA, 2960 bp, Oryza sativa
gtccccgcgccgcgccatgagtgccggcgtgcgcgctactgcccaatgactgaccaagagagagagagaaagagggtgtatgacatgtgggtcctactattttttaaaaaataaaatgctaaccggattgccacgcatacgctacgtaggacaaaactgctctggattgggtcgaggagggtaatttgtctggtattgaaagttcagggtgaacgatgtctggttttcaggttcagggggtaattcggtcgaccgcgatagttcagggaggggggtaattcgtactttttccattctgttaccatatctctactattataaaaattgaatatgtttttatcggtactttggaacgtcatatgtgtatgagtcggtttttaagttcgttcacttttgaaaataagctcatcctctatgtaaatttgggaaatagctccttatccccgcacggccgctccctgtgcccgtagccattgtattctaattggttaggaccgaactacaagagagttcatctgatagcaccggagatagaagataagcttattggaactcaaactgtataatagatcataaggtcaagaatttctgagatatattttttaatttaccgtaacttttacgaaaaaaattactaaagtactttaggacagtgggtgagattcgtgctctcataagggtgttaacagtgcgtcgctcatatttgccgttcctcgcatgccacacagaccaagaacgtgttaagctacatgtttcacagtgcaagttgtttgtagtgggtctcaccggtaccatctttttcacttttgaactctccctctctcctctccttttttgttccccaccaaatgaagcccccccctctcctctctcttttcttcccctagcggaggaaccgaagctgacggcgggagagaagagcgacgacgccgacgctgagcggccctagcggtgctggtgccggcagcggagtgagggcggtgcgaggcgcgagcggcgacggaggcgccgggcggcccgagcggcggcggcgccgactacggatcaagctcgccgtcgccgaatcgacgtcggtttgtctccttcttctcttctcctccgccgtgcctcccctcctcctcctcctctggcgcgggagcgagggacagcgggggcagccgcgtgaaaccactgcgacctgccccacggcgccacccctcctctctccccgtgggcggcctctcccctctctcctctctcccattcttgacgtcatggaccacgaatatgggtcccacccgcgacgaggaacccgtggtcaaagttggctacacgatccttaagaaactgcacggatggagaatgtagcaaggaatattcgccttttggtatcgagactaaatgtcactgaggccactgtgaatggccttaaggcagtgaagtagtatatctgcgtacattaattgggggagagaacagttggggcattcgctgtcagggccggccttggggcagtgcggacggtacgaccgcactgggcctccaaaaattagaggcctctaaaatatgtatactataatatcaggcctaataggcttagaggaaagatagaaaaccgatcggcgatcgaggatatcgtgagtcgtgactgcttgattgtattttaaacttattagtgtgaaattcgttaatgacaatgactttttaaatattaccttgtatttttatagtgatttaggagcctttatttttttgttccgcaccgtaccgggccaccacaaagtcggggccggccctgttcgctgtgttgatttgaagcaggtgtcccgacaaagatttatattccatcatttcggagagagccgatatggtgagtgctgccgtctgcaagacgccgggtacaccgagggagagagcgacactagtgacaattcgaggcaccagccaaaggaataagttaactttggtccctttatttgtagcctagtctgattttcattccttaaccgtaaaatcaggtatgacctctcccccaacttacaaaaaccggggaaacatggtccctcggcggttttgaaggcggttttggttgatgtggcgcttacgtggcttgtttgactaagtctacgtcccacgtggcattttggcgcttatatggcaattatatctcggaaaaataataaaaagtgtggccccacatgtcagctgcacacaaaaaaataattttaaaatggtggggcccacgtgggccccacatgtcagcctcactcctctcttcttccctttcccctctctctctctctctctccttcccgggtagcggacggcgcgggtgggcggcagagcaggcgagctcctgcggcggcggcgggcgtggtccgcgccgccccccgaccggagtgccgccggtccgcgtgaaggcgaggagagggagagccgagaggggaaagggaatgacgaggaggaggacctccttgtcgggtccgcccggggcgccgccgcttttttctctggggcagtgctcgctggtggggagcccccgggaatccgacgccatcaacgccgccatccgtgtcgccgcggcggagagccgagagggggaagggaatgacaaggaggaggacttccttgtcgggtccgcccggggggccgccgctacgacggaggcagcggctgtcgcgccgccgatttcttctctggcgcagtgctcactgctggggaggccccctagaatccaacgccatcggcgctgccatccgtgtcgccaccgcgaagagccgagagggggaagggaatgacaaggaggaggacttccttgtcgggtccgcccggggtgccccgccgcggcggcggcggtggccgtcgcgccgccgccttcttctctggcgcagtgcttgctgctagggagcccccccagaatccgacaccatcgacgccgccatccgtgtcgccgctgcagagagccaagatgggaagggaat

SEQ ID NO: 61205 - DNA, 18712 bp, Oryza sativa
taccgctttttcgccggcgggcgcagaggcggaggtgggcttttgcttttttgggcgatcgcggctgatggatgcaggctcgcttttgatctccgatttggtttcgatttttttttttttttgtgagagggggaaggaggtggtggaagaaccgggagggaaacggctttttcgaacgttggtggggcaacggctctgccttcgaccttcgtaaccttcaggcaggaaacaaatggcttttgaaggaatttttggaggatatccttcgaaataaataaatggctctcctaaactgctttggaattcattagagttgtctttaaatcatatataggaattttgaaggatttttcaaaatgaggttcaacatcttgaaaaaaaaatttgtttgtgcatagacatttctacattgaaaaaaaatcctccattgatatacttgtgttttttatacactccatccaacataggcatttctatatttattagttctcttatgtatttccatttgtaggattttaggtgccaggtcactctaaccctacgggtttctttttattcatgtgtttcgaaaaaaaaccattcttaccaagctcatcttgccgttaaaaaaactaaatggtttagattgtaatatcatatataactttataaacatgtaaatataattcaatttagatagtgagggggaatacaaattcaacagctggcgctagtaatttagcggctagatttcatttggtacccagtagtaccattagctcgaggtattttctgtcataccataacaaacttctctaagaatgtgggttggccatttccaccgctggttttttccaaccttcaattgtaaataggtttatgcatatatatttgtagaagtgagcgacactattatataattcgtcgagatattttcactgttacttagatgctacgagagaaatgggtctaatattacagtcgaaataaaaaatttcctcgtgcttagattgagtttgttgtttgttaccgtgttttagtcttgcaaggtgtatggtctagtgtgagatttagtagaattctttacatctcgtttgtgtgagtattttctttaccttttttctatgagtgattgctttttgtgtggtgtgatgactgatgactgtgtgtcgtttgctaggtgggtaagggtgctttagggagcactaagtggtctactttgccatctcaaggggaaaaagtaatctgctttgggggaaataatgcatggtgatgggctagctacctcatggtggccaaaggctgaggttttgggctatatgatatactatgtgacaataatgtcaaatattaattcacaaaatttgactttgttctttatcaggttgtgatgttattttcttttatgttgaccatttttacgaaacaattccatcacatcactgtactacctccatctcaaaaatatcttatttccggctatgttcatgtgcatagctaaaaatggtcacaagaaggaaaatttcaacacaatactacgtgtatttttttttaacaatgaatagcagtaaacctaaacaataactatgaatgcacacaactatttcaatatctttctcaattataggacaagtctaaattgcacatatattaaaggaagaagataatggctactccagtggttgttaagaagtttaactctgtggagaccctttttattacagtatgtaaaggtaaataatgttgggatgattgtgtgatcccgaattcccgatcgatcggtgtcggtgggatggaccattcataatatgtttggtgtacttggtgagttttacacgatcgatcgatatgatttttgctctaaagcaacattgtactcgaaagcaacaaaaagaagctaagcgcgtatgtaaagccacgcacctaccaaatcattcgaggaatccatgtgctatgcatatacttagttcccaagtattgcactacatgcatgtcctgtgtgaccagttgtggttggcaatttcaattccatttctgggtaattcagttgatgaatctattgtcgattggcatatccacgtatgtaggttgtctaatcaatattggaataatatatacccattccgaggacataaatatttgacatttttgatagaatatgatcaaacttttatgaaactttaggccatcagtttaatattaaattatttttataaagtgtaagaggtttatatattaggacagagattggaggcaaatcattgaatatttgaatgccattttttatttctaaactaagcatcgagaaattattgagggttaaagttttaagagtttaatcatgtttttaataataaatatgaaccaaaccgtgtactctaaagattaatttatgaacgaaaggagtatgtataaccatcttccatcattttgcatgtttactacatcaacccgacatggatatataaactactatctatctctacaaatataatagatccatgcgggagcgcctaatgggcgggtgatcatggcacgcgattggcccacacccgaggcgcacacgactcccaccctaactcccaaccccctcccacggtgtgacttgttaaaaatatattttagattgattaaaaaacaaccaaaaaagaaaaaaaatcaaatgcgctaaaaatatacatgggtatagactttatacataaaaatatatatacattgtaaactttgcaggtacaaacttttggtaataacaaaaaagattgaaattcaatatgaatttgagtgggatatataaacttccgactataaacttttaagtgtgtaaactttaggtgtataaacttttcgtatataaagtttagatataatatgcggttctagaaaaggaaaagataagaaaaaaaaaggggaaaaggtgattgcggggagcgatcacacggtaattagcaaattcagatccatgttgctatgtacaggtgcaatcctgcacctaccatatagttcaccaactgagttttacacctgcgttactcattcttcaaatccaactaaccgtattcatccacattcaattgaacgactcaagagatcatcccatgctcaacctcccctcctctctcgcacggaagctagcgcccatctccgcacaccctctccaccgcactcccatcctctctctctctctctcttgcactcacccagaaaccctatgcccgcgcccccttctccaccatgctgccaccaccatcgaatccctctccacagtgatctgctacggatcctgcgtcttctgctatccatcacgccgccaccgggactcctcacccacgcatgccatcgatcccgatttaccttggccttggtcttggtcttgttttctttttgctgaccatgctttgccttgttcttgttttctttttgctgtttgcatggctgatgtggaaaacctagctgattgagtgactagataattagttgattgagtgactaattaaaggaagactagcaaaggcgacatggatagatcaggaacaaaaggtgaacagtgtgttttagatggacgtagttctagttactagacatgcgttttttacctgagcacaccggcacagcactcagccaagcacgtcttggctcactttaagaccgtgtaacttcaaaaggtgaaaaataactaaagttgcctgattatattaattaggggacgagccacttgtacacaactagatcgatgaagtgacctttgagaaagatgccagagatttcaacatgctttgcattttgtaagcaaagctatccacaaagccattgtgtcccagctccagactgactgtgcatacagatcgagtgtgaatgcgtgattggtactatgctttggtagcctagcatgcaccgatagtgcagtggtaagaggtgtgtgattttaaccccgaagtctcatgtttaatttttaacatgctcacaatttcttcttacaaaatgtttggagggagtccctccaaatctcgtttttttttaaaaaaaaaactttggtagcagcttccagcaaaacaaaaacgaaattgctaaaaaaccgtcgcaagttttttgtgcaaaaataatatagctgtagtgtaactacagtgtaattatactacagttacattgttactacattgtagtctctacatataaagttgcatatattattttaatacttatataaaatttatattttagttatagttgaattatattatagttagatttgatagtttttttaaagatagtcctaataaaaaaacagagagagagagagagagggtcttggttgctgggcctccacagagtagaattgccaagtgcaccatcggcctatgaaaagctcaacactaacagaagcccggtcgtcctcttctggcccaaggtttgtctcagcccagtctcatttacttggatgttttgaagttattcatttttcttacatttttcaaggacgtaactacacagctagtggtagttagtttgtctaaatcagctaccattctatctataaaaaacaccatccacctatactttaagtacaattttctcttaaactactcatccgatctacgatttgattacaccgttgtgttcataacaattaaatctttacaacaagatctcacatcattatattttgataaaaaatcacaaattacttttatgatatgtctaaattacttttagatttcactaagttacttcttagatatataaaagtaaattcagtaaagcctaaaagtattttacatatattatagaagtaattagaacaaaacgaaggtaacttcggcatgtcatttgaattaaatccgttgtagaaataaaaacatgactctatctagaaattaaattaatcagcacaaattatggaattaactaaaaacaataataaaagtaatcacctcaaagcattacgaatgtataggaagtattttaatcaaatctaaaaagtaaattatatatatgataatttgttcaatgaaaaaaaacattaattaaagttactttctttttatataagttacttctataatatatgtaaattacttttaggctttactaaatttacttttatatgtctaagaagtaacttagtgaaatctaaaagtaatttagacatatcataaaagtaatttgtgatttttcatcaaaatataatcatgtgagatcttgttgtaaagatttaattattacgaacacaacggtataatcggattagtaatttaaaagaaaattttatttgaagcatagataatagaaatatttcccctacttacttaatggattagtactatagtaaagtaagattcttccagctaacacatatatggattctggatgtccgtcgctatttatgactaaattgagagtgctctcgaattagattttgcgatttttcaagtacaagccaacgctcacacaaacaccatatatactcatgtccacacgattacacggagcgttcaaacacagggtctaaatacgattgaaggccaagccttacacatgctttgacccctgaacacatccaaacaaacaaattctaggaattaggagagaaaatgcaataattatataattcagaaaatgaactagaagtcaggagctaaaaaaacccagttttttcatattcttataaattggctaccaaccagtagcttctcataatgttaatcttcccctaaacaggcccagagatttgaatccattagatccgtgagaagctatcctaaccgaattatacccttttatttaagctatattgaattttaggaattcacaaaggtgatggccgggacaacactactacactaggcggacgtgccccacgagacacgatcagggggtgcgcgcattatttcgattatagaaggaaaaagagaaattctaaattttaccatcgacattatcggagccatcggaattataagtgaaacagcatatttgcaaacaaagaataatttgtgaataaaacttttatatacatgttcttagcgatataaaagcaaatgctgaaaaataaatttcgatgaaaaaaaccttaaaatcagctccaaatttaaggttaacaatttaaattttgcctgatgagcataagcataagcgaaaagataaagccatatgtcgttaatagatgtaaagttctaccgaatgccatcttacgggtaattttatcccttttcgttatcgccttcatttgcccactcatcgccgaggtgcccacccataagttaaaccatatatgagccgcgcctatgagtttgttaaagttttgtgagggcattttagacattttaaataaataaaatcggactaactgaatgggatggacgaaaacctgcatatgatggcatttataagacaaactcatttatgcactttactgatggcatttgttagaatttctcaaggaaaaaaaaaagaggattgattggcaagcagggtacgttgtacactgaacaagcagagcttatattggtacaaatatttttttttcaattttttctggagaaatgctaacactgtgatatatatccacggattttcataatttactctatgcacatcaacctatttccctaatttctacaacaattcatcgatttattcatatttattgctcccacaaggggctgtacacttgctcatcaatggagccatctccatagtacaaatgctcgtcgtcgtacacgcaccagctcgccgccgccggcaacgccaactccggcggccagccgtacccgaacgccccgccgccgtagccgtcgaggtcgtcggaaaacatgtcctccagccgtctgatcccagctgctgctgcgccgtcgtcgtcgctcgccggcccggcggcggccatgctctcgtcgctgtccctcgtcgccgtcgccgccgccaccgccccggtggcgccgccaccgccgatctcggcctcgagcgaccggatcacgcggctcagctgatcggcgtcgccgtcgccgtcggtcgttgccgccggcgacggcgagtagtcgtcccccatctcctcctcgccatcaagaagctccatgaggagcaccactccgtcgtcgtcggacgtcgccggcgccgccacggccatctcctggtcgacgaggccgccggcgccggtgccgccatggtagtagtactggtactcgccggcgacaccgccgccgccctggctccgcatcatcttgtccatctgcgagcaatggatggagagatgatttcttggcttctcgcccttcttggttgccaaggtgcaatggggtttatatatatggttatcagctagcttaattagcttgcaattaattaactagtttaattagccacttggttagttaatacctccattcaattctacctcccacctgtcatgtgtaccctcttcatctctcataaaacataaatatagtagcagatacgatatattctagatcttcgaatctaaatataaatatgttcagattcgtagtactactatgcgtcacatctaattttatattcgtttttttattatgtagggagtatcatgattggtgtcatcgattagatcattagcaatttggtttttatttaatacaaatggattagtgatcataattggttttcgggtggacaattaacggccgtgcttaattatagtaggaacggtaggttttgggaggcaacaagagaggaggtgattggattgtgagttgatcatggagaggtgaggagacagctaacaggttgggcaggatcctgcattggcctacattattgccaaattatcctgctatccacgtcagtgtagcgtacgtccttgcctgtgtacttgattgtgaatctgcttatgacagttttctgcgaatatttttaggtacacttataggcaccatgatttgaaccgtaagattggatatatatccactaaagcctcgttctttttcatactacatcataaaaaccgattttcgtgacaccgactacctgcgaaaatagatccacttttacgcagacctctaggccaatttctcgtgatggcaagcttgccgaaagactgtggcaagcttctttctgggcgtcagtccttttccggcagcggcttgccaccgcaagatggccatgctagatgggtcagtgcgggatagaggctatgttacctggatacgtcacaaatgcaacgtatccgtatcagatacgtggagggatacggatacgtatcggatacgatccgatacgtatcgcgtacgtatcagcgattttcgcaattttcgaacaattaaaataaatctggatacgttctcgatacgtccgcatggcaacgatcaatatgctgtctccacttttctcgcctgatgcccaaccctcgcggcactttcccccgccgccgccgccgcccgagacgccaaaggccgaactctgagccgccgccgccaagcgccgaacgcagcgccaccgtcgctacatgccggaccttcagacgccgaatgcagatctgcgtctagatgtattcaccgcctccaccaccggacccaacgccaacaggcacaatgccgccgtagcagccactgacttcctgctcccggtgaggcaagttccattgaacgatttgacttgttttgcttgcctcttcgatgcttgagtgcatgtgatcttatctgttcgatcttgttcctctttcctgttttcttggcagaagtgcaatatacagagatagctagtattttttttagatctgatgatttttgggattggaagtgtcaatgcatctagcactcctagagctagtgcggttgctaatctagctgcagattcatcattcctccaaatgatggtgagaagaagccactgtgggatgcggtgatatgttgagttgttagagaagaaatagaatagtcaaagagtatacggaaaaatcaaagagttttttttagatatattagttgtgctatttctcaactagtctacacctgccatcgtttcactttcacccacctgaatcaactacaagagataatcagaaaaattgctacattgtaattagctaatttctttgaatagttgatatttgtctttatatatagatatttatatacatatatgtgaacgtatccccgtatccatgtttttcagaaaatgacgtatccccgtatcgacgtatcgcgtatccgtatccgtatccccgtatctgggtaacgtaggatagaggggaagacaggggatccattcttctctctcaccctctccctttccaacccaaccacgtggacgaagctggagaacaccggagttcaagacccttctttgttggtcggccgacgacgaggcatcggcgcggtgcctgcgcgtcgaaggggactagctggtggttactgctgaatctaacatgtctcattggtgcgggagagtaggaactacgggcgaaagcctagccttcaggccggcaatggcgacgcctacgggcgtcgctttccccatggttcgttgctgcgttttctctcctctcccaatggtttcttcaagtgaaaaccacgtcctggttctctaggacgggcagcggcggtgctcttggcgtcatttccttcttggaggcgtcgtttagaagacccatcccttaggggtgttatgggcttgttctgtttttaacagtaggatcagacgtagacgcgtggtgtggttatcttttctttttcctgactatagtctcccaggactgtagacttatatttttttcctattatatcaatagaaacgtcgcactatcttgtgcgagttgttttaaaaaaaatgctcgtgaaaataccggcctacatgcttgaggaaaacaactattggtataaaatcaagtgaggcgcaggcgagagcgacgacactcactaagttcccggccctcccccgccccagcaaatccactggccctctctccgtctcctctcccttctagcttcgtctctcgcttgtcctacctcccctctctctcgactgcgaatcggtcagcgacgggagtaggaggtgtcaacaagccctgggagtggcggagcgacgatgggcctagcggggagcggtagatactgcacccatagttgccgggcgccgtggatcaacagcagtgggctcgggaagcgacggatcgatgatgggcatacaacggggagcagcagattcgacggctgcgcccctcaagagtggcggcttcggcgcccacaatcaccgggaacaaagtggtggatcgatcgacggcggcatgctcgagaggtagcgaactggcaatcaaagcgatgtgctcggggaggtgatgaatcaacaattcaacagccacgggcccaggaagaggtggattcgactatcgtgattgtcggcaccggcagatggatggcgatgggccaagcggggttcggcggatctagtgaccacaatggattgctgcggtgaggatggcagcttcagtgatgaatttttgcaaatgggtatcgaagcggggttctggaattattttttttggttttttagttcttttttcaaaactttgtgcaattgggagtattgatgtacccgtttaggaaaatcattttttctagatggccctcttaaggaggctttctacgaaaatcattttcatatacggtttcggtacccgcttgtaaaaatcgtaacttttcatacatacatcttgctggaggcagtagtggtgcccgtatgtgaaaaaccattttaaccatttgggaagatctgttttgtagtagtgctaggatttgaagtgttcgtgcccgaatccgtttgtatatatagtggtaacttgtgttgaagcctagggaggggtttcttcttctatgcctcgactgatagggtagtcagcgagcaaaggtactgtggatcgaatgtacccacgctggcgatggcgaaggaattggccaaaggtgagggttggtaaagaccgagggatgagataggatagaaataaacttattttgtgatacttattttgtgattaataaatgggactaaaaataaatttattttaagactgagtaacttagatgtgagtagcagcagcacgacatgccgcagacttcgataattaattaattaatcgccgctgcaatttaaaatcacgtcggcgccgtcgtgtggctggacgggagttggcccactacctgtacgtgtgttcgttggcttcttcgtcgtgaccgattggatatttaattttccaaagaaacttacaattaggtcgcgttttagttgatgtttcgtgtctggtgtccctttcttcttccttgctctcggaagcaacttgcattgtgcagttaagctgtttcaagcagggtttacaagaccatttttttttttgtgaaaaccatttgaaaaccgttcattatagctaaattcaatcctaccacataacagactatcttcgacgttcaccgacagtgataaaaatatcacttctatgcttgttcgcaccaaacccgctcaaaatctgaagaatcaacggtgatacaatggtgctactacgtaccgtgaaccagaaactgatacctaaacctcaattattagttcggggacacctcctaagtccgaggagcctgttctcctcagactagaggtctgtgagggcaaattttcagctctaaaacctttaaaggccgataaaagctcgatgcacgatttcacgcagtttttttttcttatttcaaagtatatggccatttttgtgcgttgtatgttttatttggtcatttatattgatctattttcgactattctctaaatataactatcattttatcacaaacaagattaactatatagttactaaaactgtacgaaaatatagacatagtagagttcgagatttttaaggctacaattgctagtaactcccgaagtattgggattggtttacttaactccgtaaaggacgaaaccggatattctacccctgaagtatgaaaaccggttcaaataacccctaccatagttttgtaggtgattttgtcatgtaaatgattacgtgccagcggtattggcttgcatgacacaaagattagtctaataaacccaagtttgtctaactattacttttcactcactgatcggcaagattaaaatttattactccatctatccaatagtataaggcatggtcaaacttggtacggttgacttataatttctcatgtactataaagtttatagcaacaaaactataatcatatgaaagtaaattcaaatgtcaatacaatataatattcttaacaaataaaatttaatttatattatactaattaatggttaaatattttagaagttgaatcttgaaatgcttacaagtcttatatcatgggatggagggagtatatcttaatactaatttacatcattcttaggctgattcacttattgcatagcctgttacaatagtctcctttaggtccaagaggccaaaatcattgccatgtcatcatgtgcatagcaaaaccattctagagggttatttaaactggttttgatatatatacattttttttgtggggggggggggggttagaatatcatgttttgtacttcggcggttacatagactagcctcaataattcagaggtgaagtagacttattccaaactcctatttcttcttaacaattccctctaaccaaacgcacttaacgtatttcaatatttttaagcacatatcttagcgtattgcatagaaaaaacatacttttaagcacctattaaacatctaggttttagaggtggcatttatgaattcagccccaatacttcagggatgaagtagacttatttctatgaatttaaagtgcgaggtctctgtatgtaaaaaacaaaactcccataaccaattcctccactagcttcatcctataaactctcaatttcttcctttcttctgggtttccttacaagcagcacaagggacatgttcaatacgagattaagcgtgcctcatgcgtcaacgtcgcacgaaacgcctcgcccatatctgacatggcaacaatatcggatatttttaaagctaccctctaactgtgcgttggaggtggtctaatgactctagctagagacgatccactgtgtgcggtgtcttgattttgctgttgatttgattctcactcattaattactctagattaaataagctgatttctttgattttcttttactgcacgtgtgaacagtgatatttaatgacaatatattcaccccatcataaataaatatatattatttaactttctttagtctttaaagtaaaactttaacaataattttatattagaataagtactacgataatactccctgtggagggagtacccctttggacatgtagaatgatgtttaataacgggctctcttcgttatcatgtaagtaaatttggtaataatgtggaagaaaaagaaggaagaaaagaaaaacgtcgttgctacacgtgacattggctcagagtcgactcttagcatttagtatttattaacgaaaaatttgttacatgagggtggagaaaaggaaaaagtgataataaaaaatatttagtgcattaatggttaaagaccttattatctctactattgcagtaggatgctctctaacgacatgaattattaatacagagagttaatattagactctacttcgtacctttttacatggcttaaaggcaaatcaaacaaagcattaattctataagttatatattgattattgtcagtatttcaaaatatcaaaactttgattaagtattattttagactttaaatatatttataaccgaaaagagtaatgtataattctttctataagaaaataattaaattgtccttgtcctatttagccgacactgagctagctagcccctctcatgcattacatagaggccaatggccggatcacatggagatgtctgcttaatcagttgcttctgcacgatgccatccatgatcgataggccgatatgatcgatttgtgtgccttgtagatttggatctgatcgatgatatccgggggaatttcccagctgccaagtgccaactagtgataggaaaccgacggccaccattgaacgtgcgccctactagccacggtgctgggcgtccatccatccgtccatgtcaaaggtgctttcctcgtgggcttgtggtcgtattctagtagtccttgcaaggtatggttgtcaacagcaataatcgaaaccatttatatattattttgttgtttcaatttgtactatcaattatactgtatttcattatcgtattattatagtcctattcggatgtctaggcaatggctataacccagtgccataagcacagataagcagtggactcagcagccgcagccataaaagataaaaccatatgttgaacagattctatagcccacctttagtatgagtgtaacagtatataatatgtagtgacccgttcaaaacattttcttaaagatagacatcgcatgcaacactgtaggtactccgaaatattaattgttatgtaaatttcaccgtctataaaggaaaattttggtcatgataaagctgaaatattgcaaggaattgaaatctgaaaattttgatcaccttagttatgtctaagatttttttttaagtaaggttatgtctaagaattaaggaattggaatcgtcaagaaagctattctacaagctagttctacaccctaattatatagttttgtgtttgccaggagggaaaagaaaaacataagaattgaagttttatatagatgtatacatgcttagaatcgtatgcacaatcattcataagtgcgcacatcttcggttttcggcgcatctatctgctcattgtgactgctgcggtcccagattcggattatatcaatctctttgatgatgtcctctcatctaggcataggtcatgtactatatgaactttggatgtacttcctcatcactcttttctttttacaaatgatgttttaatttaccctagagcacaaattaagtccaatagctcctactaatagcccccacgcatgcatcatttccaaccaattcatttcaaatattccattatcatgttcctattaaaaaaaaactccaccggcaaaagaaagaccaccccaaccgctttttcaagctaagagaaacctcaaccaaagctaatagcgaaagggcacacactctggcatcttgacacacagatccgccctcacggtttgggccttaacatgtgttttgagaccattgccttgtgtatgactgccgacttaccataggtcagtttttaacatttgttttgatccaagggatgagtgagtgatcatttttaaatcaagtccgaaaattcacttgctagtggagtcaaactcgggaactggtagttgctactaaagcattatagtgaatataatagcagactacaagttagctgtaagcatacatggaggagataagagaagaaagagaaggaaagcggattacagatttatagccagctgcaacacggactccaatacgttatgtgtataagatgtgggagcatatattaatgatgtagtatatgtttatagataattattgtatgaatgagctattaaattggctataaatgaattggagtcgatagttggctatactattaaacttgctcttacaaccactatgatacaaatcacaaggttgtttttatttctatgggttgggaaccatttcctgcgctcggaaaacggaagggtccattagcgcgtgattaattcagtattagctaattttttttcaaaaatgaatcaatatttttttaaaacaactttcgtatacttttttttaaaaaaaacgcaccatttagcagcttgaagaacgtacgtgcggaacacgaggaagacgggttgggaacactgagcaaagaacacagggttagaaaacatcgaaggagaccacctctcgcatggcttagatatatagcatggtgcgaaagattaacgacaaaattatataactgtagacaaccatgaattagctagggcgtgtccgttggaaggagatagagcgaaaaaaaatatttgctttttcatgtgcacattttctgaaccgttaaatggcacattcttcttttaaagaaatatatagaaaagttttctttacaaaatcttattaatctacttttaagtttagaataattaatatttaattaataatatgttgatcattcacatcgttttacatatattctcaatcttctttttctcctctcaaacacatccttaccccttaggaattcaccagaaagcagacatacattatgcaagtactactaattaattgtcttattgtatgctggcaacttcgagagaatcctgagaatttttggttgccagctcactgaaatcacatatgaatgtgatctcaagaaaatgtaggattttctgatcttgtgtcggccgaaacttctcatggacgcatcaaggacaatgtaccacttgcttgatcattcctgtgcccaactgcctaattgtctccatggcatcagggcataggcacctggaccaggaatcaatctaccggcaaggccgaccaaactcttgttgctaattaatcacccaacttgatttatcttaaagtccatgattaaaaaccgaagtgataaaggcaataattatgcttgttagctctaattaagtctaccggtcagaaggtagctgttggatatatcatatatattcgggtgtctaggttggggcccttggtgattagtctccatttgtcataaaataaattaacttttatatacgaatttagacataggctatgttaagatttattttgggatatatgaagtatgttcctattgttcctccatccaaaagtcagacctgtttcttttggcatcaagactaaaaaataattaactcattcacaacgtgacaaaaccaacaaacatgtaatcaataagtataaaatagctttttagtttcgattaacaatttaatttagcacatagtgactacaaataggatttatttctttttgaaaaaccaaagagttgaatagttcttagaattttagcaggagggagtagtatagactacgggtgtttaattaagatgagattagagaaggcattaataagtgatgattaattgggttgggatcgtgtgtaggaggatttgacccactataaatgcgcataatgcaaaggtgacatgcatatgtgctgcatttttttttcgattgatgattgtgtgattgaaaagatgccaagtgagatctaagtgagctggagaccaaatctttgccgatatttgatacgaaccagcctggagtacaggaggagatgacataagctgccctgatctttgcagcgtgtggtcgcgtactttgcccaagtattgcatactccattatttagagccacacgggacataaatttataataactctgattccatttctttcatataatgaaatgaaataattgccgcaccaaatttgatttcacaaggatctagaaagacgtctctaaacaaaaataattttcaaaattaatcatagagaattctaccatcgtcagaaggttgtattatttcttaaaaaaacacagcacaaatgtagatggtcacaactcacaacacacactctacttttataaacatcttcaaaatactggaccaatatatcttgagattaataaagttagcatgaacatctaactgttaacgggtatatcgttacaactgacagaaattactcgtgataaatctcagtaaattcatcaggcacaatcgcaagtacctgaggcaatcgagtgcaatgataacagttgatgataattttcctctactttttttctgcgaggggcgttgatatctttcattggtggtacggatctaattactgtcacgaattcggccgacgacggccacgatataactgaattttttttaatttttaattttatttagtaaaatattgacaaaactatttttaattaaagttttacaaatctacacccctaacgtccttgggagggtgtttttaaaaaatcactcttctagaggacattttttaaaaatcacccttctagagaacattttttatgatatggcacacgtcctttggcgttttttaatggttgtgtgaaatttaaaaggtgacaccctttagcactctaggacggcggtaatagggctacctgttaaatagcgacctacgatattttgcaaacagccccctcatagcactctagaagggcggcaaggggtcaacctgcaaaatagccaggcaccctccatgtggttattagaatacaccaacggacatgtgccacgtcataaaaaacatcctttgaaaggatgattttttaaaaaagccctccctgaggatgttaagggtgtagatatataaaactttgatgaaaaaaattatttttgtaaatattttattaaataaattaaaaattttaaaaattcgacatagcttgacctactactgaattcagcccacctacttctgctcaaagacacgagtgaattaagcccacctattttggacaacgaaatcagcccacgagtcaactaagatgcctacttaaggtgtgtttagttcacgctaaaattggaaagactaaagtgtacggacagtccttggggtgtgtctctaagttcctaaactctcaaaatatatatccaaatcctagaacttgtcatagtgtgtcatttaggtcc

SEQ ID NO: 61206 - DNA, 7706 bp, Oryza sativa
agccaagatggggaagggaatgacgaggaggaggacttccttgtcgggtctgcccggggcgccgccgccttcttctctggcgcagtgctcggtgctggggagccccctaaatccgatgccatcgacgccgcatccgtgtcgccgccgccgaccacccggacgccctcctctcgccgccgcttcctcctctctcgccgccaacgccaccacacgccgctccctcttctcccgccggcggccatcagggaggagggtggcggacggctaggcgagcggcgcaagagagagatgaccgccgccgcccgccgtactttacaccacccagcaagaggagggagcagagagatggggagagctggagagaggaggagagaggaggaagaagaggattggatttgatcatttgagaatgacatatggggcttacgtgggccccaccattttttttagctgacatgtgggacccatcatttttaaattattttttctgtggttgagatgtgggcctatgatttttattatttttccgagatataattgctacgtcagcgtcacatcaatgccacgtgggacgtagaactagtcaaacaagccacgtaagcgccacgtcagctaaaactgccgagggatctcgtttgcttgttttcgaaagttaggggatgggtcgtacccggttttgtagtcaaggatgaaaatcggattacgtgacgaatagagggacccaaagtgaatcccagccaaaccgtgtcacatctaatcctactcccaactcgacataagttatcagaaaatgagagatgggccgggccctaatgagctatacgagcaggccgataaacggtccgtaagtgggccgaggttacaaaatatgcgggcccgaacggaattccctcctctctcgttcttttccggttccttcttttccccgacgcagcgcccgcgtggggtggtgacatgggcggcggcggcgacgaaaggggagagtgggaggcggcggtgaggaagaaggtgggggtcggcgggtggtgggacgatcccgacggcgacgagctccgcgccaggttcaaggccttcacggggcagcgccgcgactggccccagcccaagctcctcttctggaagggcctcctcctccgcgtcgcgcgccgcctccgcctctgctccgcccccgcgcgcctcgtaagcgctcgacgcctcctcctcctcctcctcctcccgctcccaccctgcatccggttcgcttgctccctcctctgacaccgcggtggcgctgacaactgcaggtgctgggtgtttggttcgcgcgccctggtggcctcacgccgctgtgcttgccgcaggttctggtcagtatccacgacgatctcaccctatttgctgttaatttgttgccaaacgggggccaaaatttgtcgtcatttcaggaagagatgcgtgccgatggggagattctgctcaaatcggagctaatcgatccgactacagggagcttgtatcagctagtcaggaggatgagccagatggctgtcatctcaaagcagccgattgcgcaggacgacatcctcgtgtttaaatcgttgattgaggtatataagagtttctattttattttttttcatgtgattattgtgccagttctatcgttgtttatttggatatctgctagtcaattgcaggaacgggctgctgaaattgttgatcagctgaggaactctcattggacgtcaacgtgcattgttactattagtaaattcaatgccttcttccatgggcaggaggattctcatgttgcattatgttacttgacacaatgtgggaaagcacggtatattgttgataggaggcaagattctgttgaggtttgtgctctttgttgtccattatcagcaatttcattgcaggaagtgcattgtggtactttacttcatcccatttgtaccttcagggtgtgaagttttcgctcatggctgcacaagttcctgctgtctcaaagcttgaccacaacacattgcacttaattttgacggaagaaaagttgcagcagcagcttgatgtacttgatcgccaatggcaaatgttagtctactttccaactttgtttctgcaatttggatgcatgactagtgcgttataaaaggatatgccatgttcagacattggcgttctgttttagattgcatagaaacaaatagtgtacatttcaacagatactattgcataggacagttctaaacttggtactcaggagtgcagttatctttaagactatcacctgctgcatcgtttgtggtactgtttacttccttttgctagtttcgtttgttatgtaaaagactggcactacacattccattctaggtattatctaactttgtttcatgctaaatgaattgtctgttcacattgttggaaattatgctataattactgtgttttcccttctttatccccaagatgaggggacctattcataagtactaaataaaattatgtttctctaataattcgatgtaatgatagttcaagaaggagggcattggtatccttcaaatctggggataaacagtcagcttatcgatatgtgcggcagtctaagttgttctcagaaagcaggaaaagattcacaccactgctggagagggttgaagaagttataagcctaattgctagtgctgaaacaactaagaaggtatataacttttggggaaaaaatgtttactaaatattaacccttaaaaaaatggggatgctgcattcaccattattcattataccttgacattctctggttaggtaatgaaggcattcaaggcagtattcaggcgaataatgaacattatgtgagccgtaaagaaggtaaacaagcaccttaaaggaggtgatgacccttgttgcaacacacaagagaaattgatgctgcctttacgtgaggtttcatttttgttgttcttttacaaagaaattccagtttcccatccagcaagtttatattagacatgcaagataaggtggtctttttttcatgtggtgatgattttctttagggaaaaacaatatgcagtttttggtattctttgacctatgtattagatttagggctctgtgatgcaatggggaaaagatggaaaacttctgttattcccagccaccaagagaaatttgggaaagatcgcctattttttgacatatccaaaatcaacctagccaaacttgattcagctcaagttcccaaatccaactaacccacaagtccttgctcaagatctcaaatccagctcaatcccttgttttgcactcttgttgctgtcgacagaatgattgctggagtccacttgcatggtctctgccatcttctgcatgttcctcaccagatccactccacagctatacatggagtgaagaaagaagaggacatctaagaacatgcatgtttgtgtgcatacacacggctatgctaaatatgccaacatggctgcagtccgcagctggtccagtgctaacctcctcacaaactggccttacccaagctgctggatgaggcagaaccagaggttgaagaaggtgcaggtggtggagatgtgctggttgctgtggtggtcactgctagtaatctgttaattggatgcggtatacatgcccttctaccaattcaactggtgctgcagcaattagatcaaccatggtaataaagtgatagatggagcataatggaggagtctaggagtgctattgtagaaagactgcagtttagagtggtatgtttgcaaagggggtacagggtactaaaagggcaagtttccgttgttcttttggtggtattttcctgacgtgcattccttctggtgctacagaactaaaccttttgctatatatgtcttctcatctacagcatcaatttgtttccctctgtttgtaaaaggatttgtggatgtttgtttgttcttttcaaaattctgatttcaaatatttttcaggatcagtaatactccagtcaatggattctgaagaaaatatcgaggaagaattcatgaagctggaagcagaattgcaggatgagtttcctcacgttcaagaagatccagtttcacatgccaatgaagaatttcctaatgatgaagatgttgattcattgagcaataacctttcaaacattaaactcgaggccatctagattttcacttattaagtgctacttgtacatatcgtgatctagtcacatcttttgccccatcagtatgtgttgtatttcttatgacaatgttcctaccaaaacagaaattctctattgcagaaatattccttacagggttgccatgaatttgattttttttattctttgaacctcaacatttttgggatagtattttgcatgagtgtctgctatttgaaatctgcctgccctttaccatttgaagtgtatggttgccctctatgtttacttgtgttctgtgtaatgaaaccaaaagaaatatctggttcacatttcatactgcatctatcttaaaagctcgatccttgttactacggtatgaggtcatggaaatgatatatgtgcattttgataataaggcagatagatcagtatcttacatgatattgttttctgatttggcaggttcagaccttattatttcatgaagtgtgcttattataatgacatagccatattatgtgtcagctcatctgatcattgttgcaatatgaagggtggctgcgaagtatggaaggaccttaattcttaactatggaattgattggtcagtaaattgtttttctctgcgcgatactgacatacgagaaatggcttgctcctttacaagaaaggccagcaattgtaaatgtagaggcactgaagaatctgtctggctggtgagtctgttgaattaagtcttttttggtgggacctgttggattgaatctactttaatgtttttgtaacttgtttctttgtatgggatgagtgtggttggacccgggtgtaataggtgacccattttagttcaactaaaacaaactaagttctagttttgaactcctcaaaacgatatttggttcatttagttgacctaagatggggtcacctattacccatgtgtcgacccgcacccgtctcttgccagtgccaataattcgtcacaggttcaggatatgaacatatacccttcaactgactagtgtttagttgtgtcctttgaacgagtgtatcatgaaaaaacactagaagtttcctgtaagcaacggcattggagcatagttttctatctagtcagagagctggctaggaaacacactgtacttctgataacctaataagtactcctaataaatatcacatcagaaagttaggataaagcagtagttggatccaaaatagtttggaaatagaaaattgccatcaatgccagtttttgatgaattaagtttttggcaatgccaaccgaagagaacacagtttgttgtaaatagttttggatgctaaacacaataaacatatgtaaaaggtgctataacatttattttgtaacaatcgtgttagttcaagtcgtaacaatattcctcgtcaaatttcaaactgtaggagtccaaaatcaaaatgtgtatctggcaagatacaatgacatgttgttgtgtttctgactctggattcagctaatcctggtaacagcaactttggactattacaatatatatagatagtgtgtgcaagtaatttatgagtgcccatttccatgtttgtgaaaacattgtgagggggcttctaaaattatccagacttggtctagaagtgttgatgtgaaacttatcctgaactttgtggttctgtttgaacattggaaagaatcttgacaagcaggaaatcaatctgattaactgtgtaaggtgattgtgattgttgtgcccatcacagtatacctctgggtttggttccaataatatctagaataaagacaatagagttctcttatcatgtgcatgtccaaggccaactatcacaacatgaaatgtttcccaggccccatttcttgggctggacccactccagtccttgaatatatattaacatcaatgttgccgttctcatacatcactgtccacaatttccccatactgtagatgatcagggcatacatagttgctgacagacttaaagatgacatcttgagatcgaactaagctaactgtacgcattcaatggaaagtaaaatataggtcataggaaaggagaggtggagaagaaaagagaagcatacgataagctggcaacagtgaataatcttgcaaggcgaagcatttccttattttgagaggagcaaaagatccttcaatgggcgatctgaagataggactgaaaactgacgacaacacatatgtctgaaatttcattataagaacttgaattattggaggggaactttgcttgtgctttctccacatgcaaggatgcatgaatctatcagatgcctgtccacaccagtcttcaaagctacgtcatatcaggaataaaataggagaggaaagcaatcttgttcctccattaagtgttacaataatgctagataccacatctagcttatcctcttacacatgttactgtagaacgatgtgcttgggtaatgaaaaccgtacaattcaagatgtcagggcaaatgaaccagtaacctgtcaaacttgtggagtacaacgaggtgagtactttgttccttttaggcaaaaacggtatactttaagactctggattggtgcagcattttagttgtatctttcatctttgatttcctgcattgtactacctggttacttgttgacatctgagcttattttagtactatgctgcttaattgtattataacgataacacggccactgattgtttaatgcttgtttccttaagggctaacaaactaagctgacggatgaagtcaacagactgatgcaaacatgtaatcaagcatatgtaaaatatgctcatgattgagctttttgcatgtttctgcagtagcatgtgtccttgtaaccgaacaacatacttttttagaaaaaaaatgaaacagcgtactgatttatcctttgtctgttgtatggctaactagtaggctgcaattctcaggtaaattctctattttctagacgtctcatatagtcatatgtctgataaatatgcatttgttctgtgtggttgctaaatccttccctgatgtccggttatattgaactgacatttcactgttagcataattttcagggttgtgatgatatatctccatgttcatataatttgtagaagaaagtgcttctaagtctgttccttctagcactgcaaataatctgaccaaacttgtaagcataaacaactgtgtcataataattcatcattatttgcaccagaaagcgctgtacagtaacagcggtgcaagttaaaccgcgtggagaccaagggatcccaggctcccagtatacagtcataagataaccatggaaaataagatatattggtccaagatttcagatagggcaaaaactactcataggaaactgcactggaagtcaagaattacagcttgtaacctggtagcatcttctaccatctacattttacacaaaattttggggcatcttggctgatacatctgcctcgtggatcttgatactcaagtaagttctcccagtatgaattgctaactttcatatctggaaggtgttagttg

SEQ ID NO: 61207 - DNA, 1898 bp, Oryza sativa
agaagaatgagaagagaatgaaaaagaaaaataaaagaagaaaaaaagaaaatgacatgtcacgtctatgtggcatgccacatcagcgccacgtaggatcctagaggggatgtgtcgatttgggacctaaatgatacactttgataagttctaggacctggatatgcgttttgagagtttagggacctatatgacacaaccctataagtttaaggaccgccaatgcactttactcaattggaaatttgattgaaattagaacgatgtgacgggaaagttagaagtttatgtgtgtaggaaagttttgatgtgatggaaaagttaagaagtttaaagaaaaagttgggaactaacccaagccttaattcagagcaagagtggattaagccgacaacgaccccatcaactaattaggcctttaaattcagcccactgctctgctctaatcacgtccgggttcggggattacaaaaaagaaaactccatagtgcctccttcaactatggagcaagtatgatttacctcccgcaaccgtatactataacacattcttttaacattcaaaaccagaccaatttgcctcctttggtgctttgcatattggttttatccaatgtgacgcggttttacctgacgtgccacatttaacttgattcacatgttctcacacatgttattcaaggaaaaaaaataaaaataatagtacggcccacatgttagccctcccttactgcttccccctctctccctcatgctctttcctctaactagacatttgggcgcacgttgtgcgccctatcagtgagggcaggtagcacaacaatgagagcactcgagcaaaccaaataatccaaagcatagttctattggggagtccatgaaagtataataaaatatattgctgtagacggaatttatgtttttacttgtcaatatcagataaaaccataaccatatggaacaacataaccattttttggacagatagtacgtaaaaaatgtgccagaaaaaacattctttccactgttacatagtttgcagtacataacaaattgtgccacggaaatatcagccaatgtgttgcgcatcctatcaatggacagacagtataatcaaggagccaaagggctaatatttagaacaccacatagttggttgtctgaaaggccattcttaaggcttgattataatcagtttttatatgcaatacaatcaataaaatttgccaaccacattggctcgctaaactgtagaatacatgcaacaccggagtttcatctaagcaaaagtaacggaacaacattagctttcagtcttgaagtacctcagaaccttagtatgtttaactgctatagtaagtttaagtgctatgcatctaaaattagataatatataccccatctgtattttaatgtatgacgccgttgaccttttgataaacgtttgacctttcgtcttattcaaaaaatttatgtaattatcatttattttattatgacttcatttataatcaaatattctttaagcatgacataagtatttttatatttacataataaaattgaataagacgaatggtcaaacgttggttaaaaagtaaacgacgtcattaaaatacggagggagtataattgaagcagtgcttcagagagatgccgttggggagtgcgcataagctgcagctcatggtttttgtaacgttgatcctgcaacaccttcttgatggcaactcttttcctgtctccaagcacttagcgtaaatgtcaaaaccacatcatttcgattcagaacatatcaaagaaatgtactccctccgttttaaaatgtttgacaccgttgactttttagtacgtgtttgaccattcgtcttattcaaaaaatttaagtaattatttat

SEQ ID NO: 61208 - DNA, 1182 bp, Oryza sativa
tcgaaccgggggaagtataatacacactaagcatgcatttccataagaccaagcacattacgtggaagacaatcccgaatgaatcatttcctagaactcgctctgccatatatctaattgtctgcagtgaaggtaaaaagcatcacatgagaaatagagcacaatatctcagattgacatattctatgttgtgcatcagagtcccagcttaccatgactaactaaaattagaagtgaagcatatctattaccttccctagaaagaacagattgtgaaatagcgaacataaaaggaaatcatctttcataaaccgttgcatcaactttgttctatctatggtagaggaatagaccaaatgaaacctcctgtattacatgcacagtatcaaatggaaccaaatttcttgtttgcaattttttaacggcgagaatcttaagttgaacaacaaaaaaatatggggaagggaacactacaacctcatcaaggaaaaaagtggaagcaaggtatgctctgtcatagtggctggtggaatcagagaatgaaaatcagtcttcagaacttctctgtcaaggtagaagtggaaggaaaattgctccagcttctgtgttgtgcttctgaccacacaatttccatcatattgttaggctgtgccatccatcagctgatattgtgagacattgtatgcattatgagattgtagaacatattggcaggttggtagctgatattataccataaggaactatatgcattatgaaactgtagagcaaatgatttcagatctaacctgcattgtccagattaacttgctaggttattatatgccacttggacatgaaacatcagattgatcaagtctcaaccaccttctgttagtaattctcagaagataatgaccatcttctgttagtaattctcagatgataatgattaaatgaatgttgcaatttaggctgcatggattgattaaacaaaaagcagtaatgcaaacaaatgattcaatatttccatcctttattttacttcaatgggtaaattgaaattagaaataatctgcaacagagaagctacaaacagtagcctaggaagtataaagagaatgcagtggtgatcgattgatctagcctaaaagttgctttgacacatacatttcgaagtaccaacagataaaactcaactct

SEQ ID NO: 61209 - DNA, 5322 bp, Oryza sativa
ttagggaggtttaccctgttcctggtcgacaccctgccgtcgaacctggcgagctccaccgcgtagtccggtcctccactctgcatcatgcagccaacccatcaatggccattcgtgcgtgttcgaatataaactaaattgccagttttctcttatgagctaaaacatttgagttaaactggtcggtgcatgcaactcgatacagataagtgagtgtgagttaccaggaagacggagtctctagtggcgagggccaagatgtcggcgcaggacaccctgttccggcattgggggtcgctgtcgacgccggccttgggggctatcaccgtcgtgaacccctccggcttcagcgtctggtcgtcggggttcctccactcgtcgtcgccgttcgggttgatgatcatgaccgacgcgtcgcacccgcggacggcgcagtcgtggaagaagagcctcagcgtcgccggcgccgcgatcggcgactgctgcatcgacctctgcacggacccgcgcacgatgttctcgaggttcgggcagatgctggcgtagtagttctgcttcagctgcgccaccgccaatggcgacgagatcgcccccgccagcgcgaggacgacgacgaaatggaagctcctcatcctgtcgatgtttttctcttcactacttgagcttaaacaagcttgaaatgtaataaattgtgtttgagctcgaggtggttttgcaagcgatgggtgagtggcgtttatatagaagagtaagggcgtgtgtcgtcctcgctctgagagcttctgatccatttgtttaattagggttttgcctcgttgtgagtagactcagaaggtgataatgcaaatgatcatttgtttaactgaggtttaactggtcaatctgcaactggtagttaatggccatgattaatcacgcacagctaagctcaaaacctgatttcgagatgggcaaaactgtgggtcctggctttctgctctattatatatactctctgcatttctgcatatactaatccagctctgatcagatgaacattcctacagatcttaatctcttttgtttttttgtgaatcaacattcctacggatctgaatgtctctgatgaactgagatccgggtatgatacacttcttcggtgtacaaacattattttttttgtaggattcttttttttttttggaaatttttttgtgagatctgtccctctgaatattgatcatactactactgtaattccgtaacaaaaacaaaatgatgatattttgtttctctcaactttggatcgatggaacagcatttctgaattccacccttaaaacaaacatttataaattcatctgttctgcattccagaaagcagcttccattatattgtaccttcacaaaagaaattgaagtagcttccgttgaagaatatagccatgcatgattgactagcacagagtttgaaaacccattgcatactcgttctgtaacgtgtacctccatgatttgctttggtgacgaggggcttataagtgcagtttttttttttttttgaaaactataagttcaatcgcaatctgtgggtagacctgacctggtacatatcgccacacgcaggtgtcaacattaagacgaacacatcacaaaatgggtgcaaaactgtgagctgcaggacgtcacactgggcactgaactcgtccataatatattttttttacttttactggaaacttttaaggtgcactcaagttaatttgagccgttcatctttgatcggacggtttctaatgaatgtgacgcgatgcatttgttcgttggatttaaggacatgcacacacggaagttcggtagagcgtattattttttttaagggaagggtattttttacccagtctctatgttcaatcatagtgtattttttttaaagagaagattattttttacccagtctctatattcaatcggatatatgcaaccattttaatttagaaacctagcctatcaaacatgaaacttagcttttaaataatccaatctgaaattcgctcttatgtagatttgaactcaggaccttaatgtgttatttaggtcactgcaactattaggctacatgccctttcactggtatagtgtatattttgtagagtagcctatgttcatgagtttcttttgttaggaaagctgtatgtacatttgtttttcttacaaaacgtttacaaacgatgatgtcgtacaccgtacactactaatgggtcttgattttctatgactcccaacaaactacatcaaacggttgataagtttctttgtgacaagaatttctattaagtacttgtggcaatgctctttattattatttcgactttggagttaatattaagagctagatcacctagtgtatatactagtgttaatttttgctacaacttggcacttattcctcttgtacatcacggtgaatggtaggtgacagttgagttaatacattgcaaataccaatctttaaaagtaaagtacagaaaatttgccaatcaattaagagaagaataattaatggtacagtactggtcacactcgcgggcaagtacagtaaaaccccccaagttcgagtgtttagatttggtcatagatccaggttcgttatgaacttgcgctttcgatcatgaccctgctgtcctgcatgctactactactagtatagtggtatttcttccttcataacctccgtatcaaatgtgatggaatgtcaatgaaatgctagctaaaccaaggccttgtttggaagattagcctaggactaatgttgagagctaatgttaagtcatgaattggtaggctaaacataagcttagggtggtatgtttgaatccatgggctaattcaaggctaaaaggtggagagagagtagaaaaagaggagagagaaggagagagagagagagagctgttttttgatagtcctcacacaaaattagcctcattagcacctcttggaggggctaatgttttgaggggggctaattcacattagctcaaaattagcccacctgtttggattcttgagggctaatttgaggctaaaaggtgagggctaaacattagcccatggaaccaaacagggcccagagcagaactacggctgtgtttgcaacctcttgttcccaacccactctctctctcattttctgcgcgcacgtttttcaaactgctaaacagtatgttttttttacaaaaagtttctatacgaaagttgcttaaaaaatcaaattgatccatttttttaaaaaatagctaatacttaattaatcacgtgctaatggactgctccattttccgtacggagagaaaaagtttccatctgagacatgtgaacacagcggtacattattttcttcaactctaaactacaacaccctcgttttttcgtaaatacgcgcgcgtgtgtttttctaaatctttttatacaaaagtttctttaaaaattacttgaaaatatttttaaaatctgtaataattattacttaattaattatacgccaatgaattatatcgttttatgtatcaccaaaaagctaaattgaattgcagtttcaaacgggcctaaggcaattgggctggaaagtctctcgctttgcatgcactgtttacaaactattaaatagtgcgtttgaaaaaataatctataggtctataggaatgattcttattaatccacttttcaagtgtgtgataattaatatttgattaattatgtgctaatggctcatctcattttgtatatcttttcaatttgtctttttctcttctcaccaacacacccaaagtcgttgtaccgctgtcccgagctatgcagagcaagtattttagccagaagacttcattaataagtgagtcacccccattcttgctaatcgtgctcctgttcatctcatatgggacaaactcattaattctttgggatgcaaatggtgtgcatcttaattaatactttactcttttcctctgcgaggattattactttattcttcgccattctactaaccatcctagcttgtcccttaaaaaactcctaccctttcttataaaaattctcctatagctagtcttcgttttaacaaagtgcatgtaacctgcatctagaaacaggtgcgttaaaaactaagataatgccgcatctatgtcaggtcaactctgccatttgttgcaacacaaattttgcaagtgctcacttgcaatataataagctaacgtctacgtgcatacgcacgcgagcatggacattggctaagtgccaggccaacacggggaaaattcccacacgcagtgacgtgatttttcggcgagggatcgatcgatctgtttgatatctgacgccttcaccatcctatttgtgcatgtgcggcggtgtctcggcgaagaaacacggttcagatgatctcgttttctataaattataaggaaacgaaacgcttgcttcagctgtgtgacaaactactgacgaaatggtcaagggttcactgagaaaacaaggtagctagctagctatgctgagttactaggaataaattataattcctcgacgggaatatccctcgtacatattttctcaatcaaattcaatgaaaatagttaagaaaaaatttagaaaaaattacatgtatcactccacaaaagtcaggttcaaattatcttgatttacacaatgagaaaagaaaaaaaaagaagataaacctaggtttgaatagtattgttcaatgatggatttatctttttttatttcttgacatgtgagttcagtttataatcgatattttgtggattgatatgtgtatattgtatggaggttgtcaatttttttgagactttatataacttttgaacacacgagagattaaaattattaaattaaggtacaattttcccagcgttaccaaatatttgtaccagtgtgtgcgcacgtctgataggatggtgatgaaatgatggtgaaattcacgtacaccatgttgccaattttgcatggttttatatgcagatgcaacatgcgaggaaacatggcattggttgctgcatgtttccccctagttacagaaccaattacatctaagatgtgtgcaaccaggccatatgcatgcctattttgaccaaagttattttccaaggctatgtgatctagatctatgaaaatgccactagctaagtaaatttgttattaaaaaaataaaagtattgagaagaactttttttttctgatatcaatctcccctatagcacatcaattatctgccgtatgtagccgtgcgatccaaaagatcgttcttgctttaaattcacc

SEQ ID NO: 61210 - DNA, 751 bp, Oryza sativa
  unsure (1)..(751): unsure at all n locations
cgacctagntnnnnnttaccccnnntnnntcgntnnnnnnangnnanngnnnngttaaggaaacggtcgggcgtgacgccactcctaagtcctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgcttcgtctgaagatatggtaacgtcgcttcggtcggcgagcgtaattaacgcgcgcacgatatgatctatctcgactgccacaaccgcatacccacctcatgcgccgcaagcgggctaatgggattagtggaagcgtgggcgcgagaaacgagggggcgaaatagcgggcgccagaagcgaggagccgcgcacagcgttggcaagagtataaaggcacagaggaagggatctgtttccttcctttcgccattattccccttgtcttcgccgcttgcaccctaactccttctttcctgtgccctaccttcgacacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctggcgcgagggacccctcgccccagat

SEQ ID NO: 61211 - DNA, 3778 bp, Oryza sativa
  unsure (1)..(3778): unsure at all n locations
gccgtgnntttgaatgcaatcggctcgacccgattatccgggtactccctctggcccaaaaaaagtcaaaccctagatttccgtgccaacgttttactgtccggcttatataattttttttataattagcatttttattattggtagataataaaaaatgattaatactttatgcgtgacttatctttttaattttttttatattttttttaaatagaacagacggtcaaacgttggacacggaaatcagggtttgtttttttttgggacggagggagtacactgttagctctggcagccagttggggcgcctgaatgacggtactgttaagaatggaaggtatcacatcaatggagctgacaagagctagcgtgccattcatctgccgacgctgttcttgtacccaaaacggcactgtttaattcagccttttcgtcggcttgctccgattcagtagctcatacaataatgtagggatttccggtgtattgggaaacatccttcaatagttcaatttcactgttttaatccattttctaaaaaaaaagggttcaatttcacagcatgacgtcttctatatcgaaaatgttgttccgtatactctctgtgagtctgtgtgcaaggtacgggcaaaagccgcatgtctatgctccttataagcttattgtgttatttttccggcccaaagcatcgagcccaaaatagataacagggccatattctgggtattctgccggcccacatgaattctttttattgaaaccaaaaggaataagttcactttaggtcccttaatttgtcgcccagttcgattttcgtcctcagtccacaaaaccggatacaacgcatcccccaacttaccaaaaccgtgcagacgagatccctcggcagtattgtgcccggttttggatgacgtggcgcctacgtagctggtttgactaagtctccgtcctacgtggcattggcgtggcgcttacgtggcaattgatcccaaaaataatagaaaactgtaggacccacgtgtcaattacacataaaataataaaaaaggtggggccatgttgcggcggtcgcctccagtagctggctgggcgcgaagcgagttgcggcggcgttcccaccgcagctcctcggccttccgcggctgctgcggcgtcggcgacaaggaggaggaggcaacccgtcagttagtagcacaccccgagagttcaatctaagcggccgtggcatggagaagggcacattgatgcagcacacattaccttggagtggcgatagggcacgccggaggaggaagcggggccggaggtggaggaggaggagacgtggagcgcgacgacgagcagcgttgcatcggcggtgatggtggcgcctatcgcggcgagcgagagcagccaccaccgcaccgtcgcccaccgccccgttgcagcggcgcccctcacctttcgccgcagtggcaatggcgtcgcatccgccctgtcatggctaccacacgggaggtaggaaggtcgatccaggcacgggggtcgctccgtgtctcaccgatggggatcgatcctcgccggcctcgtcgtcacggctgtctacgccatctccaccgtgtgatctcgctccggcttgacgatgacgaccccggcaagcctatcactgtcacgcggtgccgcacagtagtaggaggacgatgcccacgaccagcttcgtctccaagtctgaatttttctcctttccttttcttcaactgaagaaactgttgatgtttgattaatctgcagcttgaatggagaatgcatgcgtgcataggccgggtatttgtagccattgattcgggcaatttcgcttggaagcaaaggctccgaaagtgagaacattgagtgtttgacgaatcatgcgaggaggaatgggaagatgcggtgcatgaaaacccccttcttcgccaacggcgcctttggcggtgacgcggggtcgggctttcaggcggcggccatcgcggcgggtgcggacgggaaggtcgcggtcgacgggcggcggcgaggcgactgcttctgcgagcctaaaatctcccccccaaccacgccgctggtctcctccaagaagatgttcggacccgccggcgcgccgaccacccccgccaccccggcccccgccgcggcgctgttaacgaccaaatttggtaaattctatcactattggcatcggagatgaagatcagatcgaagtggaatccaagatgaagatcgttgcggagacagagtaaaaatcggctgcagtctaaatcggctaaggtcgggatcgacagagttcgagttggacggggctagccgatacagccgattccgataatatgacccggtgaacgtcatcgggttcaagttgatgtgcttcaaggtgattgccatgcttggatagagtcctgggaaggcaattatatttattaattaggatattctatgtaatttccttagagatatgtttgggcaaaagtctgccgtaaagacttatgatatcttagagtttgttagagataatagtcgtgtccgttatggacgtatcttgtaattctcgggtataaatagacccgagccctatgtaaaaaagagacaacacatccaatacaatctcggcgcatcgccacccttttttgctttacttttatttcaacgagtttgtgctctcgggttgagctgcatcggtttcgatcttcaacaagaggtaaaacttgtcgtgacgacttatgttctcaggattagtgcttccatctttatgacactctaatcttgtatatataattcgtcgagttatcatatatctcacatagtcttcgataatatctttatctaacctataatcggctaacatctgctaatggaaggcagccgattaggttagacaatgacgttaacttagattatgtgatatatctaccactctatgaaacttccagcggcttgattgtctagatattgttcttcttttcatacttaatgctgcatcagttgagtttgatctattaagtcgtgcttagaattgcaatctttagcctgctttctggttgccgataagggtagtatcggagtttcagccgatcttacctgatttaactacttttattctatatgcttgattgacacgttaaatctgccctttatgttaagattttattgcatctaagtatattaagcttatgtttggtatattctacttgctttaatatcttagtatagagtggtatcggagtattagccgatacatgctagatctacctgatcagctatgttatgaatgtatataatcctactattaatatatatttcgatctaagtgatttatactatctcggcaaggtgaccgatatatcccaatcacttgatttaagtatataccgatataaggattatatatcattaatgtatacagttgatcgagtagatttagttctgaattgcttattgatatttgccgatcgatgtacgcatgacatcggcttgaaataaatgatatgtcatcggcatctagtcgatcggctatcatttataggattaattgcggtttctttgttctatctcttgttgattgcaggatcaaatcaactggcacgctcatacatctgaaggcgagctttggacctgcactggagttaagcagatctcccaggcctcgtgttttctgtcaacacacttttggcacgcccggtgggacccattaggagtcagaaattaatcttcctcatggccgagaagctgccaccgtcgccatcctcggctagcccaggtactgtta

SEQ ID NO: 61212 - DNA, 2176 bp, Oryza sativa
tagttgataagataggaagtgttaaaggcctcataatagcattttagcatagtctaatattgagattatatttttatatcggtgtactcagtatgttgagtccccccaactttttgtttctggatccgcccctggaagctagtgatgctacaattgaacatgattagtagtatatggttctattggagagaaaaaacaattgctaaaaaatatccactatagtttttcacttccaaaacattcaaacttctaatggttgattgcctcgagatccatgcagaagagggggaaaaatagctagtgcgtgcatcttcaagggtttctacttcatgaaaaacttacccgactagccaacaggccacgttacatttgtaattacactttactatagtatagttacatttgaatgattttcttaaaaaaaactgttgaatgttatatagctaataaaaaaatctttggcaaagcacagtcaagctagcttcccatgcgtgcgtgaaaaggaggttgagattaagttattgtttgttactacttattttaggtgcgggtctaccaaagatatgtccctatgtatatattccagaaatcatatagatactaacttatacatcctcaacacatagatgcaccaaccggttttcaatgaataacatactttttaagcataatacatacacagatgcacatattcacgcatatactcacttatgtaaatgacacatgcgtacacatatttaaaacgatcccactaccacaaaattattcaaaggtaacactctattagtaccggttaaaaaaaacctagaacacaaccgctccgctcgcgccctctttagtgacagtactgaagcaaccagccgtgatgagaggtgccggtttaaatctaattggctagatgaccagggtgtttcctaaaatgccggtttatgccaccaatcggcatttatgacccccacttctgtgaccattttttctaataatcctacactaaaaaatgatcgagctgagctataagctaaaccaagcagtgaaaacatgttttaagtcctctcctctactcttccttaccatgttacccataaatttcttgtgatctccatctctccctcttgctctctcggtacctccttcttcctctctctctccacaatcaacagcttgtcatctcactagacaagctctattgcactgccaccgccggcgagtgaccaccccagaaaggctaaatcctacctctgacgtgcaatgacgttagcctctccctcaccaccgtcgggtgcctgcatcttcttattcacccacctctccccttatgagcctatctctccttcgcctgatccatatcctctccggcacataggaggcggcagcatggtggccataaacgatggccccgaagctccatctagccagatttagtggatggactgagggcacgccgggagcagtggcgggctgtgggtggagagggtagtagggctgtgtgggggggggggtgcaacggcgggtccatgtacaggcttggtccttggcaggaggaatgacatcaatatagctggaattttttgttgaaattgttgttcgatctattggatgaatattttgttaatgatctctgttggatattaaaattattgatttgttggagtaatttctatctattatttgtgattgaatttgttatgaatctagctatttgtgattgaatctgagattaatgttttgagaggttggttctgtgattgaatttgttatgaatctagctatgatggatcatctcgaatcaagccgagctgcctgttttttaaaaggaaaaagtatgaattacccccctgaactttcgcggtcgtctgaattaccccccccgaactacaaaaccggatattcttcaccctcaactatacataccggacgaaatacccccctcaatccaatccgcggtggttttggtctacgtggcatacacgtggcagtctagtcagcattctatttaaaaaaaattgtgggacccgcgtgtcagacactactctctctcactctcacttctctctgtcactcttcatctctctctccatcaccatctcacggcgagcgaggcatggtgcgagcgaggcggaggccgcgtgcggggacgggcggtgggcggtggcgcacgagggcgggcggtgggcgg

SEQ ID NO: 61213 - DNA, 18725 bp, Oryza sativa
agaagaagagaggaagagtggaggagtatgacatgcgggtcccactatttttaaaaaaatagaatgctgactggactgccatgtgtaagccacgtagaccaaaaccaccgcggattggattgaggggggtatttcgtccgtatgcatagttgggggtgaagaatatccggttttgtggtcgggggataattcggacgaccgcaaaagttcgggggtaattcgtactttttcctttttaaaaacatgtgtgcaaactcatccgtgctagttcaacaactagcactgttgcccacacaattagtgcgtaaacttaagtgacgtttagggaacctgcactaaggacgttttaaattcatacactccctctattttaaattaattgtggttcttttgtcctaagttaaatatttatatttttaactatcaacttttaaagtgattaaaatccacatactgttttaaattagttgtcgttctaattttgtcataagtcaaatatttatatctttaatcatcaatctttgataattagtgtagtttaatgacatgtaaatatatatattatgaacgtatttctcgtgatgactattaaaacagaaacattatgatgttaaactaagtttttttattgaaacagatagtcacacatacaaattaatgtctaacttaaggtaaaattaatttttttttcataatggaatgaaacattccgacctttgcttaaaagagctacagctaaaggtaaaattaattagaatcacaaataattcatttttgaaacggatcgagtaatctctcagccgcatgcgcgcgccttcggatttcatagtagcatcaattccatattatgaatgcacgtctaggtacagtttaacgaattacgcacgcgaggcccagccaaatagcgagcttttgattatttgacaatgatgtatggcaaaagagacgtagctatgagagctagtgcagtggcctctgaatagtacgtatacatagtactgtacgttgcagcgaaggttcacccgacggagagacgcgatggatcaccgatgctgacagccgctcgctggcttgctcgcggtcgcccgcggctaaatgcacacttgacacaggaccatatgatatttggcgcgcgctagttaatttctctgaccgatgatggacaaacagtcgctgttagctacttagacccgcgcgtgatcatcctcgtcgatacatgcacgtataactaatgagctagagctacagagacctagctatgctatgctatgcatcagccatggagagccaagagttttctctataggattgaataccattgcttcatattttgttagagtttattcaattttataaattttaatgggtttacatataaaaaaaggagacttgcaaatgcgtttatgaaaaagcaatgattcaattgatcaccacacaagcttatacatgtcttggtatgtttttgtcataagaaacccacacataccagctatttatattagccaagcctacatcaatgtgtgcttttatgtggacaagagaggcattgaaagatagcgaaagcagatgctttctggagtactcctctagctagcgtgtgtcttttatgggctcatgtattatatcacccaaccatactcaagcaatctcgatctctagagctaagatgtaatcgctaatggtgagtttggtggtactaggcaaatttcatcggatatggttgggattacctcaataacgaacgagaacacttgtaaattaagcgttgtgctccaccatcaactgtttattgtaaaaatgccatgcagttgtgctagcaccatggccccatgagaagttattggtggtgaagttggtatctaatagccggactatgtgtcgacatatgagcaccgacaaatgtgagaaatcacttgtccaagatggaccaaggctctgggtgcacttgtcttgtccaatagtgctcggaaaaagatgaacacatataacatatatataggtttaggcctcccgaaggtgacaaccggcttacacctgttcttgttcaccatatgcaaagttcgtacaaagtatgcgaagctctcgagctagctaaggttgtgttcgggagtgaccctccctggcacggaaaaaacaagatgggagagttgggaacaactctaaacgcaccgtttatcagtttaaaaatcgtgcgcgtggaaaacgagatggaagaattgggaacattagttctaaacgaacacagcctaagaagcctagagttcttgttgattataccgtccaatcatttctaccaatccctaaatactttctcttatagggatggagccatgcatcgccaatttcattgctgcatgcacttgttaatttgttaagcccacctagcccgaactatctgggggtacgtggctccgccgatgtagactctttaacattgttttcggctgatgtggctactctcgtagatattatgtactcctatattgcaagccaggtgtactatcaaacttgcttttatacacgtcaccatctatatggaggcaatcatgtaagcattgatcagcaccgttgaaacagtggacgcaagttaatcaactgattaaactcagcgaattttataatctaagtcaagttttgaatttttcaaacatgtataaattaaaccaaaatctgttccaattaaaactgcccaagggtaaaatcgtttttaaagtttcatctttccattaaaaatatgatgtattaaactaatagcctatgtatcttttactagtaattaaacaactaaaaaaaattagagtaagactccgtcccgaaaagagagaatttctagcgagaagagtttgtcccgtaaaaagacgacttctaaaaaaacaagaagcattcaaccgctgctgattacgaagtgactgctcagtcggctcattagcatcgatgggtgagaaaaaaattaaagacaactgcattcacacttgctggatactagtactactccagagtagcttctttatgggacggagggatacacattagcgcttcaagattggtggtgcacgggggaaatgaaaaccaatactccgtacttcgtactggcagaatggaacacatcatctctcttataaggcatagcgtgtcctaccgctgagctatcaacacttctttttttagttacattgactatagtacagtatagtatagcgtaactacatcataagggcatcctcaatatttgtggtgtagtgtaaccttaaggtgggccctatgaatagtgagtcattgttaaagccatacccacaatgttatggttagaatttagccataagatggacccacatagaatggaaaaataattgtttcatctcttgttcatgaagtgaatgagagagaaaaaatattttctttttgcttgtggtagaccttaaacataaggtgcaccctaaactaatgctactttccacaatgtatatagctcactttacaagtgcaatcattaccttaaggtcacctttttcatacattgtggttgccctaattatattatagttatataagtttttcactcataaaacttgcgaaagttttttaatataactgcatcataataatataatacttatatttgaaagtttttcactcgtaaaccttacgtttttagatagacctaaattatacatatggtggtgtttgaatctcttaaagataaagataaagatgaaaattaaatgtttcacgtaaaacgagatggtaatagcgtgtgattaattaagttttaatttttacaaacttggaaaatggattaatctgatagtattttagaacaactttcatattgaaagttttcgcacaaaacacaccgtttagcggtttaaaaagcgtgccacgaaaatccaaaacttaatccatccttttaattatagagttgagagagatctctcttgaacggggagttacatctttgatctaaccttttcatgtacaaacatgaccaaataattaacttgcatggagagctagtaagtcttaccggatatgataaactgaatttgatcacgacactgcccactactagtatactatacactaatatgtgtacatgtgtattatgcttagcacaacttaattaaatagagcaattaagaagtgtaacaagcatagcttctttagtttctgtccggtgtatgtatttcttttcaaaaataatatttaactttgaaaaataacttcttgcaaattaaatatgtgctcctagctcttgataatatatatcaagcactgcagaatagaacatatatatgtgacggattgtaaccctcacccattcatcacatacacttacactccacaattacatagactcatcttacataggaataaatcgccataaacttaaaataattaaaagtgacaagtctcaaaaccaaactgtgcatgtttctcgaaaagaggaccatcacattatgcgaagttaatttaaaattgaaagaagtaatattatgatttatgtaatgcacagttgaaacaagaatgttgtagttaaatgccacataattatttgtttgagacattttagaaacaataattgttctacacgaaaattgcagtagttctctctgtttcatacggaagctgccttgtctttcgaagatatgacttctgcaggtaagaagatatagctatatttatcctctaatagccgcaagatttatctctccaattaatgctcctaacttgtgccggtaaaagaataaagttagtatgttaaatgcaataatatcgcaaatttataaagcatagacataagcacaaatcacaaatttaacgaggtcaatatgatgaagttccacacatgtttcgcccaacctgttgatagcataagaagtcaatatgatgatagagggtaatgtaattttttggtataattaaattttgagacactcttcgtcttcagcgcctcctcccccgcctcgccgccgcctgagcgggcgctggcaaagccgtgcgcccgcaaagacggcggcggcggggcctctctccccttcgcgcccggcggctggggacgccgctcgtcggcgacggtggtgcccagatccgccatggctggccggatctgggggagcggcagtcggcggcggggaatgaaggtggcggcggtggacgacgcggcgcgggaggtggcggctggggacaccgctcgacggtggcgatgcccagatccgtgcggtgctggctagatctgggggagcggcagccggcggcgaggaaggaaggtggcggcggtggacgacgcggcggcgctagagttggcggctgcggctggtggcgactgcggctggttggcatccgcgtcggtgactgcggctgccgacggcggtagaggacggcggcggctgactgctggcgaggaggcggctggtgacgaggcggcggttgctatggtgactgctgaggcggtgacggtggcggcggctactgatgcaccggttggcgacgaggcggcggctggcgagctgtggcggcgagcggatggctgctgtggtggcagctggtgaggcagcgccgcggcggtggcggccgtgtctggcggcggcgactgccgacggtggcggatgcggcgacggggaaggtgtggagaagtaggcatggcggcggggacggatgcggtacgggggtacgaacgcggtgttgacgaccggaaacgggcgttgatgaccgcgaaagggcggcggtggcggtggaaggaggcatggcggcctcagacagctagtcgagggcgtggcagacggctgcatttggccggcgcggcaatggttggaggagggtcggaaaccggcttggcgcagaaaggcgcaccgatggtagcggaggccggctcggcgcgagaggcgcgggcggtggagatggaggtcggcttggcgccaaaggcccggccggtggtgggaagccggatttaccccaaggcgcgtccggtgaagaagcccggcttggcgcgaaaggcgcggccggcggtgaaggaggcgaccttggtgcgaggaggagctgccggtgaatgtggcgcggtcttcggtgcacgaaggctggccggcgggggcgccggtgcagtggtcccacatgtcggcagaggttgactggtggtggagcatcggtgcatcagccgtggattcgcaggtgttgagcagcgggtgaaaacctagcccggccttggccgggcttgcaacgatggttaattccccctcctgagggcgttgtcgtgctgtctcatccctcacgggtggttgccgggcgaaagcccagtcttggctcctttgagccctgacggacgggggcggcggttttccgtcgcttctcttcttgaagacgtcgttttgacatcccctagccgaagcctctcgatcggtgcaagcatgctttaggagttggctttgcgttggttctgagggtgttcttttgggggatctcgtctgtattcctttgtcgtctagcggcggccggtcacgcttagcggtggccggtccggtgttagccttctcccggttatgtgtcttggcgctgtcggtgtgtgggtggcggtatatttttttctttttccttgttacgaccctccagggttgtaatcttgtaattttttcctgctctatcaatagaacttcgcaccgtcttgtgcgagtcgttcaaaaaaaataaaaaaaatttgagacattttacggtgcttggaaggtatcctgggtaccttcatgtctaataaatattcaccgttgatcataaaaggtaaattaggaataaaaataacttgaatatgggtaatttggtaattgtttacaggcatgttaatcattagctctgtcgggcctgcggcaacaactccctattttagcgcgctcgttctagttcctaatccttattcatgtgtttcagcgtttgtttaactgtatattgctgatccaaaattataattctttctgctgtgccgctgtcccagaatcgtctaggaccctatcacgtatttcctcatccattcatctatgtacacacgagagacgaatacctatcaatcctcgttagtgagagagaaatcaatccctgtttgtgaagccttcgatgataatcagcttatgattaatttggtgagttgtaattggacacggaatactcgacgaatcgattactagagtttagttttatatcagttgtacgatcaccatgcatctcagtttggccgccggacgaaacaagaaaacaccgtacgtgatagaagaagctatcagtttacacaccttttgaagcgatggggagaaatttacttatctaacctcccaccaaaacttttaagttaatacctggcccacactttaatacctttccatcagtaccttctatcttagattgtcagattataggcaatgaacggatctcatttatccccagcaccggagaaaatctaataaattttatgtactaaatgtacacgtaatttgatttttttaagtaaaaatagtatatgacttctaaaattaaaaaatgtcttctaagttctaataataaatggagtattcagcagcatgcaaattggagcctacaccacaatccattggattctggcagttggcatataggtgggtgcggcttcacatcgatctccaatacaggtcgatatatacaactagttatcatggacaaaaaatatcatgtagtatgaaccataattttattatgtagaaatttgaaaagaacattcgataaaggtattttaaaaatataaaaaacaatctcatataaaagggaatatgttattattacctttccttttaaatatatgacaccactgacttttcttcatttgaatattcgtcctttctagaaaatttgtacaaatagacaaacatacaagacacactcaaaatacttttgatcataggtctagtagtacttatttcactttgcttaactaaattattgaatagatagtagtgatgaaagtttgagaaaaaaatcaattgtgccatatatttaattaaaaccggagggagcatcatagacaagacaaccatacaaattaaattccagtatcaaactcgaccatgttagtgaaaacactattcctgatttttcagcttttgattcattgtttgtcaattttatctcactagctagccttgaaattttatatgactatacaatgtcatcttacctacatttataattttgaaagaaaatattctgtgaatgtggttttatatatgatctttccactgatgtatatatatttacccgctatcatggtctcaataactgatgaagtaccggttaacacatgattaatggcacgtaagcagaaacacatacacacgaaagatttgctcaaatatgagtttttgggaaattcatcgcaattttacatggagtagaaaatttccaccacttggttacaactgggctacacacatatacttcagctaatttaattgggttgtgagactaatagctggagtgcgtgtaaacgtacgtggggcgatcgaaagatacaaatcaagggcgtgattagccgacgatgctgactactcacgtcactaattgggtagttgcatcctaattaagcagcgctaggtactgtttaattgctcttgactcttctcgattatttatcactcgacagtccctttgcctttcagttgtggtcaccgtggtgtagcatcctggggcccctccggatttacatggatacgtacgtagaaaattaattaatgtacatgctacgtacgtgctcgtatctacgtatatatgctagctttctctatcttcttattccttttcttctcctgctgcaacggttggtaagctctcttcgaatatgtcttttaaagatgttctttttttctaaataaaaatatattatgcatgtataaaatttatatcatgatcacttaatgacattagtagccgtcatggatataaacttcttaaatatataaaataaactttttcaatatgtatagaagcaagtgatgtactcctggtcgacaatcaagctagctaattgggtgatgatctagttaaatagatacggccacctcaagttttattgtggggctaagctagccacccatacctttttattttaacggtctacacactaatagccattcccacatatctagaatcgtgattaaaaaattactccctccgtttcaaaatctttgacaccgttgactttttagcacatgtttgactgttcgtcttattcaaaataatttatgaaatatgtaaaactatatgtgtacatgaaagtatatttaacaatgaatcaaatgatataaaaagaataaataattacttaaattttttgaataagacgaatggtcaaacacgtactaacaagtcaacggtgtcaaacattttgaaatggagggagtattagattgtcctagccgctcacataaagaaaaactgaaaccaatcatatcaaggaatcaaaagggttaacccgtaaacatgagccctaacccatacaagcctgtaacatattaccaacatacattattcacttatttatatatctccttatcaccaaactaataataagtatagttgtgtccatattatcatctcacatggaaacaatgatggacatatttttttctttcccgagtgcgctactttaactatactttcttttaacctctccctctcacattgtcttggtgtattcaatttattattatctttcataagatattgtctttcaaacgtttttctctttccacaacattctttatccttggcaatactctatttaattcaatgcaaacactaacccaagttatagcattaagtgtgtcttaaacctctcttctaattgttattctttagcttatcacctcatttgaaatactcgaactcttttttttatcacgatacttcttggaagtttttgtcacctccaagtcgttatttatatgtacccaaagtaatatgcatcattgacatgagtaatacactaagaatcatccatcttattctagaaagtatatcctagtgtatctactctcttgtttggttcttaaccaccatgtggctcttcaagctcgatttgttcacctaacatcctaggccccgcaagaccttggttttcttaaccaagttcaaaccacaccactgatgaaaaagttggctccagtgccaccaagtagtcaaatctaggttctaagttcttcatacttgaccatgtccatcaaaatatgtatcatggagtccaatgtaacatatataacatatggagaaaccttaaacaaagctagatcctcaaacctaaatcctggtatataattaccaacctaaggacaacttgacaagcataatatcatttgatcaactactgatcaagccaacaccaatctaaatgacaactgatggtctccttagacgaggactatatagccaacataaatacaatgggccaacactagccaggtccgattacaacccttgccgacaaaacatggtgagaacagatctagtacaactcaaatctttggcaattgttcataaacactacatcgtccctttcaacatactatcacatccctccttctctatacaaagtgtacgcaattaattcttcatggtgataggtgtgaccatgacaacagtgaatgacaaaaagagaaaggtgaaagagaatcactacaccatgtcccaaaattggtgtcagatggctgttgaaaaagaattgacgttagcttcaaacgatctgtcatgaaaagctcagtgtcagatggtctgtcagtagttcttttttaaaagacagactgtctatcggcaatgctactgaaagcgaattcctagcacggcccctaactagttttacggaaagatttatgcaaaagtagcttgaatctcataataaaataaggttaagaagcgaattcctagcctctagccatgaagttgggaaaaccaattcccgactacatggctagttaatacgttacattgggtactctgacatgaccaattttggcatagtcaatcgaccctccagcacctaactaatccaatagtaccaagtgttcccggccaaggttataagacctggtgatagttaggcttaacgtaataggatgaaaagaaacgactgcaaccagtagcgatatgagaaaacatgatcaacagacaatattgcgcattggatatgtataaaaacttacataaattaatgcatggggatgataggatcattacaacactggtcgagaaccaggtgtatagtcataccctaaccactcgtagaggtggtaggaggatcgctactacgctagtcgaggaccaagtgtagtcgtacctcacccactcgtagaggaggtgtgaggatcgcacattggtcgagaaccaggtgtctactcgtacctcgaccactcgcaatggtggctcgaggatcgatacaatgttggtcgaggaccatgttgtagtcggacctaaccactcgtagaggcagctcgagaatcactacaacgctggtcgaggacaggttgtagttgcacccgaccactcattgaggtggctcgagtattattacaacgttggtcaaggaccaggttgtagtcgcaaccgaccactcgtagaggcagctcgagaatcgctacaacgttagtcgaggaccaggttgtagttgcacccaaccacttgtagaggtggctcgaggatcgctacaatgctggttgaggaccaggttttagtcgtacctgtacctacgcaccactattgtcgggctatacccacggatggtatttctagagtatggggatcgttggaaccagggtatacacgagattgaggtaaaaaggatggagacatggatttttatacaggttcaggccccttaactgacaggtaatagccctactccaattggctgaagccggtgttgcccttatatatcagtatcacattacaatatttgggatgacctaatctagtttttatcagcttggtgacatggagctctaacacgtagttgatagctagtgtagtcttcttccttgaacattaattcaatgagattggagatagatctagatccctcacgtcggtctctgtggctcctacattagatttatctaaatctatattggcttgtcttttgttggtatgtaccctctcatcctaagggttcttatattatagcaaagatcatcttcctctccaaatagaacttagagaaacagaacaacatacggactaaatagaccttatcttccccgaccaggactctaacaccttctattacgggaagataatttcgttctttatccgccgtatttccttagtcaaagataccttctcgtatactattaggtatatggtatttccgtattccgtgaaaacccatgtattggaggcatgccttatccttgacattgacagggataaacccattgtatcacccaaaaaatattgtgtttgtttacaaaaacacccatatcaactccaatattgtgtacaatacccctctcaactatcaaaaccattcactttaccgctggttccaaactaaggtggtatcaccatgcttatgtggtgtctagtcaacccaagaaagatttaaaataggaaacatatgttaacgcctattcatctttgtcaaactccatctctcccatcttccctcgagcctatcatgagctcataggtgttggccaccctccatgagctagccacctactcagctgtcgtctcactctaaaagctagctattgcggtgcgtatcctccttgaaaaaaaaaacatgtgccaatagtgatgatatccaagctaggggtgagagagagagaaagagcaggtcaagatcagtgctcgtggttgcctttcgaggtgattgcctaactaatacagttggattagggaatatgaggcaggtaaagtgaccttgagctcaaccacaactccaagcttgaggaacagagcccaaggcatgcagtataggtggagtggaggggccttggaagattcggtggcagagctagcgagagctctttgatttggtggcggtggaagcggaaatcttgtgcagagcactattttccatcatttgtttctctggtcacaacgatggccaagacccctgtcctctatggcagcgcgctctatatttatgtggtcttcgtcgaggcagcaacttctcgtgaccaacgagtagggagctaggtaggagagcatcaacaactcgactaatttgccatttgctgccaaattagtggagacaggttgggtttcgactttggctccatcgcatcccgagatccatgagaatgaggaaaacatcaatcttagcttgaggacgagaaggacatttattcaccgactgtggtcactatggctcaaggagacggtggagcttttgtgtcgtctctgtgttatcaccatcgaggggagaaggatagaagggatggaggaggaagatcaagtggttagtaaaaggaggggcctatagtttttactgtaagcaccaggtaggtaaaagatgaagtgaacaatttcaatagttgagggggggggtattatatccggtattggagttgaagggtgcttttaatacaaaggcaatagtgacttatcctttcacagaaattctttacgccctagatttttcgctcaatccataatatacctaaaattttcttcatcccttacgtgctctcaagtattcattttgatccttccatacctactatgttggttggccatcatatcttcttcaaataactatatttcccttggcatatagaatttgtggacaatgcatttggaattgatttaaactttgtttaaattcactaaaaaagccaaatgttatttttaaattcatgatgaaaatactgtaagttatagtgattaagatgttttcaaatcaatgttttgatattggtatgaggctttcaatttagagttgtgagccaaaggccatatggtcatttagaggaaaaatataacggtcaactaataggattgacaggaaggtgattaaaatgataactcaggaatgtacggaatgaagcaaaacttaagagtaaaagagaggactgagaaaataatagtagtgcataaggattattctctatattttaattacgctggaaccttttcaaaggatgacattttaaaacttgaagactttaagttttacattttacagtgtaaatgtcaatactattaaggtctttcttttttcataaaatttatgggaccaggtgactccacaactattacatggctccgcctctaggtacttcgtatgtgaaacaattcaattttttgtttacatgttgaatacatatattctaactttaaagttgaagtttcattttggaaatttacattttaattagtctggctaccaaactctccttatcactggatttctttatttagtttttcaagcatagtagattaggttggagcgtgctctctctctataactacatactcctccggtcataacaatattttgagtgttaaggataagatttgattacacttttgaaacattagttattaatatattctcatatgcttagtttacagaaaatggtataggaagatttatcttgaaaaatacatcctatataatatcataaacttattgatattatagctagattaaagtttatgacgaaatattgtcttaaatattaaatatttaattatgatcggaaagagtacttagggatataggtggtgagacatttttttgaatttgatatcctgttgccagctattaaatcctcacaagatgttagacaatttcacgcaaaagggattctaccaaaaaaaaggttgggtacgatggcccgctaaacaaattgttctcagctctcaaccaagctctaatacatactttccccatattttaatgtatgacgccgttgattttttattcaacgtttgactattcgtcttatccaaaaagtttatgtaattatcatttattttattgttacttgattcatcatcaaatattctttaagcatgatataaatattttcatatttgcaaaaaaagtttaaataaaatgaatggtcaaacgttggttaaaaagtcaacggtgttatacgttaaaatacggatggagtatatggcgaggacagggtgtagcaactaccaacaaaaccgtcgctcatgagaaaatgtgtatacgtgtgtgggcatgcatacgtacatatggccagctagcaatgaaaagagaacaaaaaggtgacaacgacccactatgacttatatataggtcatggacaaactaattaattaacacgtttcatctcttttttcttctccttgatctttttcttcctcgttgcaccacgtaaataattaaactcgtaaaaaatagctgcatattttcctttaattatttgcagtttaattctagagtgatagcaagatgttgatacacacaaacacacacataattcaccataagtgcacatcatatcgtgttagttggcaacttggcatgcacatcatggccccctgctaggtttcttagcttcctacctcactaattaagcatgggtgtgttaacttcactattataattaactatatggaaacctgtatgttactggctgactgcgaagaatttatacggtgaaatactacattatagctgaggtacagttcgggctccatttgaaatgcaagaatttcacaggaaaaaacttaatttccatgaaaacaagaaaaatttcctatgttctaaacgagactagatttttctagctttagacaaacaaataggttttacaattaactgtgtatacaatctgcacctatattggaacaaaacttacaaaaactaaaatggaaaaaagtctatatccccccccatcccctattttaaactcttgatataagtccgtcatactctcaactttaaaatcggatatccaaccccataaattttataatactgttcaaaatatcctgtaaggtggttttttttaatatttgggagcttaattaatgagcgggtttaaataactgatatagcatgtttacatgtcgtcaatcatcgattattaatttatattctatgatgatgtcatattagtattatattaacatatgtttataagtgagcaaaaaataggggtaaaaataaaagatttgaagattttaacatatatgtccaattcatatatcatgtaaccaaactcatccaacatatatgcaaatcagaccattctgcaaaattagcttatggtgttacataaatggtactgtcactattgggaaaacaatttttgtagacaaggtgcatcgatctttctaggcgggtaaatattgttttcaccatctgtccgcctgcaaaataggggacgggggtcgaggtggccatccgcctgcgaagatcaatcttcccaggcaatgacataaggtggggaatagctacaaacgagggagaagttgctagtgcatatatactggacggtaatactctgcacacatatttatttaaaacaatacctgcaatatataactaattccttctatgtgtatgtcatgaagtatcaccagtaacctaaaggcagtgtcctttgcggatattacacatgcgagttccttagggttaatgggagatacatgaccaacgtagagaatgtacgtctcaactcaacatataagtcctgcgaagatggaatgcacatctaatatactcatgctttcatgcatgcaattgcttagaatcgaacatcgaactagttttgacgacgaagccattataaacatacaacgtgacctctgccactttatccaccacgagtgttgtcataaagatggacttttcttcgaccccgaaggcagcttagcgatgagcgacgaatacaagtccctttaggagtggagccacatgcttgtgtaattaagggaatgacagtattgtaaataacacttttgcactaattaatgcatccaatatatgtgtattatatcctcattatatgtttgttagctgctagatgtatttatgtactaattaattaactaattgcaatattactgattaaaaattagtatttaaaaaatttacggaaatatttaattttggagtgaatattttcctaggcggccgtaatgaacgccaagctacacattatcgtaaacggcatattgtggctatgtccacatagaaagattcattttgcaggcggactatttaagaggtccgcctgcggagatggatcttcctaggcggactggccgtccgctcacgaaaatgggtgattttagcaggcatttacctacaggaggaccggccgtctgcttgagaagaccaattttaaatgcctgcaaaaatagttttcctagtagtatgtatagttcaaggggttgaatatccggttttaaagtttcaggctgttagatggactttcaatcaaaattttgggggtatttaaaatttttctaactaaaaataattaaaatgatatgggttcataagaaaatagagaacaatatcgactttgtcagctaagtttcaccaccttttttatagcaaatgtttcatatactacaatttttttaacgaatcgacgcaccgccaatttcattgaataatgtttcatatactataatggttaccgtggttatgagatgtggtacactttctttctttagtcgccagccttccctgtcatattaattctcatttctacggcgagcacaagatatatcctaccataatttctgcatacatctcataaaagtaccatggaagttttctgaaagcatatatgtgtgccctaccaacggcgtcccgttgcatatgccaatatatccggccatagtatatagtcccaagaacatgacgccaagacggaaccggccgttccgttttgttgttggcttaatttggtccagccatatgcatatatagcgtgtgcacacgcactgttgctttcaatctgtgctcccacatatatttctagagtactgcatgtagctagctcgatcagggaccatcttgttattacatgctaagtgctacaataatatagctcttaaatgcctcttaaaattttcgttatcgtacgtcagccgttgcattcagatcaagctgtgaccggttgtggcaaaggaggtagtttttagttagtttaattttttgcttgaaatgaaaattttaggttattaaaacggaacagcatgagctaacaaaaatattttcatttcagaaaactcctttcaggtctagttgatttctcccgacgccaaatatttttaactaggaggagtaacattttgggatgcaggaattttataagacttttttttgtagaaaagctcaatcaattctgataaaatttctctaaaattcttctgattcaaacaaatgtggctgaacttatgaatcaaaattgcaatttgggtttcccagagtgtacagtacaactaacaactttgattctctcaaagaaagaaaagaaaagagtgtaaaacttggaacacaagcgaccgaatgcaagttaagcaaagttaagcattgagattaatcattgcagtcaccagggaaggttgggccatgaagtgggacccacagaaaatgccttgtttgtcaaacctgctttttcccgtgacccccttccaatagaaaccttgcaaatggcctttcttttttcatcaggtccgcttctctaatccgaatgcctttaattattggggccctcgattaatgg

SEQ ID NO: 61214 - DNA, 14962 bp, Oryza sativa
agatgtgaatctgtaatgtattattgtgtaagatgggaatctgtgatgaattttttagaaccctgtgatgtaatttttttaagagtttgtaatgtatttggagatgatttgtttgaggatttggagatgttctataatatgtgatgatttggatatgggaggggatggtgtgaaatcaatattcaatattaaaagcagaaaaaaaaagaaaaaatatctttagtcccggttggtgttatcaaccgggactaaagatgctcccatctttagtcccggttatttaaaccgggactaaagatagcgatctttagtcccggattcgtagtcccggttaaaaaaccgggactacagggggttacgaaccgggactaaaaagcatttctccaccagttatggtattctccacgagtatgacatactttggacatgcaaggactcaaaggagaatgtgaagacgtaactgattacatattatatactgtacattacaattaagaaaaacatgcaagacaatacagcagttaactagtaagagaaacattaggtacccaccgtttctatcgataggccggaatacaatttcttacgtgaccaacgatcgaggcaacgaccccgtatatatatatatacagcatgaatgcacacagctggatctcaagaaggaaagaaaagctaatctattatattattaaagaaatagaaaaatgagcctctacgttcgctctcatggcctagaaattctcacattaattggagaaaaagaaaaagcagagtccatataaaaatacaatttagaaatagctgaaattcggaattaaaaaataaagaatattagaagaggagactagagttcatatagaaatataattagaaaatagctgaaattcggaattaaaaataaggaatattagaagatgagtatagagtccatataaaaatataattaggaaataataaaaattcgtaattaaaaataaggaatattagaagtagagtatagtgtccatatagaaatacaattaagaaaaaaaatagaaattcggaattaaaaaataaggaatattagaagtagagtataaagtccatatagaaatacaattagaaaataatagaaattcggaattaaaaataaggaatattagaagtagagtagagtccatatataaatacaattaagaaaaaaaatagaaattcggaattaaaaaaataaggaatattagaagtagagtataaagtccatactaaaattcggaataaacataataaaattaaaagtagtgcttagagtccgtataaaaatataatttataaataactaaaattcaaaattaagaaaaacatgggaagaagagtttaaagtcaatataggaatacaatttagaagtaactgaaatttgaaattaagtttagagtccacgtagaaatacaattagaaataatgaaaattcagaaattaaaacaataaatattaaaagacgagtctaaagtccatataagaagaatatatataatttacagataactaaaatttaatattaaaaataattaataactaacacgtatgtaaaatacaatatgaatattacacattagtggtttcgtaaagttattgcaaaatttaaaatgatgttgtcattttaatatatttgaataatataatgagaaaacatatgtgctattatatgagagaaaatataatgatactagccgcacaatctgtacgggccaccatgctagttaaggtgaagacaattgattaagaagcaaccttgatcgagctagcaacaacagcgtcgaccagagaggaggaagaagagatcgaagaagatatggcggtggcggcgccatccttccccgggatggtgcaatggtgggaggagtggcagctccgcgtgctcgctctcaccagcctcttcctccagctcttcctcctcgtctcggccacgttccgcaagtaccgcgtcccgcgctcctccggtcatgcatctggctggcctacctcggcggcgacgcgctggcgatctacgccctcgccaccgtcttcaaccggcacaggcaaacggccagcacagatcatggctccgtgctggaggtgatgtgggtgcccgtcttcctcgtccacctcggcggccaggacagcataaccgcgtacaacatcgaggacaacgagctgtgggcgcggcacgccgtggccatgtcgtccgaggcggcggtggccgtctacgtgttctggaggtcatggtccggcggccaggtgccggagagctccccggcgctgttgctgttcgccgctgggttcctcaagctaggcgagcggctgtgggctctccggcgagccagctttaccaggctagccgccgtgaggtcctccgccgccggccggaggacgccggcgagggaggaggaggaggacgccggcgatgatcatattccgttagagagctatgtacacctagcaagcggctacgtacagagccaggctactggtgaccatgtccctaggcccaaagacaattacgtgttccatgtccatccgctgatcgaacccgagctccaagatgtgctcatggagctcttcgtcgacttccctgcaccctatcctcgccgccttgcctacctcaggtcgttcttggcgcttgaggacgacgacgcctacgaggagctctgcgccctgctaaatcaggcgttccagttcttctacaccaagaaagaggccgcgtacaccgtcgtcggcatctaccttcgcacccttcaccatgctcctgggcatcgcggccattgcaagcttcaacgacagtcgcaaggacgggtttgacggcagcgatgtcgtggtgtcatacgtcctgctctgctcgacgctcgtgctcgagatctgcgccctgctgtggctagccgattggcgattcgtcacgtcgcggatccagccggagatgcagcgcacggttgcgcagttcaacctaatcggcttcgccactcgtagacggtggccaaccatggtggtgatgcggatagcggcgttgttcagatgcaaaaagtatgtcaaccagcactggtatcttgggcatctttcgtcaacccccataatcatagagttcatcggcaaagacttgaaatctagatgggtggatgatctaaccaacgccgccgcctaccggagattcaatgaccggagaggccagtggactctccggcgagagaggtgctaccaagagttgggatggagcgtgaccgagctgccgtttgacgaggccgtccttgtctggcacatcgccacggacatctacctcgattgcaataatggcatcgaaaatccaccggctaccgccgatgagcgcgccgccgtgaaatgctcgcgtgagatatccaactacatgatgtacctgctcttgttccaaccggacatgctaatgcccggcacccgacagagcctgtttgctgtggcctgtcgcgaaatcaagcacgcgttgagggaccagaggcagcggctcgatgagaggggagttgcacgttggatttctgaaaacccaaatgctgcacaacctggagaccatctcgcagctgcacgtaggcttgccgaagcgatgatgcagatgaacgatgcaggaaggatgttgaaggttatcagtggggtgtgggtggagatgatatgctactccgcgagcagatgcaggggattcctgcacgccaagagcttgggtgccggcggggagttcctcactgtcgtctggctcctactacatagaatgggcatggaggtcttggccgacaagctccagaagccggagattcctcgacatgtacaaattcttccttagctttgtttttaatccataatcctctgttaaaatgttttgaggacaattgtcatctacatgttgaatgaatgaatgaaattaatgaatcagacatttgagggtgatcattgtgtaaacaaccattctagttcttgtattctatctatctaccatatatagttcaccaactgagcggggtctcatgtacatatacaactgacacttatattacttattcatcaaatccaatgtcccacgtacatatacaataattagatggtcacgattgactccacatccctctgacacccgccgcctcatcccacccgacccacgccccgctaccctctccacccgtgatccctcccctaaccctaatgtgcgccgatgccagtaacgatgaagaaagggaaagagaggagggagggagagaagacccggtcaaaccaaacatgtagacaccacgtcagctgaaaccgtcatccaaactgtcttaggatcaagtttgcaccggtttttagagttgaaggttgcattgcatctcgtattttagttcaatgatgaattttagactcggtgtcaaaatgaaggatctaaagtgaacttattccatgaacccacaccacgtacttcccatcaaagaattcgtcggtccaacccacacgaactggcgaaattggttgggaataagttcacttagactcccgttgagtaatcaaatcttatttgtatccctgaactacaataccagatagctcgaccacccaactattaaaaccgatgcaacttgactccctcgacagttttcaagggcggtttcgctaatgttgcgcctacgtggtggtattgacctagtcttcgtttcatgtgatgttgacatggctcttatgtggcattaaaattaaaaaaaatacatgtgggacctatttctcattcacataaaaatattataaaacccactgacgtggtagggcccacgtgtcattctctctccttcccttcttcctcttcccttctctctctttctttccgtatttctcctcccctttgacgtgcgcggggagcaggggccagatcggtagtggtggcggtggcaggtgggggttggagaggcggacgggcgctggagcggcgacggcagcatgtggagagagggaagaggataaggaaggatgaggtggctaccttgcgacggtgcgagaatttggattggtggcgatggcagccggagagggaagagagagagagagagaagggggcggtggtggatgaggatttgggagcgggaaggcgagcatggggtagtgtggcgaaaagcgaagctcgctggcctttttataggtgagcgctagtgctacacggtgcgggagagaggcggtggtgtggctcccggtgtggcatgtatgtgctggccgtggcagtggcacaatgagcatttggcgtgggtgacagcgccatgatgacgttgggcagcgtggggaagatgggatgcagggcggccgcgacgcgacgatgatgggttgagttggacggcgccctttccgccatccaattggtcgcaggcggcgatttaaatgacacgcttccaacaggcgtcgctgtccttctcccgtcctttccctcctaatccaagctgtccacacgactcccgtcctccactctttgcttcggtatctttcgttcatcgagaaccgccgccattcaccagaataccgtcagccaccatcggtcgtcgatgcgctcgcctgcctccacgtcgcacggcttcagcaagaggtggccgctgatcgccccaccacgctcagggcgctcgacatggggctaatcataggggggaaacctcttccgggccgacctcgagcccgccatagcgcgcatcatcgccgaccctggtaacgacggtgaagcgaaggccatcgatgaggagacccagccggtccttggttatctcccgcagcagcgtagccctccgcccctcctccgccggcggcgccctagcccgtggccaaatgccaccgcctatgctcctgctcccgccccccccctccaaacgaagagaaaggggagagagaaagagagaagggaagaggaagaagggaaggagagagaatgatacgttggcctcacatgtcagtgagtcctacaatatttttttatgtaaatgataaatggatcacacatacatttttttaattctaatactacataagcaccatatcaacatcacgtgaaatgaagaccaaatcaatattgctacgtaggcacaacgtcaacgaaatcaccctccaaaaccgctgaggaagtcaagttgcaccggttttaatagttgaggagtcgagatattcggtattgtagttcaggatacgaatcaaattcggtcactagataagggaatcacactgaacttattccaattggctgacatatttttagcctacgattcagcccatccaaagacgaaagaattaggccagataggccgggaatgcatctcatctcatgttagaattgctcgccacggcaggcctgcagcagacttgatatagtttctttacgagaacccttcaattgagagttcagacaagctcagatggcaggaaaaatgcaattatcacatcaattatgctaatactgggagtctgggacgccccaaaaggaaaagaaacaagaaaagctaatccagggacagaagccaccacaagctaataattcactaataatcttgtatggagtgccaaacttttacatccaaaaagttccaaataacatgaaaacctggaaatttcagagcacatgcatttcactttccttctgttctcccctcttttttctaccagaaacgctaattccaaacggagaagtggagggcaaaataaccagcaaaacaggtgtggcctatgcctttgcctgtacagcctgcatcttctgttgcaacttgaagatctacagaaacaaatatattttttagtgaggtcttcaaaataatcctatttcatagggttcaactaaatgcaatgtcattattgtcctatgtcatgctctgatgatgtgcaaagtacagccaagtcaatagttctagaaaagatttgtagcaattaaactaaactaatctgttaaccgtgccaagataattgaaccttttacggttagtatggcatcatgtaagaatgcaggaacctaccagcaaaacaatttcaccaatactatctcagtgtcatgctcaaaatagagaagtcagattaagattctttccaaaaacatatatcccagtttttaatctcagtcctaagactgaaaagacattgcaaacctgtatgagcacacatattgcagcagtttcagctagtttgataagatgtatttggtttgtactctactgtctagtttctagatgtctactccaaagaaccagacaacttcagcacagaacatacagtagatgtccaagcaaagaagacaaaagaacgtctagggggccgccccgtcttcaataaggaactatctttctgggcaacacacatgttgatgtattataggctgaaaacaaccgaaatacccaatcgtggtgatcaatggatgaggatgcaaactgaaattttttaaaaaaactacaaactttaaggctctctgcgtaatcaaacagataaagagagaggaatgcacgggagaccctgagaggaaggaagatttcagatagttgcgtcaagagtcacgaccagcttgcaagccaaccatggcacgggttcagcactagcttcctcacctccaagctgctgcctttttcattcagtatgcctctcctatttgactcagcatactatttgccatagcatactgaatgactctgtgtcctagttgattcagcacaagaccacctactattccatctcacaaaagtacaaaaacctttacaagcatcaaagctatggcaaagatttggggtagttgtatggtggatcaagactgcaaaataatcctagctacttggattagcccaaaaataagtcccagcgagaaggaaatatgggcttataagaaacataatcaagtatccctaagttcacgccaagagtcaaagagaacatcaccatgtttgaatacttgaacaaccaaatttattttatttcacaactctttaaccaaccattctcaccaacaatgtggcatataagtttaaacattgatggatatcattctaatccttttgccaagtaccttctttgtagttcctccattttcaaatacttggtgcaccagacttctcgaaaaaatttatcacgatttacccctatgcatgcacctacttttccacctcgtcatcagttcttgagataataatatggtattgtttgtcattttttattcaaagtacaattgcatatatgcatgtcctggttaagagtataaattattcaaaaacagaggggtaatttcttcttcagcaagggatctcaagtatttttttttctttattttcaatttccatcaacgtgtccaattcaacctatcattaaaactaaactaggggcaggcagtagctatgcatagtttagaaattgcacatcatattcatctgtaaaaaatcaggtatttattatctatattgatcagaaaatcaaatagattgtagagtatatagcctgtgaaaacagtaatgtctactccgaaattcaggccacaattttaaatggtcctacataaaaaggaaggacaaatctctcataaccactgaaatttcaccaattcagttatttggcatacgttgtcttaaatgcccgtctaggtccagggcctatgtgtcacagacattaaacgatcgtgcgaaatctacaattccagtagggaatcgccaccaaaaaagaaacaattacttctatgctagtccgcgtatcacctttgaattgatgttcctaactgacctgccaataaaaccagaaataataacaagaagatgaacataccgattccttcttgctgttctgcttttcctccaagtccttgagcgctcgatccatccgcttcctgccgccaaagaatcaaccccccagcatcagcacaactcgatacaccccaaaaacagatcaagttaatcagatcaccaaacaacatcatctcaatggctactcacagctcagcggagatgtactcgatgcgcttcttgacgttggccttcgcctccgcgagatcctgcttgaccagcaccggcccgatcagcttgtacacgttcgcctcgtcattcaccagctccagctcctgcgcgagaccagatcgaatcagaaacccacaccaaaaaaaaagaggaaaaatccacatagagcggaagcaagagagcgcggcgagcagggcatgccttgaggacgagctcgttctcgccgacctggatggtgtactgcttgcggacctggtggttcttggagatgtctgcgagggggaaggaacggacagagctagggttagggtttcgggattccgaggtgacgagaaggaaggggaggggaagggggggtttcgagcgtgcctttctggatcttgctgagggcgttggcctgggactcgaggtcgcgctgcatctcgcggacggccgccggggtggacgacgacgccgccgccgccgccattggtggtgctgcctctgctcccctccgccgccgccgccgccggattccggtgtggtgcggaatgctagagttggtgtggtttggccgtttgggctttcgctggctttcttttccctttgttctgagttctgacatcgggtactattttgggcctagatgggctcaatttggcctagctaatctaacccaaaaaatgcaaaatgggctgagaaaagcaaatgttattgtttgggggaaaaagtacaccgaaggtccctcaaaaacgccctcaaaccgcaaaaccagatatgcggtgtcccttaactatacaaaaccattcacccgaggtccttcggtggttatgaccccagttttggcctatgtgggacccacgtgggccccacatatcactgtgccacgtcatcaccatctctctctttcccttcgtcctctctctctcacttttcctctctctaggctggcgacaggcgacgctggaacaggcctcccatcccgacagccaacgcctcgctcttcttcacctacaacgaggccacgcacccgctcacgccgccggcctcctctgtttgtgtttggtgagtggtgtttgatcggcgtcggtgtttggtggatgccgtgcaagccgagcggatgcgcgcggggctggaggaagcgcagcgacggcacgtccgggcgctggtggcggccgcggcgcgcgccccgacggggagggtgcgtgcggcggaggccaagctggatcgcgcatgctgccgcaacgcggagctagaggagaaggtccgccagatgagggcggaggggcaggcgtggatgggcgttgccaagagccacgaggccgttgccaccggcctccacgccacactcgactagctcctccagtccccctatgccgtcgccgccgccacgggggagggcgacgccgaggacgcgcagtcatgctgcttcgagaccccaggcggcggcgccgccgccactgccgctgacgcggtgtccggggcgacgtcgtgcaaggcctgccgtgtcacggaggcgtttgtgccgttgctcccgtgccgccgcctgtgcctgtgcggcacctgcgaggccgccgttgatgcttgccccgtctgcgccaccaccaagattgcctccgtccatgtcctcctctcctgcagtcactcatatgtgccacaccagccacttcatggagtaggaaatttcgatagcgcaacagctatggccagaccgaaaccgggcatccgtcagccaactccggtgtcaagcaagctaacaacaatcatcctgtcccaagttacatggaaattcatgctagggaagccacggttctgtgcatcagtgatctccgggccatgcgagttttgtcggtggaaacaacagtgttcggtgcggtgaattgaatggttgattgccgatctcatctgccgcaggtaccattgcttcaaatatttggcagcccgggtcggcacgcacgccgccccgtctccccgtcggccgttgctcgtcggttgtcctccccatcggccgccgcccgtcccggtaccccttctccccgccgatcctcacctgtcgacgacgtcccggcgccgctccccactcgccggccaccgcagctccgcgcctccgcttcgctggccgccgcgcgctcacacgccgcctccgccgttcgccactcaaccccccctcgccgcccggttgtctgctccctacccgtcggccggcctgagaagagtgcgagagagagagaatggaggaagggagagaagaagaggggaaaggggaattgacgtggcacgctgacatgtggagcccacgtgggtcccacgcgccacataggctaaaactgaggtcaaaaccactcaaaggacctcaggtcactggttttgtatagttaagggaccccgcatatctggttttgcggttcgaggacgttttttatcccgatgacaagttgagggaccttcggtgtactttttccttgtttgggatcacctatacatttgtcaatagatgtaattatagtacaatcgagaagtaattacactgcaacttgcatgtgacttgtatgtaactttcaaatatctctccgtaacatgattttggtgaaacggaagtcgtggggatgaatcctttcactgtgtgcgcatagtgacttttttccttcttcacttgtacaaatcttgaaaaaaatataatggttcaaaattatgtgaaagttacattgaattatatgtaagctgtatgtaaattacagtgtaattacatgcaagttagcatgtaattatactacgattatagtgtgattacatctgtcaaatttttaggagaaaatttatcgacaaatatatagcaaaattgtattgttttgtggctcaatgtccataaaagacagagttttttaaaaaaattacagtaatatatttttcttttacaaatttacgaaaatatacttctcccaccctttaggaggttatcttttttataaaccgccttctgagagagcagctctaatgggtttgttcgttagcaggatgctacaaccggctgcggtgatagctgcactgcaagcagtgtaatttctgctactctactgtagcggcttatgaatctctctactgaataggtccaatgacatagcgcggaggggttggagtttaacatattgtttgcatgaacagatatgtgtagaacctggtttttgctggaattaaatggaattatcgagggagtgggataaactgtgtctttcccataggacttcatttgccacaatcacgtacgcctgtaaaaaaaaaattaaaatcctatttgggtccttcccgctctctatctagacggtaactcgaaaaccgtctattagaaggacagaaagggcctatatgcaaaatttctaacgtgtccctaggccccgaaccctctacgtcatttcattagatatatcctctaggattgtaaaaaagaataatgtatttctataaacttaaaaggaaaaatagttgaaaacattgaaaaagcaagtgttggaagatgggccggcctatattggattagacttctagccgagaacattttttgcaaggtaggcccatgtactttgttagttgcatatattttgcaaaagtaaactcctctgtgtttctcttcctcttgctatggttgtttcttttttaatgagtttttttttgttttcaaaaagtgggtctctttcaatggtaatttatcttttatgagttcctttttttccctttttttgtggaggagacttaggagaacttcttggtgtaccacaagctacaaaaaagagactccaaacttgcaacttgggaggattcctcagcccatcatatgcaaaggccaagatgagcttctctgcagaacaaatgattgggtttggactggccaacagccatgcttgcaaacaacaccaagagcaagtagtcaaaacagcaccttcttttcctccgtttccccatcaaattccctctctcatcctctctttacaaggaatttcttcttgatggccttctttctaattcctctttcaaaaattccccactgttcattttgtgcctacaaaacatgaaagaagaatcataacggccattgattataaaactatatatgttgccacaattgatggaatggaaccatttgggcgacccatttgtgtgcacgctttgcctacattggtactactacttttgcataatatcaagaccgccaatttgagaatctgagcctaacccaaaaggagcatatgaatatatgatctccttttgttttcctcttccacttcttgttcttctcataaaatgttggcacttggatgcatattattggatcctcagccccacatacttgtggaggtctctccttagactccaacccactttctcgagataattcctagaaaaagctaattgcattgtgttgccccctcttccaaatttgattgtgtggggaggacaagagaatatcggtgcactcccacttaaactaactcttggtgctagtggaagttatggttaattgctttctttattgaaagaaagggtgagagtgtgagacttccctttgatggacaccttgaggaccacacaatctcagccaactattgccaattcgacgctcactatcaatctcattttggggtccattgatttgtacatctagttttctaggactggtctaaaaaacaatgcaagaacattgctgcacaatgagtcccaaaagagactatggtttgtatgcaagtttttaggaaccaaactgaatatgttgacggctctttcagtgagatcttgaaaagtatgatctattctatatcaaagaatcaattgtgtatatgcacaatgtaacactgaaatttttaaaattaattatatatactttaataactttatttctaatatatatataatttaatagattttatttacagaaatgtgatgccaatggaatatcatttgttatctgtataattacaatgtaaaaaaggagataaaactagttaaaaggaagtgcacgagtttattagaatcaggtagaaatagtatgataaatattatcatggtcatacatattttttgtggttcctaattatgcacatagcttagctaggaccagatgaataccatatgaccagaaatccagaattgtatcaacctagtttattttgcactagggatagtaggggtttctctagtagcgcttgtttgcatagtttaagtgttcaagttgctacttatttttaccaatattatcatttttgcatgcaaatgagcaatttcatcaatataacctgcgttatttcacaccaataaattattaggagttcgtatgctaatataaatttctggtttgaaatggtacagatagaaaggaattacgtcacctggtcacaaaagacacttttatcccatagaggcaattttcgcctctatattgtagaatcatacacctagaaaaattttacaagtttatgagatttttttatgacaaacatgcacctatcattcttcacacattcaaagctccaagctatacattctagattaaaaagtagggttaattggatccatgccattgcaaatttatctattcagaaaaatatcactacaatttgtctatacgtagctgtgctactggaattttacaaaattagaaccataccactgccgtcacgttctccatccatctcttttttttttgtcttcttccttctttctcccgtatcctctcactctgctttctttgcccggcacggcgaaggccaaggtggtcgccatggccactaaccctccgaccacggcctagccactaatggagccgctcctccagctcggccgcgcggcaacgggtggcgtcgagctcaacctcgttctcccacagccgccgcaccgctgacgccaatgcgtctcgaagcagcagcactgggcgtcatcagccacgccaatgaggggtcaaagttgttgacttgggcagggacggcatgaaggaggaggtcaagacatgtggcggtgacctcgtcagttagagagcgaggcggaaggagct

SEQ ID NO: 61215 - DNA, 2646 bp, Oryza sativa
ctagagcaagagaaggaagctctgaaagaaattgtggtgataatgagtgatagctaagtccatgaatgactaaaaacctccacttattaagagaatacattgtcaaaaacaattagcaattgcatgcacaactgtttatcataattgcaaggtgaccccgacaacacacaacctactgtaatcttcatgtacacacataaacaaatactataattttattatcatcaggtcagtctaaaggtgcagaaaatctccagaaaagaacaagggaagcttcggagcatcatgaaaaggccgaattgtacagatcgtccggattataaaatgtacaattccatataatagtttctgcgcctgtttaatcagaagggtatccacaatcacatgggcaccaagaggtgccattgtatcttccaatcatcaagtcaagaatcaaacctttttctttcaggcatccaagcaaggataagaaataaaattgcctgggttagccacctcatcgagattattatacctccactgttctgtttgcaaaccaagcatcatctggagttttcggcattataaccataaaaaattttaacaacaagcacacttctctccataataatcagaccaatgctactaaacatgtgccctggtgttattgggatttgcttctgagcgagaatacggccagtgaggaaatcatgctgtttgtaactctgcaaaagcaatcatcagcataggcctggttctcacagctgattgcttagcatcttgagaggtgccagagatgatcttcttggattggagcacagatttgtgattggaactcagaggtcctaaagaaaaacaacatagctggctgcttgagataaagaaaagggaagattctttctgtcctgggatacaaacattagttgccgcccctcgatgattgatgcaaagctttctccaggtaagaagtgatccactgactttcctgaaaaataaaggtgaaacatggtatgtactttagcctggcacagcatttgaagataagaggtacagaagcttataaacatgcagatatactataaatctaaggatagatgcaagcaaactgggttttaatgagaatcacaaaaaaaaagagagaacttcaccaacagtgcgctttccctgcatggaatactcatgacgcagaggttgctgagggaaaaaaaagctcatagtagcagcgatggactagctgctgcaggtcgcattcaataatcacacgagaaacaacattaatccttttccaaattatgtaactttgacaaaacatcctttacttttaactggcttgtgcaaaaagtaacatacctgatatgtagaggaagggtgagctatcaagagttccctctaacaaaaaggctgcggtaattaagtcacagtaatctattatataattaaaggaatagaaaaaggagcctccacgttcgctctcatggcctaaaaattctcacattaatcggagaaaaagaaaaagcagagtccatatagaaatacaatttagaaatagcttaaattcggaattaaaaaataaggaatattagaagaggagaccggagtccatatagaaatacaattaggaaatagctgaaattcggaattaaaaaataaggaatattagaagaggagaccggagtccatatagaaatacaattaggaaataactgaaattcggaattaaaaataaggaatattagaagtagagtatagagtccatgtagaaatacaattaggaaataactgaaattcggaattaaaaataaggaatattagaagtagagtatagagtctatatagaaacttaaaactaactaaaatttggaataaacataataaaattaaaagtagagtttagagtccgtataaaaatacaatttacaaatagttaaaattcgaaattaagaaaaaatgggaagaagagtttaatgctaatataggaattcgaaattaaaaattaaataatattgaaagatgagtttagagtccacatagaaatataattagaaataataaaatttcagaaataaaaataaataatattagaagaagaacatatagtctatatagaaatacaatttacagaaaaaagaaatattaaaaaacgagtctagagtccatataggaatatatataatttacaaataactaaaattttatcttaaaaataattaataactaacacgtatataaaatgcaatatgaatattacacattagtagttttgtaaagttattgcaaaatttaaaattatgttgttattttaatatatttgaataatataatgagaaaacatatatgctattatatgagagaaaatataatgatgctagccgcgcaatctgcgcgggccatcatgctagttagaatgtaaagagacaagtggaggtacaaccccaccgacgttttgtaacggacaaagattcttagggggatgataagacaggagcccacgcacgcacacgcttaagagaacaaagggaagaaagctcccacaaccaccagctttaaaagaaggggcaaatggggagggaggcctgcaaagaaaaggagaagagtgccctctaacctacctatgccttcctccaaaatcctgatatcttgagccacttgttgctgccactctgccat

SEQ ID NO: 61216 - DNA, 688 bp, Oryza sativa
tttaccttatgtacattgaagtttgtgaattatgtactccataaatgttacttgtgtggagtatttgatttaattagctgattttcccagccaagtttgacattttattttagttctgttttgcaaacaaaccaaagaagtccatatttgaggtgcttgatttcatattctattagcacaaattgatcttgagatctctgtccctatgttagacagaggatttgagagatcacctattcgttctaagcttttaaacttttggatccaccaaatgaagggcttgttttaactttttatgagaatttctatcatatttattatacttttatctatcaactgtaaatcacctgcagtcaaattttattgtacacaagcaaatagacataatgtgcgttgatgccccttattgcttttacaggctgttgaaaactggttagctgacagggcagtattgccacttgagaattcattgggtggtagcatacataggaactttgaccttttacttcgtcatagattgcacattgttggagaggtccgtcttgctgttcgtcattgcctgttagccaatcccggtgtcaagattgaaaacttgaaaagtgcaatgagccatccccaggtcaaactcttgcacaagatggcctaaatattctttattttttggtgtactaaacatgcagacatatta

SEQ ID NO: 61217 - DNA, 18013 bp, Oryza sativa
aggcatccagcacggctcagatatggtcaccgttgatcccgttgctggcccgcctggacaggaggaaggcaaggcacgcggcgcaatcaaagtcaccgacttgggcagggacaatgcgaaggaggtggagacaagcggcggtgacctcgtcggtgagagagcaaggcggaaggagctcgggtcgatctggtcgtcgtcattgtcgttcccatcgctggtatccgacgcagcttagatctggtcgctgtcgatcccatcgtagaccggcctagacaggaggacgacacgcgcgtcggcgaggcgcacggtgccgaagtgccgaacatgagccctcgctggcacccagcaccgcggcacgtagctacttggtttgcctagcgtcgctgccacgccgtgaatggcttcctcttcctccttggctccaccatggtcatcttggtctcgccgtacagccatgttcgagctcaagagacgggagaaagaaggaagaagacaggaaaaaaaaaagatatggatggaaaacgtgacggcagtgacatggtcctaattttgtaaaattccagtgacatggctacaaatagatgaactgtaacaacatttttcttaaatggcaaatttgtaatgacatgggtccaattaaccctaaaaaatatcataaacaacagcatcttcagctccatgcatggttcacgaaatcgatcagttttcgtgaaacctctaggtctcggcttataaaaatcagtcagtatttggtggtttctgtacagcattgaccgaaagtcaattggttttaccagtttttagtaaatcagtgaggagcgattttcacttcgaaaacgaaaggtgaccactgacttcaatacttcatgcattcagcatttttcttaagagtaaatttcacaaaactacatgtattttgcacaatttatcacaaaactacagatttaagagcttgtttcacaaaactacagatttagtatgcccgtttatcacaaaactacaggtactttgtacaatctatcataaaactacagatttaagaacttgtttcacaaaactatagaattagtgtattcgtttatcatagaactacacattgagtgtcttcatttatcacaaaactacaaatttagtgtctccattatcacaaaactacaggttttgacaatgctaaaacctgtagttttgtgataatgaagacattaaacctatagttttatgataaatgaagatattaaatctgtagttttgtgaaacaagttcttaaatctgtagttttgtgatatattgtgtaaaatacctgtagttttgtgataaacgaagacattaaatttgtagttttgtgaaataagttcttaaatctgtagtattgtgatagatcatgcaaagtatatgtagttttatgaaatttactcttttcttaatgaccggagaggggatggtgcttaattttagaatttaatttaaagggttttttttcatgctttctgttttttaagttgtgtttccatcagaaaataattttattttgcactcatctcacacaaaccaatacaaagacaaaaaaaagagagatcaaaataacatccaatttaacaaaccccaatgcaattatctcccactctaacaaactccaatgcattaatcctccactttattccctcgctttttattacactagaaaaaatgcccatccgttgcaacgggtgaaaactatttaaattttgttattgttataggtttagttaaagtgaaatttactatgggattcgcttgaatatatattttcttagaaaatcatgagttgcagctaggagtctaatcgtcttaagttagcatgcgagtttattttaaagagatttctatacaactccttttgtattttcaaaagcggaccaacttaaaaacggagtcaaacatggatatgtattttcaaatgcgaatgaaacttaaaaaccgactcaaacacgaatgacctaccaaagtaccggcaaaaacatctttaatttttataattgtagagatacactaaagtactttttatttgcttctggcttgtatatctcttctctactattataaaaattgaagatatttttgccggtatatttatacatcatcattgtttgagtcggttttaagttcgttctcttttggaaatacatatttgtgtttaagtcaaattttaagttcgcttgcttttagaaatataaaaggagtcgtataagaaatctctttaaaaaaactcgtatactaatttaagatgcaaatcggactaataattgcagctcatgattttctaaaagaaaaatatgtccaagcaaattcacacagttaagttcaccttagctaaaccgtataacaataataagattaaaataatcttcacccgttgcaatgcacgagtattttttctagtcccataaaaaagtaaaaaaaaaatctggaaaacagtgttttttttaatcaccggtgccaatcgtctgtagtacaagaaagaaagacgcatgcattgccttgggccctaggtgataactaagtacaaattccacctttaaaaagttctttcgtgagtattttaattggtcaattatctagtggctccaggggcttgatcatctgccaaactctcttgtgctccagtaagtcccccccatgaagaacaagaaccgaatagtacccttacacacctctagagaactcaaaaggcatcgatccatcttatccttgcactgatcgatcttccaaagtccaaactcaacttaaactaccactatggcgtaaaacaaactacagctgctcatcatcatcattggctcattgtcacacatttgagatcgactgatcatgtaacgtgaagatcgagctggcgccgccctgcagtgccgctgcatgctgctgctcctgctccgtgccgaactcgattctttctcctcgtggctttcgtgactaaagaggagaaaaaaaaaatctttagagcagcatatgccatggctgaatagccagatgatttccgataattatttaagtgtgcaaacaaatgaattaactattttaaaatttgatttagaatatttctctcagaaaacatacatcgtttttttttttttgcaaaaatcacatcatttaaaaatcacttggctgggaatttgtcttgggtaacacacgactaaagcaacagaaaataacattaaaacaggtgaaaagaaaacacctaaactaattaaaattaaatctcgaaattcaaactatggcttataatacatagactaatttgaaattaaatctcaaaattcaaattatggctttgtttgatttagattattgacgcgaatttatctatttgattattgatcacaagaatagttaaaatattttaacaaagaaaactaactaataactcagaacgtataagcaattcagcgaaagaaagttgtctgagaaaacatatttctcgaaacatggagcaaaattatccgtttcaataatccgataaacacacagaaaaggacatgcgcacaaatgtaattaagcgggcaagctgcagaggtactccctccgtcccgaaaagtcacatccagtactacgaatctagacatctctatccagattcgttgtattagaacggagggagtacacaactacacaaacgcgcatgcaacacgaagttgatctgtcggtcggcacagcggccgtggcagcatcgacggccatttgtcgaagctgcatggacgctgccctctgggcgaacctactactaatctcccgagaggaacggggaggaggccgaccaccactggggtcgttttctggagcctctgcctatgcaatattgcatgtaatttgcatttgcacacccggccggtggccactgccggtgcaggtgcagcagcgacgtactactagtctactactactactactactacttctacctcatccccctggatggatagctcatagctgggttcagacttgatctagctacatcgtcatcatcagtgatgtgaaactaacattggcttagctagctagctaggtgcgcatcgcaccgcatgcagcagtgagtggctcatatgtgctgggagttgggaccagaccggtttggtcagaattatcggcaaccggtggtaaacggccaatatcattacaaatttaaatttgttttattattttttcattctcaagtttgtaactgcacggccggatgtgaggacctgcaagtcacagtgatgtgtgaggtttacatacaagaatagagttaaatacccgtccacgaatataagaacttctagcatttaaaattttatccataaatataagcatttccgaagaactacttccccctccaaccacccctcagtaactgtttgcgcagttttatcccaattgtagtattataaagggcctttcccatctcaaaagctagccgttgaggtgaggagctcccctacttatatattaggtccattgccctttcacaaccaatataagactattcaacaccaatcaccccttatttaaccataggcatcatagtcttttcgcttcatttttaatctctctagaagcccttatatttgtggacggagagaccgagagagaatagacaacgctgtcaatgattaatcagggtgtggcatgaattgttcaatgggggtctaccagaggtactaacatgtaatgaccaaaggatcaagtggctggatgatcaagaattcgttgttggaaccttatcatgatcattgatttaattgacagctcacttagagaggagaggctccattaatctgcatggccaaattatttggactgtgattatctataatttgcagaggttcaggtatgctcaatctggtaaattcctggaatcattttctctttctggttcatataagaacactaaattatttccatataatcctctaagataagcaatcacaagatatgaaggaaatattgacacgcaattaaggaatttttcactttaaaaacaaacaattcctcctttttttttaaaaaaaaaagaaacaattccttacctctcatatcatatcccaaatcttcattcataaggtctggcaaagattctaaatcacccctggaatcatttcgttgtcgacagcactatcacctttcacaaattctgcttcatctgtttgtggaaattgtactctgaaagggaccaatacaaatagaaggcagtaagttagtaatcaaccatggcgtgcacattcaacatgttattttcgtgaatccaagtaaaaatcaataaattcgacaaagactaaagatatatcgatcacacccataatcatgtgcacggtaatatccttgttgcaaatatctgtgtccaaattttgacacaccttgtcagccatgaaaaacaagcaacttattgaccaattttattatcagataaaatagtataagctaaaattataacaaattatcattgtaactgtgaaaggcaaaagcgtatcaaccacgctgtcatcaagttcacaaacagaaccatgataccaaaaagggcatgcaaaaggtatggccgtgtacgcaaacaaatgattccaaaatgctgatatgggaacaggagtgctcaaagagcagatcatataagccagataacaacaaggaatagaattagataagaccaatcaaaagtacagaatataaagagaaaagaagatgttactgaaaatgactaatcaggatggaaccatatcactgacgatttaaagatctgaactgaccatggtctatagaataggaagttaaccctcaacataaaaaatttcacaagtggctgtaacattattagccttcagcaacagctaaatatggcattcaattgataagcagattaaattagatttgaacttcacacataatttttgagacgttgcaatcagcatggtctatgtattaatggtactacccatgtgagaccttcccctgtgttgtttgaacataattgcaacaacgtttcaaccagctcatcattataaagacgaacaccatcgccacatctcctaataagtaagaacaccatcatccacagttgaaagatgcaacaagaaaatgggaatggacacatgcatgcacatgcctgcaaggaccgccacttcatcgttcaccactctcacatgatcacctgtgataatgcagacgacatcccaacagaagcaagatatcaggaacacaagaaacacaaggaagtggctgaaaattctggttgtcagattgttttaatggtcctgtaaagcaccagcttttcatagaacaatctattaaaagtactgtataaaagatattagcacaaaagtgtgtttgtaatacatcccctccaagctagttgatattgtaaaaccatcaaaccgttagtctgcttcacctggactatatttttagtattatattcttttttcaaaaattagaataaaaaatctatgagcagtgctgaacaaggcccttcaaaaagcagtagaaattcgttgatatcaaaagataattattccatcttaatgggataaactcaatgtagttgataagaatcgaaattacagaagatgcaaacgaatcaacaaaaaaaatgcatatttaatagaaaaaaggttgacatcccaggtagaggatggaccagtagtcacctgtatggaattctgcctctgaaagtatattgaagagcataccagatagggactcgtatggtttagcttttggccaggcccacaaagatagtactaatacacaaatagccctgaaatttctatttcctcgtgtccttcaaacacgtgcaatggcataatgatggctaggcaacaatggataactaatgcatttatcattgctaaattatagacaagttcaacatagttccttttttctggaaaggtttttaaaatagaaaatgagtaacattggacgttattttacaatttaaaaaaatgtatagtttaccttcaaggaaaagatttaaccagtatatgattgtcaatgactttgacatcataccagaaaattacagaagatgtacgaaaaaagtatccccagcagcacatcctaacatcaaagtaggcaccacttattgttgtcagccagtatgccatagtaccctgcatgacatgtgagcatctgtcaggatagcaattagcaagtgctatatccagccagcaaaatcattacaaaagtaaatcatacgcttattattcagttataacatcgacaagcccaacaattagtgtaccaagaagaaggttttttcctttgtctagaatataacttcggggtccattgcaaagcacaagatatgaagtgggtaccatctgaccaagtactggctgattcaccaagaacgcgatacaagacagaacttcaaataagattgtaaacaagtgaaacttttgccagagatcacaataatggagatacagtctgttcattcctcactggtcccatgaaaacaggcagcccaatcagtgcaccggataaacactaattgcagcaactggtaggcatcagaacacggaggctacttagactgagtgactgacaagagattgtggatgatcttattagccattcatctgctttaattagttgagatgaacgtagagaatggatccttcacccccactaaaacaaatcttagttgaacacaactaccaaaagaatatacccaacgattaagtccattgcagattactggcagaaatgacatccatgattccggccgtcctgttcacatttgcacaaacatgtggatggcagtgctaagaaaaacatatgtcagaagtaaatttgactgagattaacagaatgccacttactgatgcacgagttctttttttaacctttgacttgggaaccaatggctactacaaaagtaacaattatgaagaagcatagctatccagaaattaattactagtcacaattgccacttcagcacaaggactggatgcacaacacaccagcaaaacaatacacaccacagactgttcttggttgaatcgaggagagcaccagtccacagaaggagcctgcacattcaccagagcaaatggttggagaggagcctgttggttcttgctcaacagaaggcattcgcaagagaatctatccttgcagatcagctggaaataaattgcttcaggagttaatttgactgcagctgatcatctaccaaaagaagtcaactctgtctcgtgatagaatctgccgacttgtcttagctaacagcttcccacatctcccatctaaaacacgcatgccctgtccgttgttttcctcgtaaggtacaggacacgagcagtttccggttcccttctttttaaaattcctcaccttgaccctgcatgttcatcatgtgcagcatacatatatatatatatataaagacccagcctccacaccctctgcaaacagagttgggtggccaagaacaagaacagcaaagcaaccatgacccaagctcactcaaaatcttgcttccaccagttctgggatggactccagatcaagaggagcagcgatagcttcactgtagagctactgccatcccttggtgcaactataaaccactccaacaagttgcagaagttcatcatatcgccttatgatccccggtacaggtgaggttcacactgcactttctgtacctatcacatgctgcaaggcatataagtaaacagcagttgctgacatgatctttgtttgctttgtctgtgtgtctctcagatcctgggagctgttccttatagtcctagttgtttactctgcctggatttgtccgtttgaactagcattcctgagggacttaccatctaagcttttgctagttgagaacattgtggatatattctttgccattgatattgttttgacgttcttcgttgcttatgtcgatagcaaaacacatcttcttgtggatgaccgaaagagaattgcaatgaggtgtgttcctgcgttactcattcctatgatactttcatgttagaaaccccacatttggaattgaaaaaggcccaaacgattctgccctgacattagcaaactacgatcatctgcaggtacctatccacttggtttatctttgatgtatgttcaacagcaccatttcaaccaatcatccttctatttacacacaaggggaatgacattgctttcaaggtactcaatttgctcaggctgtggcgtcttcaccgagtcagttcactatttgccaggttcaaaatcttgtccaggttctccataatttgatggcgaatcacaagtgacaactgcaacaatttaatcattctattttatcaggctggagaaagacatccgattcaactatttctggactaggtgctcaaaacttatttctgtaagtccttctgaacaaaagaaacttaccttctgtgttctgtgcaaaaatttttctatcttgcaaagtactagttatgtgcctataggaagaaataagctggttcttatgtgtataaaatatgtattgaccaaaatgcaggtgaccctcttcgcagtacattgtgcaggatgcttcaattatatgattgctgacagatatcccaacccagagaaaacatggataggagctgtgatgtcaactttcagatcagagagcttatggactagatatattactgctctttactggtccattacaacactgacaacaacaggatatggggacctacatgctgaaaatccaacagagatgctatttgatattgtctatatgatgtttaatctgggcttgacagcttatctcattggcaacatgaccaacctagttgtccatgggaccagccgcaccaggaaatttgtaagtttctctacttaccagcaaaaatgtcaatggcaaatcttctgtctacagaaagatcattcagaaatgtagtttttagtgagatttatatagtgctgaatgcagcagattatggcagacaagtgaaaattttagcatttggaatgccattacagatgtgatacactaccctttgatcataaaaatacaaataagctgcatatggatgccatacaaataaatgatgtcaaagatctgagaacaaactagcattttggttttatgcgtggtgggatgtatggttacatataaaatcatgcttattcaagagcatctacacagttatacaatttatatgaattgtgtcataggaattagttatatctaagacatccaggggatcaacaccctaagaactaagcaccatacattcataatatccaatgggtataagaactattatagtttcatttacaaaaaaaaatggtcatgctggaccattcttttaagttcttgtgcaaatggcagaggcgggttttcaaccatagagcaaagcaagggaataaatgaatagaatcctgttcttgtagtattccacaaggtacaagttcttgtatccctacgtcatttgaccattctaagggacaacaacatcaacaaaatatcattcaactcaagggcaagaatactaaaagaggtctgaagtgaatgcaaatagcatagtcatcattttaactaaaacggttactactaccagcattgttgttccaatatatgtactgctatattgatgatcctttaaaaaatatatgtgcagagggactcaatccaagcagcatcagagtttgcagcacgcaatcagctacctgagaacataaagcagcaagtgctatctcacttctgcctacaattcaagacagagggactcaaccagcaggtcatgttagactgtctaccaaaaggaatccgctcaagcatagcatacagcttattctttccgatcatccggcaagcctatctcttcaatggagtatctggcaatttcattgcagaactggtaaaatcatgaaataattcaatattttcgtagtaccatacaaaagcaatactttccagtctttactaattgaatatgttgaacaaaacaggtcatggaagtgcaggctgagtacttcccaccaaaggaagatataatattgcagaatgaaggagaagcagatgtttacatagtagtttcaggagcagtggttagtattctatctccaatttagttcagacatgaaatttcactaaggctttatctgtacgctaattgcgcttttcttaatgctttttctatgtagaatataataacaacaatacatgggaatgagcaggtacaggttttctctgtatatatctattccagatatcagtaagatttattcagatttaccaaaaattatgaattgtttgaaaacaggtatatgagaaaattgcagagggagaaatgtttggagaggttggttctttatgtaacataccccagccatttacttgccgcacagcggagctatcacagcttttaagaataagcaaaacaaggcttagagagatcattgaagaaaacagggaagacagtaacattctaatgaacaacctagttcaggtataacttcaattttattttcaaacaattatactgcattttttacagctaatcagaagttaacaactctattccaatgtacagaagctgaagctacgagaaagtttacctgacatgaatcaaccagaccgaagattcttgagcaagtatgagctattccacgttcctcgagaagcatggctgctgaaaaagtcacaactacattacacagagcacacaagtagggattctagtaacaacactccagtatttggaggtgacagatattccagacagttacttggagaagcaacccgatcttcggcatcagaaaacgaaaatagcagtatgacagataaagaagagaaccatgatgaagttcacacaaactgtgagatcaaaaaaagaacggaagagcactgtatccagataaactctgaagatagcagctccacatacagtcagcgaacaatgaatgcaacagtgcagacagggtctccacataaaacagaagaaaacataacaagaagaattccagatgagtactacataaaagaagcaaacaaaagagttacaattcacaaatatcgtcataactcaacagtctctgctgcgcaaaatggaaagcttatcaagctgcctacatcattggaggaactgttcaaaattggcagtaagtaaaattaagttttaaactacctattttaactgtgtttcgcctatgcaatttactgagtggatagcagatgtaaatctgcaatttactgtatatcagctacggtagtatgtatttactctcatcatatatattcttcgcatggcaggtcagaagtttcaaggttttcatcctagaaaggtggtcagtagagattatgctgaaatagatgatgtcagtgttatccgcgatggcgaccatctattccttcttgagatgtagagaagaaaacgccataacaacctaactggacaagttagaactctggcataagtaatggatgcacatcaagattcagaactgaagatatgaagaggaatgacattttgacacttcaatttgtttaatagttactgacatgatgtaaatgcctgatattgtatgacaaataagcaaggcagccttaatgcatgcagtcatgcaaaaaatcatgaaagcatgtggccgaaagcagttgtgtaggtttctactgcaaggatttttaacctgaaattgtacatccattcatctcttttaataggaagaaaatgagcatgttaataacagccctgattcattacttccctagacttgacgacttgtgctacacaataataggagtatattgttcctcttggtgtttgtgctctattgtatcgtaattggtgtagtccgatgcaactacttcatatttcaaggactatcaaggtgtatcttgtactctctttatcccaatttgatcatcacttgtttatttgtgtcaagactaaatgagcatcacttaatgcactacgtgcaacccaccaagattaatttctgttggtccaactacatgcaatatttaaaacttgatgtaatccatggaacacaaaaaaacgtagcaccttaaccgatgagaatcaattacagaatgatgaatgttttattgtccttgatctatgctccctttgcttaggtgatgatcaaaatgggatggagggagtaatgcctaactagtaatcagtaaaactttttcaacttaagttctgaaataccatgagtcaataaatgaacagcagcaagactattggattttactgttgacttcttgagacgtgtactaaagcaatagtagatactgcgattctcgtcatccaaaacatatccagcggtgatctagccagcctaactaaaaatgtgtccataatccccagaactctaatacatctaattctgcatcagtcactttgaagaaaaaaaataactccaaaatctcaaaattagacgagagcacttcactcacaaacaaacaaacaaacaaacaagaaaggcgtagggtgcggggtgccccgccagaatacctgcaattttgcgagggcccaagtgcaaaactcgcccctacagtgcgtgcgagaaagagacgaggagatggtggtaggtcacctggcgacggcgccggtcggagagcagagcggccccgcccgtggtggcgggctccacgcggagccaccggtggaagccggcggcgaggaggcagaggatcgttggcacgcgcgtgggttggggtggggggggggggttggaggcgcgaatgcaggcgccattgacggcccgtccccacgagccgcggcgagcgatcgcgccggccgtgtgggacccgacggccgccgtggtgtggccgcgccgcgtgggaccctatccggggatggaaacagtgaactggaccgtcgaccatttttctcacacggatccaccaaatctgtgtaggtccattttgcctccctcggctatagcctcaccctgatatttcaattttgatatacatctgttgataaattttctcctaaaatttagcaaatataattacatacattgtaacttgcatatacttccgagcgtccaaaaaaaccaacctagaggaaccagattcgttatactaggaggggaaggttggctctttttggaacggagggagtacagtgtaatttgcatgtaactttcaaaattctcttcataacatgatatttcgttgaaacggaggtcatgggaacgaatcctcttacatgtgtgcgcgtgctgcgacttttttcctttctcacttgcacaaatcttgaagcaaatctaacggtttaaaattatataaaagttacatacaatgtacaattatattgtagttaaatgcaaattacagtgtaattatactacggttgtactgggattacatctatcaaaattttaaaataaaaatttatcgacaaatgtataggtgatcccgataatgaatttggacacctctcctcctaggttgagtttttttttctgttggacggtgggagtataggtgccattacattcaacaaaagaaaatttaagaaaaaataaaaataaggtgatgtgtagcaattcccaaaaatatggcgcagcagatacgatccgtgtaaggaagatggaggccttgttaccaaactagccatgctccaacgatctgagatgcattactccgagaataagttcatctaaggtcctttaattttacacctaatcagattttcgcgtccttgaacaatctcaaaaccagatacaaccggtccctaaaatgtcaaatcgggggcaaataaggtccctcggcggtttaaaaggtggttttggctgacgtgacgtctatgtggctagtttgactggtttttttttcccacgtagcattgacgtggcggttacgtggcaattatatcttggaaaaataataaaaatcatggacccacatgccagcttaaaaaatggtgggacccatgtgttagcgacaaaaaaaaataaatatggtggggacaacgtgggccccacgagtcatttcctctcctctcggctcttcctctccttcccggattgggattcgatgacattcccccgccgaccccgacctcttcttcgtcatcctcagccagttcggcgtcatcacccgtgcccacatccctctccccctgcgccccgacctcagaaaagtaagagagagggagagccgccgaggtccatcgagatcacctcgccccgcccgtgcccctgccacggcggccgcgccgccaccagtccaccaccgtcgcgcagaaccctgtcgcgctgctgcagctctgggtcgaccgcaggtgcctcatcttcccgttcctccacgccgactacatcccgggctccctccgccgcttcctcgccggcgccgcggactgcttcgtcggtgtcagcgtggacaaggacgccgagcggctgagcgacgaccacagcctccccgcggggaacaccgccgaccttcgcaccctcgcggcgcagaggctgggctgcccggagctcatacaggccggcctacaggccgtggtgcacgtcatcatgggcgcccacctcgtcaagctgcagagggtgaccatgagccgctgggacgccttctgcctctccaacgagtagatctggtacactgcatcgacgcctacgtctccttcgaggtcggccggaggctgctccgcgcttgatactgaggccatccacaatgggtacccctgggtcgtctccccgctcacgccgttcgccgtccgtccgctgcgcgtgtccctggagagaggcgagacccccacgtggggaatgcgtgcctctagctcctcagctccctttttccggagacactccctcgagactacgcattgcagcgacccggtgccccgtcccctgtctcctcccccagtgtttcccctttttgccctcaccggcggcatggcaacgagagagtgagagaaaggagagatgcgacggcgacgaggatccgcgacggcgacgaccagatccggccaccgccgcggtagccgtcggccaccagccagcgacgggcgaagacggcttcctcgcgccgcggcagccgccggccaccagctggcgacgggctcggcttccgcgacggagacggtgacgatgacctggcgacgaccccacatgcacctcggcttcctccaccgccaccgccggccccgccacggtctcctggcggatctggccacggggggctagatccgcccacgatggcgccggatctgccccctccggccggcggcggcggcgagtaagagaggcggcggcgagggggagagagagagtggcgcggcggcgagagggagatgcgcacggcgcggcggcgagagggagacgcgcacggcgcggcggcgagagggagagagaggggcgcggtggcgagagggggcgagagggagaggcacgcggtggcgaagaaaaagagaagagggcatggtggcgaagaaaaagagaagaggggtaggaaagtaaaaatatgagtggggactttgtgggctaggacactcattgtgtacaggagtatctctaccaggttgctttagatcttgaggagtccatccaaggataccctacactgcgagctgagtttttctacgatgtcctcagttagtgaggatattctaggagtgtctcacattgtgatgccctgatagaccgtcgatcgaggcggtcaccgtggcacgaaccgcaattgcttgcatcctccgtgcctaattctacctagattagagattagattcagttgctgttgtctttcgctcatgctctcacgtaatgttaggcaaggatttatgagatttgaggtgttatgggtttatgcttagcactgaagaaattgaagaatcggatgaaaaaaaaggtgccgatcttctgatctagactatggttaatgaaactagctgggtggcctgcgcaattgcgcggctagcacccaaacaaaatcatatattttttagtatgattttacttaaaatttattaaatagctatctccgtatttctaattatataaagtcataccagctgctaccccttacttctgtcatatctttttttaagttaattgcactttggtccaccttttattaccaaagtttcactttgggctatcctctagctcatattttcactttggaccaggtaagattaccttgaccaccccaagtcattttctttagctgtatttactctataatattgtaaagaattacatgcgtaagttggaaaagattatcgggttacgggttgctgatgtgtttaaagttgaaaaagtcttttatgtattcataaaaagtttatgcgggtggtccaaagtaaaagaaaagtaaagtaacctagctcaaaatgaaaaaatgtattaaaagggtggtccaaagtgaaacattggtaataaaaggtggccctaaatgcaatttactccttttttttatttgcttgctcggtctaccattatttctattcattctccttgaaacctttaaaaattggatcttatagttttttgagtttattatcttgttgaatttcgtttttataatttctagaagtcccaccaaacgcggccattatactcctctacgatccgtccactgtctttttctctttattgtcattgagattttacaaatcgaaaataattatcgttcgagttcattttttactttctataagtcccgccaaaccgtcagcgacttttctattgtactccttggctcgcccgctgcctcccttctttatcgtcattgagattttaaaatcgaacataattatcattgtttttttttacttcttagaagttctgaacctttaaaatagtttttagagtttattgtctcaatggtttttttatataatctttagaagtctcgtcaaacgatactactgtactcctctacggctcatccgccgcctattctttattgtcattgggattctaaaaattgaacataaccatcattggaattcatttttttattttctaaaagtctcgccaaccgccagtggctctgcaactgtactcctatacaccctgcacgttgcttctttttattgtcatt

SEQ ID NO: 61218 - DNA, 8365 bp, Oryza sativa
taaaatgttacttgaattggtatagaaattctgcgttttgctattgaaaagttatcggttccattaattatattttttgttcaggttgatatgaacaaatattgattagttgattgggaaactgtacctgaggcttttgttatgcttgctgacaaaaaataaagcaataagatgctgttgctgtgacgctacatcgcttaactaatgcaatcagtgtgcttgaattcttcaaaaacatagcacaatttgtcaagatggcacatggtacatgccaatattatacatgaccaaagtcgcgtcaactccatggctgctttataattgtgtaattagagaatttcatcgctgcgaaattctcgtctcaatcatgggggacttgttctttcgtttgacctgtggccatgcgtttcgggttatggttgcttaattttgttttacccccacgaacatattaatcaacgtcgacatcagtgcccgaatctcggagcaaatccagcggtgaatatgtactcatccgggaaaaaataatcagttgactttaaatcctgatgagaattgccaatatatatacttgagcagctaagtcctcccatctattctctccatctcagaaattttattttttgcccatccacattgagtaaacaagcacaaaatcttttaaaaaagaaaacagagactttcagtttgaagtctgaacgcactcttctgatcaaagttacatattggacgctcatattctctctttcaatccttgtttaccctttatttatttttcatttaggatccccttgaggtaaagtggaaatgtgggctaaaagagtttaaggtttggtaaaaagtggtattcaaactgaaattaagacctgtttaattgtgagccataacttaccataatttgctacgtctaagattggataagtttgaccaacttagacagctaagcggttgtagactagtagccactgtaaattcctttccaataaaccgcacacattaataacttagaattaataacttagaaaagtgcgataagattcgcttaggtttgttaaggtgcggtaaagattttaaatatggaaattcaaataagtttgacaacttttattggcaaacgttatccctaaccctgaagaaacatacgaacaaaaagtggttatctatatagaagtacttaattagaggcaaagagttaaaaatacaatggttacttcttaatcttattgatgaacaaatatttaaaactgatatttcgagacaatgcacaactacttactgtcaaacggagtggtacctacctgctaagttcccattaaaattacaagagattcctgcacaagattattaaattgtaatataaatataaattcaaatgcaacggcaactgtatatatgtggtgcatatttgttacgaattatgcgtgtatttttttccgtaaaataagaaaaaaacaaagttactgcatgcttattgtggaaattttaaaattttgttacacataaatttggcaattatccaaatattcatttagattttttttttccaccgttaagagatggtatcttaactatatactccctccgtttcatattatatgccatttgacttttttttagtcaaaattctttaggtttgatcaattttatacgtaaacgacttttaatatttttgcccatgtggcacgtcaatgtggcaaccaagggtaaaaacagtgtggggcctactagtcagtctcacccttcctctctccctctggttcggcgtgcagcgctgagcacgcagtggcaccagtgcccggtaatcattgtcatcgccattgacgactatgagagccacataaaggcaacgacacgaaggtggttgtcccagtctagagccagcagttgtaggagcactcggggcaacaccgccgatggctgcggcggattaagcctcaccataaccgtggaggagcacggggggctggtcaatgtttggctgtgcaagtggagccgaacggtgttcatgggccatggcatgccggagatggcgaatgggtcaccattgcctggggattagcccggaaaagcgttgcaagctcgatgcccatggtgacggcggcttacgcacagttggagctcgttcgccgttgccaggcatccgggccatcgtgttgtggtcctgccatcgactgccaaatgatgccgctttagtgactccggcgattatgccgctcctccccgtccactccgtcccgttctagcgccgcctcctatgccgctgctgcttcatgtcgtccttggtagccgcggcccctatcctgagctcgggaggtctcttgagtggtgcgggcaacagatatgaccaaatgacaggctagacaatagtcgatagtgtagatcgatcaaggggaggaggataggctggagcggttgagagcgctacacgccggaccagagggagagtggaaggggacaattgtgagagtgactagcgggtctcacaccgacttttaccactagattgccgcatgggtaaaagtggtaaataataaagaaaccacctcttaacagtgaaaaaaaaatctaggaagaacatttggataattgctaagcctagtaaataattaaatttcccacttattataactattactttctccatttcttaataactgacaattttaattttcttatttaaagtttgatcattagttgctcttaaatcattacacaaggtgagttttgtgcttacgtttagggcatatacccaactttcataacatgccattatttctagtgttcataaacaataagggtagtcaaagtttgaaagtgaatagtattcttattactccctccatcccgtgcaaccataagtttccatgcctaacttggatcgttcgtcttatttaaaaaaaatttataattaatatttttgttgttatgagatgataaagcatgaataatactttacttgtgacttatgtttttaaattttttcaaaatttttagataagatggacggttaaactttggcgcggaaaaccatggctgcacttataatgggacgaagggagtataaatttaagggagtactgttaagtgaactgagtgtatgcagctcgttcatcggggtggaacatgtccagtgtccatccaaattcaaatcttaaacttgggtacgagttcaattttttttgactgatttacaactaattttctttcagcgatagacgatgtgcccataaacaagccgagtgtatgcattcacaaagataagtgtgcgtgacaacatattcatcgatatcaagacgttgcatcatgctcgtagaaacgagtgcgcgcatgtgtatataaacgtctagttcatatttcccccgttccaaaatagagtaacctatagtcagattggatacatatagtactattatggatctgaatagtaacgaaaataaatgggagtagctgtagaactgtcgacggttttttggatgaaaaacttttaaatataactactatgtaattacattataactattatgtaattacattgtaaatactttgtaactaattgatatgtaaatcgggtgtaactcagaaaagactggttagttgaacaaacctgcaagttgttggaggtgttgggttcgatccttggtgcatgcatctgattttttttctctgttttcctccaccagcacaaaaatctcaaagcatatcaaatggtttaaaatttgaaagttttcaccctgttaactgtcgacagtagtatagcaaatccgaaataaatttagagaaaactatgaaaaatccagttaaacccggaagccaagcaagcagcaacctctcatcagcatccgtcgtctatctccagccagacaacttatcccctactctcctcccaccacaggaatccttggcttcctccgccgatgcttccctcctcctcctccactcccctctgaccgatggcttccaccccctccctctccgtctccgccgccgccgccgtcttcccgtcggccgctgacccccgcaggccgccgccgccctccgtcgccatcgtcgacaaggtctttttctttttcttcctgtggcctagcttgcattctaaaaaaaagaaagagctcgaatcttgttgggacttcccattttctaggccctaagttcgaagattgttcgctaattatagatcgcattcttgccactaattagcttagcaatgtgaataatgcgaaaagaaaagaagaagcagctaggattaatttgcgctatgtcaaaattgtgttgttgtttttttttctttttctgaatgtgaataatgttgagcgtttctaggtcttaagttcgaagattacttcgctaattatcgatcgcattcttgccaccaattagcttagcaatgtgaataatgcgaaaaagaaaagaagaagaagctaggattaatttgcgctatatgaaaattgtattgttttttttttcctgttttgttttgcagaatagttcatatggcaggagcttgcaggcggctgacaatggcggcggcggcggcatggaggctccccttcgacctctggatgtccaggaagcgatgaccatgctgacggagggcaaggcggtgcagtcagcgatgtacgtgccgctgctgcaccggtgcgtcgagacggggagcctcggcgccgccagggcggtgcacgggcacatggcgaagacgggcgccagcgccgacatgttcgtggcgacgtcgctggtgaacgcctacatgcggtgcagcgcggctcgggacgcccgcaggctgttcgacggaatgcccgagaggaacgtggtcacgtggacggcgctcgtaacggggtacaccctcaactctcagccggcgctgggcctggaggtgttcgtcgagatgctggagatggggaggtacccgtcgcattacacgctcggcgcgacgctgaacgcgtgcctggcatcgtgcgatgtcgatttggggaagcaggttcatgggtatgcgattaagtacggggccgagtcgatcacgagcatggggaactcgctttgcagtctgtatgccaagttggggagcttggattctgcgttgagggcgttctggaggatccctgagaagaatgtgatcacgtggacgacgatgatatctgcgtgtgccgaggatgaggaatgcgtggagcttggaatgagcttgtttatcgatatgcttatggatggggtgatgccgaatgagttcacattgacaagtgtcatgagcttgtgtggtacaaggctggatcttaacctgggaaagcaagttcaggccttctccttcaaaattggttgtgaaacaaatcttccagtgaagaactcgacaatgtacctctatctgagaaagggtgaaactgatgaggcgatgcggttgttcgaacagatggaggatgccagcatcatcacatggaatgcaatgatctcaggctatgcccagatcatggactcagcaaaggatgatctccaggctcgatcaagagggttccaggcgctcacaattttccgcgacctcaagaggtctgtgatgaagccggatcttttcactttctcaagcatcctatctgtttgcagtgccatgatggctttggagcagggtgagcaaatccatgcgcagacgataaagagtggcttcttgtcagatgttgtggtgaacagcgcactggtgaatatgtacaataaatgtgggtgtattcaagatgcaaacaaagcctttcttgagatgccaacacgaacttttgtcacatggacttctatgatctcaggctactcgcagcatggccaacctcaggaggcgatacaactcttcgaggaaatgagattagctggggtgaggccaaatgaaatcacatttgtaagtttgctctcagcttgcagctatgcgggtttggttgaggaagctgagcattacttcgacatgatgaagaaagagtattgtattgaacctgttgtggatcactatgggtgcatgatcgacatgtttgtgcggttggggcgggtagaggatgcattttcctttatcaaaaggacaggttttgagccgaatgaggccatctggtcaagtttggttgctggatgccggagccatggaaacatggaacttgccttctacgctgccgataagctgcttgagctcaagccaaaagggattgaaacctatatcctgctgttgaacatgtacatttccacagagagatggcaggatgtggcgagagtacgaaagctgatgaaacaggaagatgttgggattcttagggaccgcagctggattacgataaaagacaaggtgtatttcttcagagctaatgatagaactcatcctcaagcaactgagttgtatcaactattggagaatctgttggagaaagctaaagccattgggtatgaaccatatcagaatgcagagttatctgatagcgaggatgatgagaaacctgccgctggatcactaaagcaccacagtgagaggttagctgtcgcgctagggctgctgcaaacacctccaggtgccacggttcgcgtcacgaagaacatcaccatgtgcagggactgccacagctccattaagctattttcgctacttgaaaacagagaaatcattgtccgggacagcaaacggcttcacaagttcaaggatggccggtgctcctgtggagattttggtgctctattgtgagaaggatggaaatcttaccccccacatgctactctaggaactcaacagttttgtagtggaagcagggttacaagttacaggttgcacagaattcttttgatgaactgatcaccctttgtgatttttgtagatctttgtatgaaatcgaaatttataaactcaggcagtgtccccaaatgatctgtacacaaggttagcattataggacagtgaatacttgtgaatctgctgtaaatgctaaaatgctagcttcttaggatcagatctaagattttattgtttaaactcacaatgcaatatggcagtaacccccattctttgatcttatactaggagatcagtgtagcatacaaaaatatagatgctgtataaatgatagagttgtttaataaaaagcatagtgttactcgaaatatatacattagtgaggagactttgtgcagtttgttcatagaactggtttctgaagatggttgcatgcacttgtacgctattgctggtatttgaatatccaaactcaaagaacaaggaatttctactatgttttgaaccttttaactttaaaaacgaattctgtaaaaacttattttcaaatattaatcttttgaccacaccatctactcagtgaatacggaatgcgtggctgcgttgtttcaccacaccagtcaaactagcctaagtttgtcgagagtatatttttaaaataaacaaattaaaaggtccaaactatattaaaaaaagaaatcaagaacaagctcaacaaaacatcaatttggcaataactggtaagtctttttatgggctgaagggattgatgcttgaaggaataagtctacctaaagtgaagttattccatacttgaatgaatgattgcaacttaggccctctttgtttaggtttagacttattgtcttagacttttaagttaacttattggcttatatgatttataagccggtggatttaatgtcctaagtttagtagtggagtcatacatctacttcacataagccaaaaaagcttctccaacataatttttggcttaatagtgttagagtggcttacggcttcaaaaaaaaaaaaaccaaacgaataagctgcttgtttgtttagccttatacttttcggcttataagcctaaataaagagggccttaatgggccaagatcccattggccatgttttggagggctttttataatgtcaggctcttttgtgggagtctaccaatcatgaagcctttgtagtcgacatttgggcaagtaaacaaccatatccaaatgtgagagtaaggacatatttggcagagctgtctctcaaatccgatttacttgtttggtaaccaaattgtccaaaataaacaaaaactaaaacgaaacaaggtgaagcgctctaaaaaaaattgcactagagaggtggaacgggttaggccagctcaccgtgaggtaaaatacaacgctagtcatccactttcttagaaattttttttgaggtaccactttcttagaaattatagcaacttgctacggcactaccctcccctcttccatacagattgagattctctgccttaaatcaagtaaatttacagtcactgaaatgtgggtacatagaaaagagggtctacatatcagtgacttaaagttatgtgacttaggctttgttcgggagtgaggg

SEQ ID NO: 61219 - DNA, 1502 bp, Oryza sativa
  unsure (1)..(1502): unsure at all n locations
agggccnattganaancctgatatgcgagctcgnaccctacccggaaaccacgcacgccaccgttgtattgtcgtacagcttcaactccaggtctccaagactccaagtcgccaatcagcgtgcgtacgtttgacctaatcttcgagctggcactgcatcgcaaggctgattcttcagcgagcgagcgagcgggacgtacgacgcgcgagccacccgtaccgaacggcgagtgccccgtcaattctcaattctgcccgcatgccccaccgccacatacgctgtattcggctattcccccacgcgtcgcgtgtgcgcgcgcgctgcgtagcagccgcctgcctctgcgtggagtggacgcggccgcggccggtgggcgcgcgcgcctaacgctacacaccgcctctgaattcctcgtgcgaacacacggttcccccccccccccccccccacacgattcgcgtacgtgcgtgcgtgaataaacagtcgttggctcgtgcatgcatgatatgcacggggaaataatgggaaagcttgtgactcaagaattaacaatctggcttgtgtgtgaaccattctgcattctgcaatgtcatttacacgttcgagagctcacacctggctgtctgccatcaacagaaaatgcggcaatcatttgatgaaaccggacgcattgatcgatctgcagctaagctaccagctgcattgaattatataaagcttcactttcaaaataaaagcatttttttgggttagcaccaagctcaatcagctcccaaggcccatctgccattgagccaagagaaacagtactccctccgtactcgtaaaggaaatcgttttggacaacgacaaggtctccaaaacacaactttgacttcttatttctataaaaatatttattaaaaagtgatatatgtatacttttatgaaaatatttttcaagacaaatctattcatataatttttatattttcaaactcaacaacttaagagttatttataatttatattcctaatgtttgacttaaactttgttctaaacgactttctttacaagtacggggggagtagttagtgatcgatcgatcggttgggccaaattttaatgcatttgttagtctaaaagctgccaatatctaattgggcttatgctaacggacgacaagtaatgacatactcatcactcatcatcacgccaatccggtgatataatatttggatgaacggcatctgaacagacctccaaccgtaccattttcttttggcattgatcaacgaacttttttctgttaaaacctaaacatggttggataaagaaggttgaaaattctatggaatttcttgcaaattgggactcaagttgtgttgtggaggttccacaaaacttttcatggcagtgaaagaaagctggggtccaaatgctaaagctgggtggttcaattgttgcccttgagaagccattctttgcgaaggggagaaaaagaagtaagcactttatgct

SEQ ID NO: 61220 - DNA, 3375 bp, Oryza sativa
  unsure (1)..(3375): unsure at all n locations
gctggcnnatgagacctgcataacctcatgctgcatgccgcagtagactctgaggatccccgcgtcggttggcttggcatggcaggtcgacaggtttgcagcctctatgggccatggggatgcgtcgatggcttcaccgggagcaagttgccatggcgcagctatcattggagtgtacttgcacagtgccgccgcgtccagatccacggagatgcaacgtgggcgatgtcccgagcagtagcatataaattcgtactgttcttcttatttcctctctcagttttaacgcaggttcacctgtacagtacgaatggccatggaagctgtactacgcggtaacagtaaaagcatttcacagtgagcaattcgctgatgtgcgtttcggagtttcagattctgaaattatgaatggggcgggcaagtatatggtggatgctgtagtattaatcgaactcgatctggagcagtgtactgtacttacgtagataatgaacttggattaatttacgccataaaattccacagaaataactcgcgaatgaagtactggtcctgctgcctgctgatgagcctgaatgccgcacgggcaacctccggaaaattaaaaattttcaggagcaaacattcaaatttcgctgagatcactagccagagcctcacgtgtcccgaacttggatgatccagtccagagcccccacctctttccgtgctgcctcgcaaagcatcgacgtgccacctaccccatccggaacagtaattcctcactgccatgtgggacccacgccgtgtcatgacagccatgtcagcgactgaactggtaatcacctcgcgtgtgcgtctgtgcgctcatccttttttttttcctcctcctcccacgagcattcattccctcgcaacgcgcgcacgaattttatttttatttgaaaaattcccgatattgcccttgagctgtcagcattagtaggctatttaatgacggacaaaacagtaatctcgcgtcctaacgttcttaaatgcgcattactagctcgaaacaggggtctctgctccccagcccatgctgctccctttgcccttttctttcgggaaaaaagggaaaaaaaatactccattcatctactgacacatgggcccacatccccacaactaaactgtcagtggctcagtgccacccgtagtgtactgccactccgcgacaacccgcacggcgtcgaactggttatcctcaccggcggagcagcgcagcggcgagtggccccacccttctcccgctgccactgccactgggccccaccgcccggaagatccggtcaccaccgcagagcgctagtctccaccgctattattaccccctaccgcttggttacaaatcacactcgtggttgtctcgtgtagtggaggtggagtacatctaaaatccctcgtcttgtcgctgctaagcttgccgccgatggagccgtcgcggcggctgctgctgtccgactacgacggcgcgatcgtgtcgccgctgccgtcgccgccgccgtcgtcggccacgccgttcaggccgggcgtcgcggtggtcgtgggcatcctgacgagcgtgttctccatcacgttcctgctgctgctgtacgcgaagcactgcaagcggaacgccgcggagtcgtcgggcccgtacgggagcggcggcgcgttcgggtcgtccggtgggggcggggcgggcgaccggcggaactccggcgtcgaccgcgccgtggtggagtcgctgccggtgttccggttcggcgcgctccgtgggcagaaggctgggctcgagtgcgcggtgtgcctcggccggttcgagccgacggaggcgctccggctgctgccgaaatgccgccatgggttccacgtcgagtgcgtggatacgtggctggacgcgcactcgacgtgcccgctgtgccgctcccgcgtcgaccccgaggacgtcctgctcctcccggagccgccaaagccgtccaccacggggccccctgatccgccggagacgaaggtggcggcggcggcggcggctgctacggccaaggacaaggaggcgagcttagctcctgctgctcctgctccgtctccagcgtttagaggcttcttctccggccggcactcgacggggtcggtacgggcgccagggagggttggccctgcctcacgccggtcggccgatctcgtcgaaggcgacggcggtgcggtggtgggatgcttcgaggccgccaaggttcgcaaggacagggtgctgttgatggagccggcggccgcggtggcggagcctgacccggaagcctacgaccggcggttcgggcaccgcatcctggtgagcaccgccggtggctgcgaggacgagacggcaccggcggcgaagcagcggtggagcgaggtgcgaccatccgatctgatgttcgtccggtcggagatgctggtgacggaggccggccggtactcctgctccgccgccgtccactccggcaacggcaggagcgtaatcagcgcgaggagcctatcggagctcgccggcgtgagccggctccctcccatccgcgccagcggcgagccacgagccggcgcgcgtcggtggccgggctcgagctggtgggcccggggcccgcccgcccttaacggccctagcacctaggccgctgttccgcggggcccacttcgcagcccggaaaaaggctcccaattttttctctccccatactgcccccgccacttccacgtaaaccacggcaccctatgcccgaacccgtggctcacgtgatgggcaccatggtaattacacgcagctggggcacaagactgcaagatgagtccatgccatgcccgcctcgggagccgcgccgctagagagagataagatggtggtggtgatggtatgttgctttccgcggggatctcggggcaaaggggctggtttcttcctgaattcgggcggcctggatcgatcggctacggcccgcatatggcgccggcgaaggcgtcgtaacccaatgcggccgggatcttctgcggggccgcgcgctgacaagggcttttggcgcgtcgcgtcggccgggtcgggggacgagggaaccaggcaaccagcccatgcttcacaagagagaaaaagaaaaaaaaagctggtcgtatgcgtgtaaaattcttgtctgcgtaagaggaaaagcgctgcaactttttggtgtaacctgttgcaaagcatctaccgggcaatggctcagttagtaaagcagctgaagcccatctcgcatttctcatctactatcctcttggctttttttgtgcgtcgtgttgctagactcgggttcgttttgcattctatcgtagtggcagtagtactatcagtggcacatggtggaggagcaa

SEQ ID NO: 61221 - DNA, 1202 bp, Oryza sativa
  unsure (1)..(1202): unsure at all n locations
caacaagcgtcgcaatatggtaatggattnggaaagggctaattctatagataaatcattactctaacctataancaaagtttaatataatctccaactcaacccaacccaacacccccccgggnatttgaattcgaatactacaaccccgcagccngcagggcgactatagaggatccccgacgtggacggcgtctgggaaaaaggggcggcggcggcggcggggcccaatatacgggtgcgggggctgacaccgcggtcggaggcgaaaggcgaagagatcctccggggcgtcgacctggacgtgccgcgcggggtggtcgtcggcgtcatcggccccagcggcagcggcaagtccacgctgctccgcgcgctcaaccgcctttgggagcccgcgccgggcgccgtgctcctcgacggcgtcgacatttgcggcatcgacgtcctcgcgctccgccgaaaggtcggcatgctcttccagctccccgccatgttcgacggtaagtacgtacgcccgccgctgtccacacacactgcacatacgcacggtgatccgatcctggaagaaactgtacatggattccatgaatgcggtaccttttccaaatttaaatgttcttctctgcaaaaagatgcttttccttcaaaaataaacaagaacttgatttgagattaccaagatcctgtccaaaaaaaaaaacagtaacgagtaagttttagacgatcaacagacaactaggtttggcatttttcatatgaataattaactattcgccactcttacgattgattagcctagttgtgtcaataataagttataataagggggaaataatgataaaatgtaccaatgtcgcagtcaaaacctaacaaatgaaagccgagttatagcatttgataaacagataaaaccaagttgagcacttttttgccctcgtcttgtttcctagaaatgggtgataagtttttttctacctaagaaaccgcatcaattttcaacttgcagtgaacttttacactagaggacgggtacttttagttgaaagaggtttttacgctaaggccaaatacatgagagcttttgctagttgtaacttcttctagacttcatagctcccttaaatagttcagattctaacctaaattctgataattgatactcctcagtttgccagaatatttcaacctaggatgagacgact

SEQ ID NO: 61222 - DNA, 767 bp, Oryza sativa
  unsure (1)..(767): unsure at all n locations
ctaatgaacgaatgctaggaggtggaggtgttgatggaggtgattgaatgcagctactagtgagctatcatttatctcatcacggattgactatctcatactccagtacaattctcattgtagctatacatcgagctgctggacctgaactcgtagaggcctgcccagtccagagacgcggggctggcagattctcctacgccgacgagcttctcaaggcgttctgcgctgcctttccttcttcttcatcgtcgtcgtctctgccgacgcctgcgccgccgccgacgcagccgcagccagagcagcagaaaccagtggtggtggtggtgtaggagaatctgccagccccgacgacggcctctccggcgaaggcgaagctggcggccgcgaggcaagtgccaggcggcgtggctagatccaagaggaggtgagctttcttcactttgccttcacgctcacccacgccgtcgccttcggcttcccgcgtcgcagccgccggcgacgacttctttccgccaccgcgctcgcccgccgacgccgncttgccctgccggcggcgtcccattctcccgtgtcttcgccaccgcatcggcggcgacctcctccccaccgtcgaccggcctgccaagtccagagaggagtgagagagagaaagagagagaagagaggaaaggagaggaagggagaggccagcctgctgaagtggcatcctgacatgtgggtcctacgtgggtctcacgctgactcagccggcacgtcggacaaaa

SEQ ID NO: 61223 - DNA, 23625 bp, Oryza sativa
  unsure (1)..(23625): unsure at all n locations
gatcctcactgttggcagctttttgccgcactgcagcttgttgatattgctcagccaattgctttctaccaaggaaagctgataggttcttccttgcttcagaatatgttttctttgccttttgatatgcttcagttgctttagtatagaagcatacaggacagtagaactgaccagaatcatcaaatgtcactgatgagccaaaacatgtatcatgaacggctaaaaaacagccactgcatttcagcaactgaccatctttgccacattttatgcacaactcttgttctgacaagccctcaacagtaccattagcatattgatcctgagtacagaacggtagtttttcagccattgacagaagaccaccagctgcgaagccactgaaactaccatctgaagaatgcacatgcaatgtttctgccacagtattcgccatggtttccttgtttgaagcttgctttgctcgcttgtcattaacatcattaggagaggttggaatactgcagcaatcattctgaacttcagttctgttccttccaatattctgctcagagaaatggttggcctctgaatttctgttatgcaaggtcatgctgcagccatgagactctagagcagtttgcttattcagcccaccaaagaccatattattttttatgatgttgccatcatcatatagagcttgattaactttgtcggaacaaccaacttccaaatgagccttgtcactattttcttgttcaaaagtttcagtatgctgtgtagtattccctgctggatctttaatttcagatttgtctccttgaacatccccattaaagccttcagatggtaaagcagcagctgtctgaataccagtactgccacaacccacatcttgatttgctttatcaccagtatcatgttgccctgaatttggatgagttttgctgaagtgtggttctgaagtcattattttatcctctacagcaataaactcaggcaagtgggtcatgttggatgccggtaaagcatcattgcttctgtcaacagctggagaaacagttgtctgcatggttgatccttcatggatggaatcctttggtgactgaatgctggcaacaagtggcatgtctccattattactgtgatgtttattaggatatctgaccccacaagattgtgattgaactatggttgtatgatctatcgtgtcctgctcagacattcttcctgtattacttcccagcaaatctgcagaactagctaaagaaggctcagctgcaactgacatgtgtctatttacattagttggactgtcttctggagacctgatgttgacaccaacagtattaatagaatcttcttgtcgctgatcaaaacacctattgtctgatgtacatggttgttgaaaatcagaagttgccattgcatccttctgaagattttctgtgtttctttcatcgactaaatttgctagatcatcctgctgaagttgagcaccatctgtagtgaatccggtcttctctgtattcacaagatcatggctgatattgtcgtgttggtcatttccattctgctccactggggatggtggaaccacaggtgtaatctctgggtaaacttttctgagctgaacataaaacaagcagcacactaattttaacagaagtcctttcttcagatgtgaaagacagcattttaacataccaactcaaaagaagtttctggtaatgtaggtctctttatgcatataaacttctggatatcttgtctaaagggcggaagcatatccttctccaagctccctgagctaccaacctgaaaattttacattatgtaaagtaaacctcaaaattatctggacaccaggaaggtattacagacaaattgcagcacactagcttcgaaacttgaataaaccatatgcataatattgtttcacagagaaaaaacaggtttaatcacaagcaaacaacaaaaaaattaaaagggtgacagtagatacatgcataatcatgtgaggaacaatatttaacacagctagcaatatatttatatcaatcccacagttcttttcttaaaaaaaaattagcacagcctccccttttccctgcacaaattaaagcattcatggagcactcaggccaccaataatcatgtgaaaaataacatttaccacagtataccccctttcccagcaacaatgatcttttgagacttcataagcatatgctatatataactagagcaaaggtaccaaaatcaattgggaatacgtaagacaaaaaatgctagaggtaatatcatgttcatatcaccagaatgcttgagctcagaaaacatctgggtcttgcctagcaatgttgcacataataaacatgcatcagtgaacaactcattggttagagatctgaaggttcatctaagcacatattcttcaaaaggtgctgagcagattacaagtcaaagggtgaaaatgccgtttcatatcactggaatggatgagctcaaaacatagaaagggtgtctgaaccaagctaccaataaccctattattcaagaaatgtacccaaccatgcgaatggggatcaccttgtcttcacgaatagtttgaaacgaattgcagagttttccagtaaacgaatacttaatacttgatcgaatgaggcaaatatgtcaatgcgttgcgccgaatacctcacctcccggatgagttgaagcagcaaatcctcgcaggtgcgggatgcgtcctccaccccaagcatcccctcccccggcgccgctatggccgaggccgtggcgccgcgctcgccatcggaggaggcgagggagacgacctcctggaggcaccgcagcgccacgcgctcccgcaccgcctcaggggcggccctgacggaatccggggagacgcccaccatcgctgcgggggcaaggcgggcaaggcaaaccctaggtgagagtgtgagacaaggaagaagaagaagaagaagaaacggacgcaaacgagagcgcgcgcgagagaggagggggggggggtggatctacccttggtgacggcgaagtcgagggcgtcgtcgccggcgagcgcgtcggcggcccaaaaggcggcgaagcgggaggcggtggcggaggcggaggtggaggggcgcggcatttgcggttacgcggtggtgggggtggtgggcggcgagtttggtgggcgggtggagcaaccggacgccgacgaggtggccgccgtggaggcggcgcgccggtgagccgccggcgaggagggtgggggtggggatggtggtgcgccgccgctgacgaggcggatgggccgggatgcgagtaccggaaaggcccatttgttttagattttggatccacaccctatgaggcccatcggggagtatttgtggatagctttagttggtgtttatttcttttttcgccataaatatagctacaccctattattttatctcgattttcgtaaacgatgtgttctgtgcgaatttattttttagaattttcctaaaatatgtcaaataaatatattttgcgtatagtagtgtattcaggtcatttataagagatcgacaaataggtcagagtcattgattagccaccttgagcattgttttaggaggcgaagaaggctttagagatgtttcatactccctccttcccataatatgatacccaaaatcccttttattataggacggagggagtatatcgctattgtgatttgaatgttttgtaatctacggtaatctaggatatgaagttgtgatatgggctaaggacaaggctaatgtatactctccgttccataataagtttatttgtgtctctcctatttatcataaggttctttttacgtaaccattgtattggagtttgtgaaagtaaggaataaatgtgctaggagtagataaagtataaaataattatattgagatttgataaagggtattttagtctttttgttgttgtattggtatgtgtgggatgggtgaaaaataaacttattttagatagtgggagtatgtctcaatggataataagagtgggcccatgtgtatatagtaatatctatggctctctctacaatggttaatatgtgtgtgggaggagtttaaaagtgagtcctgttggatctcactaagtctaaaaaatggatacctagtcctttgaatgaaaaataaatcagtatctatctatacctaattaaaaaatacgcgaggcttccggaaaaaaaaatcgtccatcttttttttcggtttttcctttctttctgtccgttttctccgtccgtccattttctccctgttttttctcttttttttttttgtccttttttactgtttctctccatccgtctattttttcgctatttttttcgtccatctttttctccgcctttttccgtccgctttttgttacctttttttagttttttccatccgctttttttttggtaggatttatttttttatctgccatatttatttcgtcgtcgggccaaaccctagcgccgccgtcacatcgatctgcctccccatgcctgattaactgcaaaaattgatgttgcactactccctcgtcattttcctcatgattttccctttcaattccgctttaattcactgaatttaatctccatttgaaagtcattttttatcgtgaattttaggattcactccgattttaataaaaacagattttggagatcgagtgtatcaaaactctaaaccaattaaaaacagaaagatgagatcgagtgtataaaaaatccctcaaccaattttagaatatcgagaaagattcgatcggatttgatgaggaggatcggttttggcatcatatggacatgagacagtctttcggcggttgaagagggccggctatccagctccacttgtgagttgggtcaaagagagacaaccaagtagagggagagaggtagtgggctgggcggagactgaaaaggaaggggctgggctggtctaaaacctaagagtaaaatgtatagccgatccaaaaatattttttagcatgaagcttgttctgtaactccagaatggtaagatttttgtactattctgatattaaaggcctaatgctatcttttctataacgttgtggatgccctaatcattttgttttctgttgtcttggcctgatctttatctgttttctttcaagactaaatgttcccatcagttctatgcgtgtttttttttccgggctaattaagcctatgatccaataagatcaggacataggctagtacaaaatgggctatcagatccgatccaataggaacaacgggacagaggctcgagcagtgcccacgggaggcggcaccctgcgagggcgaggtactccctccgtatttttgatctatgatatagtctacgaaatactaatttgaccaaccatacatttctatctctactattataaaaattaaagatgtttttaccggtattttggtacgtcattcatgtttgaatcggttttaattttatgcttccattttaatctatatctctacttaaaaaaagaaatttctgtcgttgtagaaaagaaagaaaaaggtctgactaaaaaggtaaaaaaaaagtccgactcaacaagcgataaataaaaaagcttctgttgtaagtataaaaaaagaaaaaaaaacatctcatcgtaaaagaacaattgtccgactcccatgaaaaaggaaaaaaaaaagtctcccagtaaaaaaaagtccgcttggttttttaaggaaaaaaaaatatcccagtaaaaaaagtccgcttggtttttttggcactaggtttttttttctgatttttttgcacgctaaggcttttggttttttttcctggcctttttaatccgatctgttcaccgcgcgcatcccgggcgcctttggtttttttttgtcaatttttttcgccggttttttttctcctatgcgccttttgtttttctcatccggttttttaatctgatctgttcgccgcatgccttcccactttaacctagcgccacgtcgccgccatattgatcgtgcgttttctccaatttgattgaaaaatcgattcctcattcatctctcatcatttcctccatgattttccttcggctttaatttgctagatttaatctccgtttaacactttccaatgatgacggcgatcttctctggtcatttttatcctgagttttacgctctgattttgggggaaaacggaaagagtagattgagtggatcaaaaaccctcaatcaattctggctgatcgagaaagattcggccggatttgatgtagtctagggctgaaaagcaaggaaggccttctgccgaaaaccctggaaagtttttcattaacttttttaattataatctatagcgatcccaatgttaggatttttattaactttttcaattataatgtatatagtgatcccaatatttcttaatatatcactaaaaaacgtctttacccgttgcaacgcacgagcatgttttctagtaaaagtaaaatgttttatataaaaaggttgcatattatgatagtttatttaatgataaatctaataacatcaatttaattgattgatattttttatttttttttctattaatagtcaaagttaaaaatattaacttgtcactatgctaaaaatgcttataagtaacatattgttcccttcgcgaaactcaatcataacatttagctctaactagcccataaacgaaagcttgccctgctagtttatttgtttgtttttctttaaccattgtgatactaacattatgtctatttcatattgtctaacacgtttgacttttttttaagttaaacttattaagtttataaaaaaaatatactaacattttcaatacaaaacaaacatattatcaaaatatattcaatactaaatttaatggaactaatttggtgatgtaaatgttactaattattttcaataaactgggtcaaatataacataatttgatagaaaaaaagtccaatgacttataatatgaaacttagggagtaactacttggatacttgcaattggatgctttgttctactttaaagtaataatgagtaagaatgtcgctatcatctatccaatcatcctgcctttgagaaacctgcacattgtccccttgtctcacttgcagttctgctgatgactatcccttgaccaatacaatagcatccaacacagcaatgaaagctacaagaactattttcgctaccatccaagaagttactcacaatgatgataggaatgcggctaatttatccacatgttacgatgaacaaattgcaaccaacatccattaaacaaatcatagtcgattgaaagaaggcaaatgagaaataagaaccgcaataacgtgcatggtctctcttgcactaaatacctctccaatagggtcaagaagaaagtattctcgcaacacgcaagattgagagacatgcaccataagtatctcttgctattggtaccacctcctcttggacaaaatctggcctgaggggcaccaatgagggcatctagcaagatttccatagcactgtagggcgatgacacgagacaaaccgagagagtgaggatcattacccttggtaatggataagttaggggtcttatctctgccgagggtgtcggcaacatagtagaaggcaactggatggcaatgtgtgtggggtgggggggggagggggcaaaggagtaccttgcaacatgaaaaggaggggggcaaaccaaaaaaaggcatgatgcatatgttgcatttaaacactccataattgtctctaagatatatcacaaacattgtggtggtagagagaggcattacaatggccgaaggagtttgagtgggcaaactgcaaaaaagtactccctccgacctaaaatatagtaaactagcactggattaaacataacctaatactatgaatctgaacagaagctagtttatctaaattcgcagtactaggtcacatctaatatagtactagattgccatattttggaatggaggaagcatgatgctagctttgtattcaaatatgtatctgcatgattacctccaactcacatcatggttagtttagtgatatgtttgggattctaatttttcggcccatcaatagtatagaaatgcatcaccggtgatgtaggaggtagttaagaaatgcccatcaatatgtatcaaacatgttagctagacttcactcttttctctctttttatcatggggatgtaggaggctctcatgaggaaagacattatccagcaaaaaatagacatggaaatatatcaggaaaaagaaatggtgcaacactgtttctccctaacttgtgggtatcgacgaagcggaggcaaaaatatcggtacgttagttggtgggcggtttagggggtgttacatgcaaatagctatagtaaacacgagtatagctagcactacaaatctacaatgatttcacccataagtcaacattatcatatattaaaaataattaatatatgtttttcttatatggtaacacttgtttggttataatcaataaactcttgtttagttaacccattacatgcagtagccacgttaaatgcaaatggcccaaacacatttctgcaaatggttgcacggcctgcttgtctcgaggtatctgcaaaaattggtattttttcaagtgggggacacaaccgtgtgtgaaaatcaatgttcacgggaggccagttaagctaaccgcctaataaataaaaattccaaaaattgaaacactcattcccatccaccccagccccatcgttgttgtcgccacaattgttgttgccattgtcattgttattgcccccgtagttcgccatcgccgccgaagtttgctgccaccgtcgtcaaaggccccaccattcctgaggctgtcaccggcggatccgaccctcccggagccgggggcggtgcatccgcccttcctgaggccagacaacaccagatccgccaccacatggcttactgcttcagaggctgcccctcctgaggccagcggcactggattcgccaccattgaggttgccgtcgtcgcggccctagcctccgtcatcatggtagccctagtctccatcacccctccggccacgtgtagattcggcgcatccaacactacccctctccacccctttgctgtcagtgccagatccacgctcatggtggcaccagctcccattgggtgcccatctgccgcgtgcaccttctgcaggcctctagcggcgaaccgcccctcccattgctgctcactgactgctcctattgccagccgtcaaggagagccgatggaggagaggagaaaagacggcgaaggagaggaccgaagagatgtggaggagaggaaaaaacttaacgggtggaagaaaaggagatggatttgactatgtgtaaaaattcgtaggtgtgcatcttaagaaatccacatgtaaaaaatgaatttttcacatacggccgggtctatgctgggtactttttaaatctttatatatagtagaaaaaacgtccgtgcattacaacgggtaaatgctattttaatttattgttgtcataaggtttagctatggtaaaaatttactgtgggaattcacttggatattttctttagaatatcataagctataattaggagtctgtatttcatctcaagttggcatgtgagttttttttaaagagattttttataaaactccttttgtatttccaaaaacaaatgagcttaaaatcctactcaaacacatgtctgaatttgtaaaagcgaacgaacttaaaaaccgactcaaacacggatgacgtaccaaaataccggcaaaaacattttcaaaagcgaacacacttaaaacccgactcaaatacgaatctttacttccaaaagcgaacgaatttaaaaaccgactcatacacggataacgtaccaaataaccagcaaaaatatcttcgatttttataataggaaagatatattttttttcggggtgcataaaaaaggtgtgttcgtaaaagtcgtcgattatcatgttcgtacacacgacacatcgatcgatcgtcgacacttgtcgatgtgagcttttgctgctttttatacgtataataatcgtacatacagaacgctaggtcgatcgatctgaattttctcgtgtgatctgaattatattttctcgcgcgtgtgtggattgaatgtattaaacgacaggtcagtcaaaaagatatcaggttcgctttgtgtgttttctgcgactacgagaattttgagtacagtcgttctttggactgtacctatatatgcttaagattggatctttcgaaatcattgtacagtcgtacgtacgctaattagattattcgtttcgatcgagagatgtgagtagtttgactcatgattatatcgaataaaataacatgattttttttctgcatctaacataaataaagttggccaaaatcagttgccacttgccaaacaaatgcagttaaaattattagtactgtgttttctgtgactttagccacccaagaacagacgaattttttattttattttttgagaactcttttaatttaaaatttaaaaaataaaccctcttaaaacttatttccaagatctataatgaaaatatagctaactgtaaagttctagaactcgtcaaagctaactgtcatatgaagttcgctaacagctagccctatctcttaaaaggaaaagtgctggctatatatccagccagtcatccgagttcccacttctgctaacttcaaacttcttgaccgagatattttaatatttaccactatttgtcactttgaatggcactcacagtgtatggcatgttaaccctcatgtgtctatgatatgtgggtccaatagtaaattcttaattaccacttataatagtggcaaagacttagaccctatttgtttcagcttaagattattgtaatctagattattgagacagattactataagctggattataataagccgacgtagaataagttgttagctgtttgtttttctgaattattagctggttgttaggtgttagcaaaccaataatctaaaagaagtacctttagagtggataactagattatagtaatctagcttatagattgtaataatctatcataataaactatctgtttgtttaagcttactcctaataatctagattataataatcctaagctgaaacaaacaggggcttaaatatatgtcaactcctcgcatctataccctttatattgttgatacccactaataattattagaagttaaaactcaatatgtaagcatatcacattatcacccgctagtcattactattctaggatatcatctcatgcaaatatgacatatccttattttactcacctcattttgtcaaaacatgtcaatattcatcatttttataatatttaacttatatccatttatgtattccatagcaaagtacgaggtatcacttaacttagtttagttgatgttagtaacattcatcttcgtctgaatttgtatgaaaaagtatagaatttctaaagatgaggtgacctacaattattaatttaagtttatgtgaactacaatgattaatttctagaatttaaaattttcagtgtaaattaaagcccttaatactgtcggtttgaaaagagaatctgtagtgatataaggatttagattattacttattagtgtttgcatagtggtgacagtaagtcatttaaccgatcgagtgtgtttgttagtttcctattcagtatatatcaaacatcaacaaataaaaatatctttatttcagtatcaaacatcagtggataaaaatagcctaggcaatcaaatggtcccaaaacgaaacaaaacatgcctaatcagtcatacggtccccaagataaagacataaaaatgactgctccctccgattccaaaatatatgtcgttttagacataccctaccgctttcaataaatataagttgttttggaactttcgacgtagcactttttcatcatttccctcttttgtgctctcaccaaaataaacactacccctcgcacaaataaataacccatcttctataatataatataaacaaaagacaacaaagttatttgagcactttttctttattctcacgctcgtcaaaacaaacactaccccttgaacaaataagtaagtcatcttcttattgtaatactctcttcattttttaatatatgattttttaatatatgacgctgtaagcttttttagatatgtttgaccattcgttttattcaaaaattttatgtaattattttttttattgtggcttaatttatcatgaaatgtcctttaaacataacttaattttttttatttgctcaaaattttgaataagataaatggtcaaacttttatcaaaaaaaaattaatagcgacatatattagaaaatagaggtagtataatataaatagaagtcaataaagtcatgtgagcacttttctttactcttgcgagaaaaagtctaaaaacgacttatatatttggaaggaatcaaaggaaaatacctgttgatacgatgaacttgatggacacttggcccaaggcccccccgaccgggccggcccacgctgtccttgtcaaagcaggctgctttcatgtcctatacgatggatttggacatataccgattaacaaaagagagagagagagtattctattcttccgtgatgatcgagcacactccttttccaaacacgtgtgtatatatgtgtgccccgatcagacggtcttgcaagtgcccatgtgttccttcctttgtggcttcacatcgtcttcaacctgcttggttagcatttaaattacattattttctccgtctcaaaataagagtgtgggtgtgtttttcaaatttaagtaacacagctgtacttattttgaaaaagaggagtataaatttgagttaattttgctttttatactatttaaatttcggatcggctttagggttttctgccactttaatttattgctagctctacttaattttataagatgctatgagcataaggaaaaaaaattattcttaaaaacaagctccaaaattaaagaaaatcatcttggattataatcaagcgcgtgtatagacttaattaggctccatttgagtttgcacgataaagattgagtacacaacacgcaaaataagaatgccattagcatacgactagttgagttttaattattttaaactttaaaaaaatatttgataattttaaataacttctgcataaaatatttttacactaaatataagagggttactacaaaacaggatcccattgcaacgggatagacatattagctattctctttcacgagtatcacagggattaggttctagatattacagttaccgggtaacatgtatcttaggtatcgggtaccatgcaactggtaccacaacatgtatcaggtatcaggtactgtctccgttgtctaggttttctgaaatataaatgtaatgtttagtagctcaaaaatacactaccagaaaccaatgtgaaatcaatgtgaaatctgtatcttaacatggaaagaaaacggagctaattatcgcggagacgagtcgtcgattggagggtctttaattaggatccatacatccctctcacagtgggccaagcctagctggcttcggctgccttcctccaattgccttctgctgcgatttcatggagatttcataaataggccacattgagcatgtgtggttttactccaagacagattctctctctctctcatctctctctgtgagagataggcatgttgatttattattattattgttattatttccagtaaaaatctcccctgacagagacgcatcctccaccctacgccacctttgattatgttattaactgctaattaattagtgtgaattgcaaccacgagctatagctaattaagctaagggcacccacaatggttatctatagactctctacaagagatccatgtcagcatattttcctactttaaaggtattaaataaatagagagagcaaagctatctactaacttagagatagtctatagagaaaaacgaggcaatgcatgagagagctatagataccaatgtagacatactattaaggtggtttactattaatcgagtctattgctgagatgtacatattttatagagaacaccttactttaccattgcgggtgctctaagtatatatagctaggtcgtcaccgatcactacacatgctgattaatcaaagtcatgggaagctaattaatacgacgtgatcatgttgaagaaattaattaacagtactacttcacgagagcatcaactaattaaacgtgttgggagttaattatatttaattattgtctggaaatatattccagctcgtgccagtgatcatcaacttggggtttattgtagcaaaaatggaggttacaaccacttttaatttctttaatatatatatatatatatatatatatatatatatatatatatataattaatcatggccatcagggtcagagagcctacacattaattgtttttttttcttggttagaccatccttctcacgtatttaatcgtcaggctcaggcaagagatgatggcaaaaaggatacatatgtggccaattaagcaatagggggccaggtttgacctttgatgataattaattatgatggatgctgccgtagttgtgtgtggttttcagacacgcagcatatttcggttttaatttaattgattgattatcacattgatgccttctctcttctttttaatatatgtggttgtaaggacatcataatttggctgtcattgtaaaggggcctgcaggttctctacttggtttgattcccatcgtgatcaactctagtctccaaaatggaagaaagtactttttcctttgaacaataatgtgtacattttggttttagagacgacctttagcacttgagagaatattgtgggaaaacataattatccaacggctaaattaattaaatattaagtgtgaaaatagtcgttgtcttgctaattcaaaaaggcatttcaattaataatagtgaaaagttcctttcctatgtcctaattaagctttttgtgagttttgttcggtttgggataatccttggaggataatccaaactcaaaacctgagattagcaacaattcttgcaactggcaagcatagagaaataggggtgaagattctctatatgtgggtctcacccacctattgatccacgcatcaatgtttattatatcaatgtttataatgatagtgctattatgatagatgatgagaaatggatattaaaataactgttctgctacaattctgtggacacatattttttgaccggttacagtcgatttttcggctgttcgatcctatcaaaagggtcacgcagtacaaactaactaagtaaacataatggatcttatcacagtcgtccgttaagttcttcatgcagttaggagtataatccatagcattaagttggctaataattgaagattgagttttctttctttctactagaaaaaatacctgtgcgttgcaatgggtaaagactattttaatcatatttttgttaggttttttttatctaaaaagtatatgcgatttttattttgatagtattgatatctaatttggaaatcttattgagataatggccatatcctgtgcgttgttttcttatggtttggcaaaaattctgaagcaattaggagtccgactctcgtcttaagttaacatgcgagttttttaaaataattttttatacgactccttatatattttcaaaagtgaataaacttaaaaaccgacgcaaatataaacgatatatcaaagtatcagtggaaacatcttcaatttttataatagtagagataacgcttttgcttacttttctatttggttccaactaaaatctatatatagtgcaaggcttaaaatttatagtgtaaaatttgatttttttttccttttacaatgtaaagaacttattacaggattaacatctactcttgtacaacttctccctccatcctagaacctccatcctagaaggaggagtacaattctatagcgacgaccatataaaattcactcctataaaattactgggtgtctctatttaaaggtattggtatttctggtacttagtactctctccctcccaccttggtactctccttaagctagaattgttttttttgggaggggggacaaattttaaaaggtagaattacactgcttttgagacagattgagtagaacttatggcgtaaattatatgtttgaaaaaatgacttttttttacctggaaaaatgactgttttacaatgaaaaatatgggaacataaatctagctaatccatcaaaacaatatagtaaaaacttctattattgaaatcaggatttaaaaaaaattagatttttctacttgtgatttgaaaactacaaacactaataacataatgaatttaatagtctaaaccacaagaaactttgatcgtcggaaatcacatttccaactgcaaaaccccacatatcttggtttcagttttttgggggaaaaaataaaagctgatgtttatattcttgaatttagaaactttcaaataacaacaattaaaatttataagacaatacattggagttattgatttgagttgagcattaaatgttttttaaaatataatgagatacatttgatcccctctccaccaggagctagtaactatgtcaatttataacctaattgaaaaaaaatactttcaagtcaatatgcagtacaatttaaaattaaaatttattttttataacatgaaagatttttatttagttctttgttttccccaagtatatatatatagttctgtgaaacttgctagttcaatttttcaaatataaattttgcatactcaccaatattaattttaattcccacatatgttttgtaatatctggcagagacatctgctatatttagacactgacaggtgctacaaattttagccatttttgtcttttacatgtattgtcataatacaagggcagtggggtttctctcgtgcctgcacgtacggtagtagggcgaggagaactcctgtggctcttatagttcatctgcagtactgtaggtcgagcccataccggtcatgcatttctaagtatttaatttctctctttaattatgcaagacaacaacatgcaaccctgacaataagcccttcaaatactatatgacagacaagagacacagctcgctagctatgtggtgcatggatagataccaaaatgtcctacaagaggacaattatagaatctcaaatttttaaaacactttttatttttaattttaaaaataaatatttctaaaacttattttcaaagatcttaaccttttggcggcgtcagctcgaactgatgtatgctgccacgccgctagcgtaacagcgttatttggccacgtcggtctcggcggcgtggcaacgttattcggccatgcctctctcgtcggtgtgacaggataaatatggattgcgccccctgcagatggtgtatcagtgttgttttgctacgccagacggactggcgtggccaaaaggatcggataagattttggaaatatgttttgaaatgttttatttttgaaattaaaaatttaaaaagttcaaaaagaaaaaagaaaaatctagaatctccgcatatcatatttcattaagtgtgagtgcatttttcaaataattagaaagaaagactaacactagactatacgtttagattatcagggtgatgcccggctgtttgcgagtgcttctccgtcaacacccccactcactcttcccagttttagaaattttagatctattaggtggattagggtttgtcttctagattgtccatggacatgcaattgcctagagtattttagtttttctagcttactctttgttgatgggtactgcattcatggggtttttgataaatatctaaaatggtttgtatgtcgtgtgatttgccaatatgtttgttgatgatggcttcaaactagacgcgccttaccaacacaagggtaaatgtgtactttcatcactatttctccctctatttgcattagttataataaaaaaatgtgtttggtgtttagcagataattatcatgtttttgcggtgtcctttagcacatacacattatttgagtgttttgcggctaaaatcataaactttagatgtcctctgataaattttgccaggatgatatcctcgttcatatgcctttacgtgtcatagtttgtaagcattgtagctatgctcctcatctcacagctcttgcaacattccaatatggagagcacctttgttctcgattgaaaggtttcgatgtgttttttttacaaccaggttgtaattgtttgttgtatttaatactccctctgttatataaaaaaaagtacatttttcagtttttataaaacatttgacttttcatcttattgaaaaaaatattataattactacttttgttgttattagatgataaaatatgaatagtattttatttgtaactaatttttatttttttataaattttataataagaaggatggtcgaattggaaaagaaaccaaaaatgcgttgcttactctgtcccaaaatataagaagtttttagagttggacacggttattaagaaagtagatagaagtgaatggtggagggttgtgatcactactagaaaaactatttgtgtagccaaaactcgttttcgcaggcggccaaaccatccgcctgtatctaaacgactgtgaaaatcattaatttttttcagacggaccaagcatccgccagcgaaaatcatttacacaggcgaaaagtcaaatttcccaggagatagcagcacctcttgcaaaaatagtttcggcgccaaaaaaactttttcgccaccaaaccagcccgccctcacgtttcacccaaaaataaaaaattgttcatcgattcaacaaaatacaatcacaagcatccatttatcaacacaatctatacatgaacacaaatacattggatttaattccacatcaccgtcttgtattgcagcatcaatcaaaataaaaacaaataaagaaacacaaaaaaatcacagctccgtcgccgccggcctcctccctgccgccctctactgctccagaggggaggaccacgccacgaccgccaccggcctccacccatccctcctccgggccgatctgagtggaagagggagggatggaggggacgaccacaccagggaggggatatgccgctggacctcatcgtcggcgccgtccctcgtcgccgagcagctgcctccggccctccttgcctcgccgagccgcctccatcgacctccttgtcggcgccgacccttgtcaccgagcctcgccgagctgccaccggacctccccgccgaaccgccaccaccgccggccctccccgccgagccgccgccggatctgggagaggaggggtcgcggagaggggcagcgacgtggccggcggtagtcgtcgtagtggcgcagtagttgtcgtcgtcgtcgctcgtaggctccatcaccgatgccctccgccctgcgccgctgacggccccctccgcccgcgccgccgccgaacccctccgccggcaccctccacccgttcctccgccggccccctccgcccgcaccggccctccgcagtaggaaggaaggaaggggaggggagggaggagagaaggaaggaaggcaggggaggaaggaaggggatgggaaggggagagagagaagggtatagcggtggagagaagaggataaggatgactagaatttatttggataggtagcatttttgcaggcggaccacataaggtgcgtctgcgaaaatagcgcaggcgaactgtgaactttacctcgatttatatttttgtatgcggttatttgctgtaagagtcatgtctgctgcgaaaaaaagacccacacgtcaggaaaaatgctttttctagtagtggattggttgggaagagaatgtttatgaaaaagctgttatattttgggataaatcctaaagactaaaagttgttatattttaagatggatggagtacagtctgaatcaacctcgtttctcgaggaaaataaaagactgaagtggtacgtacagcgtcatgtcaatattaatttagctcatgatatcatttcttgcagcagcagttgaaccacgtcccgttgcctttactcctaaatgcaacattgcatatatgcatgtgacacatgtgtacatatatatatacctatcctagatcaggccgcccctagggggcggaaccctagcctccgccgccgcccctcctcctccctcctccatgcttcaaagccaccggagctcgtcgccggcaaagccgggcgacgcgttgggatggcggcagcggggccatcctcctcggctccacctcgccccggcgcgggcgtggcgacgatggcggcaggacggcgaggtcgtggcgacggggacagcgtggcgacggcgcggcggtggggcgctcggtgtcggctctccgcggctccagcgacgggcaacggcgtcgccagatctggactccccacttggccggggtgaccggcgatgggctcggtcaacgccagcgccgctccgcggacctggcaggggggtggctagcggcggcgatggtggcggatatggaggcgacgaagttggcgacgacggcagcgcactgcggcacgtgccgtgacgccggccctcgtcaagaacctcgccaccacgagggaggcgcgacaccctcgtcaatgctccggctgtgaacgccgtgcccttgacgccttcctccatgatgccaacgacccgcgcttcgcactgcacctccgatccgcgccaccccggtcagatatggacggctggcgtctggcggcgctggctagcgacggtgcggctggacggtggtggctggactgggggtgtccgtggcagtggcgatggcggtggtgatggtggctgacggtggcggctggcgacggtggtggctgtggcagtggcggtggcggctgtcgacgatggtacctatggcagcgatggttgaaggccatcatccggctgacggtgcgtcgtcgtcgacggcggtatgtggaggcggagaaggggtctagcggcggggaaggagtccgggtgcgggcgcgccgtcgacggcgggaacaattgtgggcggtggccttgaccgaatcgctgaagggataatgttgttgaccgacgacgatccttcttgtgcggattggtggtgtgggtttggacagggaatcgcgggcgaaagccttgccaagccatttggccggctgacaacggcgacgccgtttggcgtcgttcctctccttggaggcgttgttttagcatacccctttcctttccctactatattctccgggtgaaaaccttgcttcggttccgaacgagcggtggcggcgatccacgtcgcatcctccttgggggcaccgctttggagaaatctcttcgtgcaaggatattgtcattggtctatgcattggcttcgaatttcagtcctaggcctggacgaggccttctagctccacattttattttacttttctcagtttgggtcctctcttctcttgtttggtgtgttcaacttgtcttgaactacactctcttcttgagtggatctttgtaataattggctgtagttctttttgagcaaagaccggaatattatattccattatctaaaaaaaatatacctatcctagctatatattctatctctcgatgccaatgctctcatcaccccaaaacggcccaaaaccgcaccgatttcgcccccacgaaacaacatcatttgcacatacagaaactccggccaaaccacaaccagagagagacacacatatatacagagagaaaaaaacatagagatgtgtacatgtgtacacatgtaggggatcagagagagaaagaaaacattgataattatacaaagggataaaattaagaacatggtgggggatcattgaaatctgaacttggacagtgctgaggggcagggggacatgctggtacatgttgctttcagggtgtttgtttgcatttgcattgcattgcatgatagcaaatgtgcatgaatgcagtacgcgtatggtgaattaccctttcgagggttgcgtccatggggaggcatgtgaaagggcagcttggccactggccctgctgatctatctcatatatatatatatgtatatatatatatgtatatatatatatatatatgtatatatatacatatacatatatgtatatatatacatatacatatatgtatgtatgtatacatgtacatatatgtatgtatgtatgtatgtatgtatatatatgtatgtatgtatgtatgtatgtatgtatatatatgtatgtatgtatgtatgtatatatatgtatgtatgtatgtatgtatatatatatgtatgtatgtatgtatgtatatatatatgtatgtatgtatgtatgtatatatacatacatgtatgtatgtatatatacatacatgtatatatatatatatatacatacatgtatatatatatatatacatatatatatatatatgtagtaaatttgtttggtgcccgggcaccatcgttgaaattgagtatatacccaattcaaatgagtatgaatctttttcaattacttagatattaacattaaccactttactaactaactagttcaaagcaagtttgaactgaatttaaacttgtttttgttagattttgattctaggtatatagcatccatatatataattagttaggtatgtaatcatggattgtgaaataaaattaaatttgagttgttttgttgataggtataggtatgaatcgaattattaaactgggtatatactcataatttaaaaattttgagtgattttgtgcaatatataccatggtgcccgggcaccatggtgccccatatgagtgtcctatatatgtatgtatgtatgtatgtatgtatgtatgtatgtatgtatgtatgtatgtatgtatgtatgtatatatatctatctatatgtatatatatatatatatatatatatatatatatatatatatatatatatatatatgtgtgtgtgtgtgtgtgtgtgtgtgtgtgtgagaataatgctaganagtcttgtaacctaaaacggagggagtattgtggtttggggacaaatttcagactaagcgacaaattaagggacctaaattgaacttattccaaagaaaaaccgtagtaatacccaagcagtcccagcatactgtcattgcttttcacgagtccccaagcacgaacctagtctcctgcgtctacgtggtccatgactatagatggccataagggccgagacccgacggcctggcccacggcacgacgttttggcccgacccaagcacggcacagcctgacaggggtcgggcccatgccggtcccgccgacgggggtcggggcca

SEQ ID NO: 61224 - DNA, 23678 bp, Oryza sativa
aaatttactatataatatatacatatgtatatatatatatatagacacacacaaacgtgtcttgtgcaattgtgaatatgcatggtatgtgcccatatggccagttgggggctccggttttggaaggtggtttctgctctttcccctcctgaggttcgtgcccttgcccttatgcgcaaagccagtgccgttcctgttccgcgaccgcaactttgcgaggaaatgtgtgtagaatgggatcgcgagatggtcaagtacgattgagatactcttttttccgtgtgattgaggactagcgtgcataaaacttagtacgtaacaaattttacgtactaagttggtcagaatcttatatactggcataaattatgtgcttctattatacatatttaattaaatcctttttctgattgttttagatggaattatcattaaaatggtaggttcttagtaaggtcaatgtatctagctttaattaacaatagttatgttgagaggaacaaatatatgtggaaacttaagatgccgcttaagattaaaatctttatgtggtacttgcttaagggggttgtgttgtccaaggataatttggcgagacgaaattagaatggtagcttaaggtgttgcttttgtatgaaaaatgaaactattaaacatctcttcatagattgtcattatgcaaaattcatatggagagcagttcagttttcttttggttttaatcttccaactagtatatctcatatatttgatgggtggcttttgggggttgacaagaaaaagagtaaactgatactggttggagtttctgccatttgttgggctctatggttgagtaaaaatgatttggtttttaataaatcaccatctatttcatatatgcaggtaattttcaaggcaacgcactggctccggttttgggcacagctacaaaggtatgaggatgatggggagttcctaaaggttgcatgccgcaagttggagttgatagttatgcaattatttgctaattatggatggaggttcacgaatagacttcaataaatatgttctccttattttggcttggttttctctgtttttgtttggtgtgtcctatttagctgaactacgctcttttctgaattgttacaatgtaataattggctgtagctctttttgagtaaaggctgggatgttaaattccatcataaaaaaaaattacaatgatacctctcggtttctctcgagaactataattaattaattttactctgttttacaatcggattcgtatagatgctactcgggtttttataaaattcatcatctttgggttcagagtacacatgtttgcacgttctctcgtggagatgttgaaatgaacctcaaataattgagaatgtcccacattttcccttgaagttgaagaagctgatgtttttagctcagcttgacaaggcttgaaaagatccctgtttgacttactatagctagctataataacaaattacaaggtcaataactatatataagaaatatgtgccaatttaaccaagatgaatatgtatctcaagattgatccatcttaggtgccgagggtgtgcgcccatgcatccgaaaccagttaaccctcctttggaatgcatgatttttcaattggaattaaactgattgtcgtgaagaataaaatcctagcgttccaaactagccaggcttaaggaattctttacaaatacaaatccttttggtttgtaaccagctgttttttaagggaaaaatccaaattacaccccataactattgggtgaacgaattatctccctaagcctgaaaaccatatatctttcactttcaactatcaatgccggacaaattaccccctgacttgaactggagtagttttggccctacgtgacaatccactcaataattcttctattttaaaatcgatgggtcccacctatcagtctcatcctctctatctctttcccctcacctctatatatctctctctttcccaatcctctctctctcttctcttctcggctccactctctctctatcaccgagcagtcggccgagaggaagccgaggacaacagcggtggcgcggggacagcggaggcagctcgaagcggcgaagggagagccgaggacaatggcaacgggcagggacgagggaggcgcctcggagcggtggtggcgggtggggatgacggaggcaactcggagcagtggagggggagccgaggacagcgggagcactggtgctattgtgcgtgctcgccgcagtggcggccatgtggggtgtgctcaccgccgaagctcatgccagcctgctgttgcgcgccgccgctctccagtgtggagctcccgatgaacatcgccgacccatacatcgttcccggattccccagccggccatcgcctctagctatagtgatgctgcgtcgtgagccacgacgacacgaactgctgctgctccctcttgaggcacaactcttgccccccccccccaaaaaaaaaaaatcgccaccaccaccaccactgttgccgccggggctcctcatctacatttgacgtgcgcgcgagagagtgggtgtgagagggaaagagataaggaggagagagatatgtcaggtgcccatcagttttttttaaaaaataattgttgactgggctgccacataggattaaaaccacttgcaaagttgcttggggggttttcatccgatataatagttgaggatgaaagatttctgtttttttggtttatataagggggtaattcgtactcacccaataattcatgtctaatttggacttttcccttttttttaatcgatgagtacacacaaaatgtgtaacgcgtgtaagagaatcaaagattctgcaacatagagtatgaaaaagagtacatttggtgttcagctgctctactgctttatcaaacgtatagagcctgagagaggcgtaggtagggcacgaggagtgaaatgacaatagttgctggatggaaaagacaacagttgctgcctcaagtaaagtacccaaaaaaaaaaagaagaaaaaactatagctaggtcctcaacagctcaactcatggtactataggcttcataggttctgtttctaggattatatttattaattatttatatttaggatatggctgtagctatcacagtcctaacagtaggttgtcctgcctttgtgtaacctttttaaattgttgcattaaatatttgtttgtactcacagacaaattaatgcaaatttacttatatactaaaagtctaaaatatgtacccctccgtcccaaaagaaacccgtatccagattcgtagttagggtttgtatttttgggacggagtagtacaaatagtcacaaatcacatggttgtaaaataatcatggatcactccaaggctttccaagctatactagctaacaaatttaccatagaaaatatatatctgattctgcaattgatcatacctgtgtggttcagtgcatcttctcaccccgcgctttgctgcgggattaacggatgagtatatgttaaatattgtcgaataataaaagttgaaatgttgagaaaataatgtgaggaagatgatttgacacatacttatcaatctctataatataatatctattatctatctatctttatctattatatactaaaagtctattaatcttcctacaaacgctctcaagtaaccacgtggcttcctaaaaacactctcaagccgccacgtggcactctaataaattagataaaatcctacaaattctaagaaaaaagcaaaacatctagcccttgattttacttaaattggtggacccgatatttcaagccattagattaaatctattaaaaccattccttctaatatggatctgatccatatgatgaagaggaaggtacgatgtagtattcgtaaacagaaaaaaaaacaaaaaagatctttcctatccgatgcatatggatggagaggaacgtacatatgtactaccaaaaacacaaaaaaaattacatgtaacgtaacgtacgatcgtatgatcggaaattaaaaagataaagccgaaaaaactagattatacataaaaatccactgaactttcgagaaacgctcttaagccgccacgtgactcctacaaatgctacttagccatcacgtggcgctctaataaattagagaaatctaaaaaaattccgggaaaaaaaaggaaaacatcatataattgattttcacttaatatggtggacccatcattttatctcctattatctcacctcctcacttttttatccaaattttctagctagcataagccattaacacataattaattgagtattaactattttaaacttcaaaaatggattaatatgattttttaaagcaactttactatagaaaatttttgcaaaaatcgtaccgtttagtagtttgggaatcgtgcgcgtggaaaaagaatcaaacaaactccctttcatctccaaacgaacacactacataaacaataagaaatgctatattaactatctattatatcgtaaaaatcaaataaacttcctacaaatgctctcaatcactgcaacaaaaatctcatctagaggcacttttgtagaggcgttttacaaattgcttataagatcagaagtttcatagtgtagagacactttataaaggcactttaaaaattgcctaggaaacttttagtctagagacatttttagctcagtttattatagtttatcttgtagaggcattctttcggtactgtaaaatgcgcctgataggtataggcattttcttgagacattaaactatgtagagacactttttggaatgataatgtgtactaaaggactaaatataagtaaataaaggcataaatgttcaagtagtggcatggagttgagttggttagtgcattgaagataaaaatgatttgtccaagagatcattagttcaagacttgataaaagcaataaaactattttattctccttttttgactggttttatatgtttgtgatacaatttaatgtctcttaaaaatacctctaccatcttatagatattttataaaatgtctcttcgtttatagagacaactcaccataagacacttatgagatattttttaaaatgccttctaccatattgtaaagacatttgaaaagtgcgtctacagtactagaaaaatgtctccataaaatatttttcttgtagtgaacctgtcacatgcgtggtgtactacaaacactcctaagatgccatatggctctcaaataaattaaaaatcctaaaaattatgataaaaaaataaaccattgattttcctttaaataggtgaacctaataattataactattataataaatactttttaaaagattttttctatttatattgattcacatgcataactaattgcacatatatgagaagtaattaaagagagggctagcaggatggtaaaaaaccaatgaaagtttgttgagatttatttacgaaagagagatataaagacacttaattcaaaatagaaaatatattactttaattttaatttgttttgttagaactattttagaaataaactaatgcgcatgcccgtgcaaatgcgcgggctattttcctagttgtaaatgatgtgtcatacttgcatgtgatttaaaataggctcgaataatattttttttgacaccaggctagaatagtaattgctagtgagtgaagatgtggcatgcttccatgggattttaaatgggttagaataataatggctagtgggtgatgatgtggcatgcttgcatgttgagttttagcttctaataattgttagtaggtaccaactatatagaaagtatagatagattggcgcacacacacatggaaatgcaaaaagtttgacaatactaaatcaagtaattaatcctgcaataaactctaataactaaatctgttacatagactcagaaaaaaatgacaaaccctttgaaaaagaaatcaaaaaaggaaaatgataaaggtagaattcatagttgcattgtttctgtttctcctaacatactacagtatatatgttgcaatatttttttgtcttaagtttgattacattacgatgtgtgcaagtttttacttatatattgtgctatctgaggtggggatatacacgaacaaggaacaccctcatcactaacctacagtcatactctctcttcgtcccacaatatagtaaactaatactcgattagacataatatagtactacctccgacccaatttaaatacagttgtgggcttctgtatccgacgtttgaccgtctatcttatttaaaaaaaatatgaagaatttttttaaaaaaatagtcacatataaagtactattcatggtttatcactaaacaataaaaatactaatcattaaaattttttaaataaaacaaacgaccaaatgttggatataaacagtacaaaactatagtctttttggacggagatagtactacaaatttgtactaatatatttattttaggatggagtagcaccatagtattattattagcacaatacaagtcactctgtgatgtgatctcaaatattttactactagctctaatattataatatttactcatatataatttttaggcacgcatgaggtgatgagatcagaagaaaaatctttagacatgaggtgagatcagaatatattttaaagaaacaagtacatatgcgtgcgtggaagatgaagttgagctgcccaagccatgaatttaaaacagaaagatgccctgacaggcacctcctccctgcagctggaatctgatgatgcagtcaccgttggcactgaaattaatccaatccaatccaacccaatcaccattgtgcatgagagcctccccccataaggacagttgaagaatggcattaaaagaagaaagctgtagtagtactccctcagtgtcacaaaactctatttttcagtttttgaatataggagtacaacgtttggctcttcgtcttatttaaaaattttcttaatatttttattattattagatgataaaatataaataggattttatgcataactaatttttaaaataaaattatatattttttaaataagacgaatggccaaacattgggaaaaaaataaaaatgggaaaaaaataaaaatgaagttttgtgtaacggagagagtagtagtagctgctgatcaaggaaggacagctacctaatgatcagaaaacagaagggagactattcattcattcattcattgattcatgagcacaacacacctaaattttgggtcaagcaaaaaaaggtaaacaaattgttggggctctgcttcttagaaggtgacttttaatgatattgtttaattctttgttatgggacaaagatgaagtcatatcaaaagatttacccactggtgttgcaatttacttcctgtttagtagtccttgtgatggcattttgctctgtaggatctccacatcaataagcaatcatcagaagatatcgtggaaaatgacacgataaaaacaaaaaaacaacatgtatttaataactaaaataaattaccagaacatcacatctatctaaagcatggtaaaagatgtcctactccagttatcattgataggcaagcaccaaaaaacgaaggtttggatggagcactcctccccttctctccacatgctcagatgttctttcaagagttttttctagagaacatttgaaaacaactaatattaaatgtagaaaaagatgtttcaggaccatggaaatcttaatataaacttgattgatgaaatgtggaaaacaaacttgatctctttgtgttttatacatcttgcaaatatatttgaagattttgaatttatttgtagacttttatattagtatcattcattcatcaacgtctctacaactatacatttttatgaaatatacttgagaaagtttgcaaactttacttgagtttattccttgaaatgggttggcacggcactaatcttccttgtatatagtactccctccgtccaaaaaaattaaagctagaaggggatgtgacattttctagtataacgaatctgaataaagggctatccaaattcattgtactaggagatgtcacatccttgtctaggttatgttttttgggacagagagagtagtattagctttgaattctataaaatttgttccccagagtttcactccatggtcaatttgatatcatacatagtacttatggatcaatttgatgtctgaaagattttattattttgttcaacagtctcttccaagtttgtcgatcccgttacctgatatatataaggcatccacaatatgtatagaaaatttagatcttaaacaatgaaatatccattatgacttggtcacagagacattatgagggtggatcaagctcatgacacaaaaacaaacccacaaacttgacaattttaaaacaatatttttcagtatggttcttctatttttttttcaaactgtatggcctagcttaatacccatctgaggtatgaaaattgtgaaagatgtcactatacttttaccaacataactgaacagaaccttatgacctccttgggccatatacatttcatgatataaaagggtgccttacatagaagtttgttgtgaccgatatgtatttatttatgtaagtcaagtagtgtatgaataaattagaaacggtataaccatgttgtgcacacatgagaataaggtacacaacctcatgagtggcatgtctactggacttggtcaactttaaggtaataagacgcccttttctctatgtatctgattttcatgtgttattgtacacataagagtaaatatagacaatttcccatgaatcttgtcgtaaaggctagtagtttactatggtagcaagtccactatatggtgtttcaagtaggggtgggtgttcagtttttccggttttatcggttcggtttgttcggtttagtagaagattggtttcacataattactagccaaaattcctcccagaaaaattaaaaccgaacctttttaaaccgaattaattcggtgcggttctttcgggttcggtttataccgaacttgattttgaccactccatcagttcatcccactaccaacaataatcaggaatcaacaacatataaaaaagagtaaatttcataaaactacacatactttgactaaattatcacaaaactacagatttaaggtcatatatcccagaactacagatttagtaacaaatttaacacaaaactacatgtttaagactaattatcacaaaactacatatttaataataaaactatcacaaaactacatattttggggtttaaatcctttgcactaatgttatgttttgagttgtaaatgtccaagttttataattaattgatattaaacctatagtttgtgataactttgttattaaatttataattttatgatattttaccttaaatatgtagttttgtgataaaattagttttaaatctatagttttgtgatacatcatgttaaatctatagttttgtgataatttgatcgaagtatatgtagttttgtgaaatttactctataaaaagaagttccatcatccatcttaggggaaattaagagtattcgtgtacatgggcttaatcaccataggccattgaaccagaacaacagcaagatggcagcaagatgttagagaatcgaagactaaccaggaatccaagattagcacctgctggcctatgaaggaggaactgatcgatatctcggaattgactgccactgccatggttggctgcgccgtctggctggtcgtctgcgagggtcgaggagcctaggacgagctcactgggtggcgctagggttggataaagttatgctatctcttgggctagatggaaggggtgagttgggccttgtattaccttggactgtcccttcctcggttttctcggtggaccgatttattcttttgaagaaaccgacgcgatgactgaacaccgaactacgaaaaccgatggaaaaaccatagaccgcaataaccgccacttcggtgcggttcggttcggtgtccggttttcggtaatttcttgcccaaccctagtttcaagtaggccggaggaccatatttgaaccacaagacgaacttggagaacaaatttagataaaaatgaaacatcagggaccaaattgattccaaagcgaaacctagaggaccaaaataaaaacataagtaattaacagttaacagaaaataccaggtgctcgtacgagcctaaatgtaagtctttcttggctcatgcttctcacttgtctcccacatgttaaattttacaatggaacaccacaagaccaattctcaatccatggtactacgcaaatgaaagaaaaagaagtttatactgcatcgcaaaaaccccgatcatcgcccctaaggccctgttttaacttgattaagatacatactttttctcaatttccgttagcacgcttttcaaattatgcaaaaactttctataaaaaggttattttaaaatatcagttaaatcaaatttcgagcatataatagttaaaactcaattaatcacacgtttatgaatcacttaatcatattcatcatattcaaacgggacctaagggcctattcggcacagctctagctccagctccacttctcctaggcctggagctcagtcaaacagtttcagctcagctctatctaaaatggaaacagagctaggtggagcaatatcacaaaatgaattagagaggttgagctgggtttaggctgctccacaactctacttcaaaactcaactcctgaaattaaatttagaagttatagctctaccaaacaggcccgaaatcaaaacacaaaaggcgcggaaattaaagcggtttgtcaaaacgccccgatggagaaaccacaccacatcaaacacagagccttataatttgcccatgactgactaggccccttccccctccctcctcatcagcaaataaaacgtgcattaacaatgaccctcccaagatgagcagccgcaggcatggagagcctccaatggcgccctccctgccgaccttccccatatatgcacacactcacatatatatatacacacaaacacacaagcatatatgcatcccaacagtccatacctccatctccccccatgcttcgccttcgccttcgtcttcgtctacctcatcttcgaaattctaacaccaaaattaatttcattattagtaatatagtatattagagtagtagagggatcgagagagaggagaagcatgatttgcttcatggcgtggttcgtcgcggcttggagctgcctccttgtggtggtgatggtgagctcgatgaggcttagtaggtcagcttcatcgtcctgtggatcttcttgcggccatggcgggtgggggccgaggagctacccggtgatcgggtgcctggtggcgttctaccgcaaccggcggcggctgctggactggtacacggagatgctggcggcgtcgccgtcgcagacgatcgtcgttgaccggctgggcgcgcggcgcacggtggtgacggcgaacccggcgaacgtcgagcacatcctccgggcgaggttcgccaactaccccaaggggaagccgttcaccgacgtgctcggcgacctgctcggcatgggcatcttcaacgtcgacggcgagctctggcacgcccagcgcaagcttttaaccaccaattcttcgcgcgcgcccttccggaacttgaaggcaccctgcctcaaggccaaggcccggaaccgcttcttcccgcgctcgcggggctcccccgcgcggggtggtggacatgcaggacgtgctccggcggttcgcgttcgacgtcatctgccgggtctcgctcggcgttgacccgggatgcctcgacccggcattgccggcgccgaggctggccgcggcgttcgacacggcggcggggatcatcgcccggcgaggcgcggcgcccgtggccgccgtgtggaaggtgaagcgcgcgctcgacgccgggtcggagcggcggctgagggaggaggtcggggtgatccatgaggccgtgatggggctcatccggagccggaggaaggagcgcgcgctcctcctggtcaacggcaatggcgtcggcggcggcggcggcgcgaggagcgacctgctgtcgcggatgatcgaatgcgggtaccccgacgaggcgatccgcgacatggtgatcagcttcatcatggccggccgcgacaccacctcgtcggcgctcacctggttcttctggctcctcatgcgccaccgcggcgtcgaggcccaggtgctcgacgagatcgccgcgacgcgccgcgcccgcggcgcgggggaagaaggcggagacgacggcgagggcgaggggctcgacctcgacgactaccggaggatgcgcgtcctccacgcggcgctgtgcgagacgatgcggctgtacccgccggtggcgtgggactcgaagcatgcggcggcggacgacgtgctccccgacggcacggcggtggggcgcggcgaccgcgtcacctacttccagtacgggatggggaggatggaggccatctggggcgccgacgccgccgacttcagcctcgacaggtggctctccctcccgcgcggcggcggcgacggcgccgccgccgcctcgccagccgccgatgcgttcgccggcgtgtcgccgttcaagtacccggtgttccagggcgggccgaggacgtgcctcggcaaggagatggcgttcgtccagatgaagttcgtcgccagcgccgtgctccgccgtttcgagctccgccccgtcgacgagggccgcacgccggcgttcgtgccgctcatgacggctcacatggccggcggcctcaacgtgacggtgcggcggagaacgccggcgccggcgacgtcgacggcggccaatggcacaggaggggaattgaccagtagttaacccacgtgtaagtacaacaaaacaaaggattaattaattaattaattaattaatatactatacaactgtgctaagcttacactgcagcttacagctaagcactgtacacactctgtatcatatgaccatcatatgaaattaaagagatacacacaccatgtttcattgagatccttgatagatccaaggtaaacattgggtggtgcttttcaaggtatcttccctgctgcacaagcagcttcgtttgttgtgccgatccggccacgttttttttcttttcttttttttttcaattaaggatctgtttggtttgtttgcggctacggtttgccgcacatcaattaattgtcagacgagatgccgtagcttgttaaataagtgtctggttgatcactgtaactatgatccgaaaccatgttagcgacaccacaccggtcgtgctgctctacccctatgccaacttataaacccctttatgcggctctttcggcatttttacgcccgattcatcttattatcaaattgtactataatgcctcatctcgactcgcatacatatgcattgttatcacctgcttgaaactaatcacgaaaaacacatcatacacatactacattaactggaattcacacacattccggacggttaaatcatgaacggatagagatgttcaccgatttactgaaaatcaaagttggcatcaccttttaacgcacacaccccactacacacaccgttaggtgggatttgatgcttagctttttgctgcctgaaatattgcagtcagcctctctctgatgtgagctccatttccatcatcaatcaattggaaagttcatgggttcagtttctagttatatgaccactactagtactagcaatgcatatgcgtagacaaacaaacagacagacagacatgttgaatgataaaagagcatgtggggattttgctctaatggggttaggtgaagggatgagcccaagtgcaggtgcctatcacagttgcatagaggggaattaaacgttgtggaaatatatatatcaaagagagagagagagagaaaaaaataaagatttggtaaaactgagactagaatatatgcatatatttatgtgtgtgtatggagtatggttgaagtgaagaggaggagaaaaagaaattccatgtgttgccacaccacgtgctgaatatatatacacctgccccatcatatcctttgctttcacacttggaatattttttttttcttagctagatcgatggacaagagagagatgttaattacattattgttgtgtagtactaattatgctacttaattagaagggcaattaaagttgaaagccacatttgtgtgatgaatttggatgcagagttatgttatgtagtgttggttattgggatcttgtattttacaactagattttataattaatttaaggaagtttttactgctaagagtaagtttttctatataattgttttccgatgcatcggtactgtgccttcggacttcaattcagcttataatccgcagccaaaatgccttccagctagctatttggatgaaattaattacgtcactctttggagagttttcgagcctttgaatcttgacccagcatctatctatcgttgtcttgtgttgtttccatcacgatggataaagattgggcgtagaatattctaacttgttgatttcctaaaaaaaaaagttaaattcaatgaacttatacaaattttaaagacaaactaactataatgtcaatcaagaggcataccactaaatatacaaagaaagatgtacggtaattaaggtttgaagcaaagataataagccataatgtggaaaattaaaccacctccacaaccatttgtttgaacttgttttcatacttaattaatgaaagtaatatacgtggttttcatatttcatcaggaagttaactagacttttctctttttttttcctattgcagtctactgcaattgctgacacattaataattacttaatcgatctcttcttagcgtgtgaagagtgtaaaacattaattaatttttttaccaggaatactgctagggctttgcccagcaatttaaattttataggtaaaacagtagttaattattagaagtaataaaaataaccaaagtactaatttgttctcacagtttagagaggtcatattgggtaaaaaaaaatagcacccttaatcaattatatgtagatgaaaagaaaatgtgcgtaaacaatcaatcatattttagcacatggaagattgcttaattaattaatcccaagacacatacatgtatggtcagtatcactgtttggtggttggtagttttcgctgatgtgcatggcttgtctgctcgcttcttaattatgtaaatcctactcttaatttcctgtggaacttgggctgaataaataacgataatgaagtcaacttttgtagtttatcggatgcatgtacgtactttattagagcaattaataaagaacaaaacatgtttaagaaagaagtcgtgttgtcctgttcaaccaacattatactactatattatattaatcttccatgtgttttctttcgttattctgggcaaattaataatcctcaattattcatagactgatattaagcataataccaattgatgtcattaattcgactttttgttgtggatatatattaactccatgtaaacacaacagggagtaattaataattaattcagctagcaccacgtgagagctggactaatgggattctagaggtagactattacggccaataaatctttaaaataatgctaatagatatccttaattcgactattcttttgtggatatgttaaccccttctagaggaattccatctacattgacccttttctaatcgtaattgtaggaaatgaaaactcctaatgtcttcctttcgcggatctccctatatatacaccaccattttttcattagaaaggtttttttccttttacacctcccgccattatatgtattcctattatattaatatattcccttgtctcaaaatataagtgtttgggttggatagggcacatcctagtattatgtgtgtttcgtactactagaatgtgtcccatccaatccaaatctcttaatatattttaagacaaaggaagtattagaaaagacagcacagttactatgactccataggagagatttttagcgtgtagaaaatcttaacgtggttatttagtcctaattatatgaaaaagtcataatttagtcctagttcttttctaaatagttatccgaagtatatattagagtcctcttgttttcctactgcgtatttctttaaaatatttcactactggggaaagcctctttagtgttaggttgcaaactgggactccgaatccgggactaaatatgggtatctttagtctcggttaaaataatcgggactaaagagctctaccatctttagtcttggttggagttaccaactgggactaaaggttttattttttactgcttgcatattgatttcttcaaatcaaaaattcatagataagatcacatattaatatgcagatcaaatacatcacaaattctcaaaaacaaatacattgtagatcacagattcacgtaccatcatccattcatccaagaacacattaatcatcacttcacccatgagatatcatccatgaacacaatcatgaaaaacaaatcaaaatcataaatcataaacacaatcgcctcatgaacacaatcacaaatcatgagcagcaacatctactccgccaccaccacagccggccgccccttcgcctcatcctctccaccacttctcctcctcctcctcctcctcctcctcctcttcttcttctccctaccgtgcgccaccatctgcttgctgcggctgctggtacccgccgcggcccggatccggccggatccgcccgcagccgccaccgtcaccaccgccgccaaatccaccgcgggaggaaggcgagagggagaggtagagggggcaagcgccgccggtgagggaggcggagggggcggagggagaggaggagggttgggggaggaagaaaatggacattttgccactttgaaaacatggtttcgctagaatgccatcccgaaaacatgtttcgctaaaataccaatatggagcgtgccatcacagctactttgccattttctccattttcaccattttggatatcattttctctggaaagtggcttgaagagacgagaatgcccctccttctccgatgacgagttctcccgtcgagctgtccgacgatgccaccccgatcgacgacgcgttcgacaccgcccccacctcctcctccacgaagaacccgttcacctcctcctcctccaccgccgtcgccttccctttcctgaacccgtgccacgccggcatcatcccgccgcacgccaccaccgtggacacacacaccccaaatcctcctcctcctcctcctccggcaagcgcacggatcgacggatcagagcccagccaccacggcaagcgaaatcaatctcagcgagaaagagagagaggagagaggagagagagcacacggatcgtagtatgcctccaccaccggcagcgacaacgacgaggagcgggagatctgcaactgcgacggcttcgtctacaagcactgtcgggtcctccacccgcccgacctcgaggatgccgccgccgccgcttcatctacaagcgccgccgggtcctccacctcgacgacctcgtctctgcctcgttgagcatcccggccatcgacatcggcacgctggtgggggtgggggttcggcatcccggccgtcgccgtcgtcagcttcttcgtcggcggtggcgtggaggccgtgcatctcccttcgctgcggcatcgccatgcccacgtcaccgtcattgccaccgccgccatgcgttcgctcgccacctcctccatttcggccacgcggaccacctcgccgcgctcgtcctcttcctcccatgaactggatcgatcccctcttagccggtgagcaagggcaatttggtcccatcaagccacattccagcgaaaatgcaattgaaaatgcacaaaatggccaaaatggcaaagtggtggtgagtgcacgcttcatattggcattttagcgaaacgcgttttcggaatggcattctagcgaaaccgctttttgaaagtggctaaatgtccattttctcgtgggggatgtgagagggagggggcgggagagagcacgtgagagataggggggttccgcgtgtgcgcctcgaggagataaggatgagggatgggtggcgtgcggctgcatttttcttttcagtctttaagcccgatttaaaaagtcgtcaggtcatgtcaggctcccattatcattagtcctggttgctaacatggcctgacgattttttaaactgggactaaaaatgatctttagttctagttagtaacaaaagtttcgtgctgcttttttcaccatccagcaaagattagttttctagtagtgtttttattggacagagaagagagtttttttcatcttactctctttccttttatatgaaagaaacatgttgttggttttgcttatgtgagacggcaccaatcatcactcacaagttccaaaattctaactcatatatgatcgcaactaaagtgacatttgctctaattaatttctctctagaaagaaaatttaattatgacttgtcagcaaggaaacaaaaagtgagattaaggaaccgcacgttgtccataatctctctagcaccgggtatataaaatagtcacaacaaatgctggtcaaaatctaaaccacatggctgtaccttgggtggaataacaaattaaatttgcatctagggaagtgcctgttaaatatattgtaaactgctatgtgcaccgagcaacgcatgctacaagcaaaatggtggttaattaattgtggatgcatcatagctcaagttttgatttttgattactctttccacttaaaagattgaaaactagtttagagtacgcccaagttcgagctaaatactataaaaagccatttttcattgtaaatataagtatttttatgtcttattattatgtcgaagcggtctcttcgctactggagaacctatctttgttgggtcggccgaaaactacattagcttcggttccaataagaaccggaactaaaaatgtttcctagtcctggtttaaaacactaacagaactatgtgatctttagtttcggatggtgttacaaaccaggactaaagattatcttgacatttagtcccggttcatcccctggcctgtcaagggcctgtcaggaggccggagatctttagtcccagttggtaacacaaaccgggactaaagatccccactttagtcccagttggtaatattacacgggactaaatattatttagatctttaatcccggttgatgttaccaactgggactaaagattgccacctttttatacttcttcttcctcctccagcctgagccattgctataaattgaaggtgtaagggagggaggtgctgccaaaatttttggtgaaagtgttttagtgataatatacaaattgtagggatcgaaaaggttagcaactccattatctaatgatgtattcttggcatattacatttatagctttgtttctaaacaatattgtctccaacaaggtttatggtggaaaatgataagagagaaaatttgttatttcaaccgagactaaagatgagatctttagtcctagattttttttttgtcccggtttgcaatccgggactgtagggggttgcaaaccgggacaaataagggtttctccaccagtgcatcatatattgagttgagtttcaaggcgtttcttttcaacgaagatttgtttgatttgattttggtaggtcttcggtttaattgttaggagatatccatctcttgggcatatgttgaagataggcattgattctgagtgtgcgtgtgagtgtggtgtgtgcgcgtgaaagtttttctgtgtatttgaaagtggaataaattaaagttaaagaacatgtgtagcatcgtctggtgtgctgctccattatatatatcattaggccatcattgaatatatgctgatttatactgctcccttgccaaagaagacgaccttgactaggagctaagagaaaaaagagagaaccttagcattttctagtgcaaattaggttggtggctgtatgccctgtatgttgtatgtgacaagtttgatgagcccacgtttccatgtgtttctcccaattctaaatagagcactcgcgtgttgtgatggatctcggatacgtgcagatgaccttttttttcctcaaaatagtacaatatgatgcttatataaacatgcatatactcatctttataaaccccacacgcataccgtctctctataaaccccttcaaatgttagacctatataaaattgacgatatcactacagacgtatttcactgtctaaggaccaggtataccgcttagcactgaaagaaaaattaacctaaatgcatgagatacgttgagatacactcattttcgttgatgatttttttataaagacactattgagtgtcatttttagagaaatattgctctgatttctatcaagaaacatgcgctgagctattatcgtgtgactggagataccccatttagtgtaatttgttataaatatccttatgtatctgattttggggcaaaaatgtaaaaaaaaggagaaagaataaaaaaaaaatttctgcttatgcttgtcctttttcattcgactccgcctgagatatataacaaactgggtgaaagagcacaaattaaaggtaaaaatctatttgtgttctcacatggactagattttccttcgctttgctaactaacacgtttagcacatttggatccatcttgaggaagcttcctcgatcacacctacatccagttgcataataggttactgatagatgggaaaatatatggaaaacctgaaaactggcgtcgcattgtaaaaatcactcctggaaaagtgattttcgctgggtcggctgttttccacaatagtcccggttcttattttgatctttagatcatttttagtcctgttggtaatcctaattggtattaccaaccgagactaaaaatctatctttagtcccgattggagttaccaaccgggagtaaatatttctctcccatctctgatcggttaagtcccaaacgaaacttcctcctcacgagatacttagataagatcggatcatcccctctcttcctatccctcagatcttcttcctccttctcccctcccctctcctccccttcctcctcctcccctctcttcctcacatgcggcggcgtggcagcatgcgcagcgcgcggcggcggccggcggggccgcgcacggggcggtaggcgccggccgtggcgagcggcggcaggcggcggccatggaaggcagcagcgcgccagttctcctctccggttttttttataatttgtgattgagagatgtataatttttttttagaatttgtgatttattacatggatctgagatgtataatcgatctgtgatgcatttgatttgtgtgtaattttgtaagatttatgatgtatttgatttatgtgtaagtaatttaggatttgtatttgtgatgtgaatgatttgggatggtagtttgatttggggatttgggggttaatttgggtttatgcatggcacttgatttgggcatttggggttggatttgggtatatacatcccactcgaattgggagaaaataaaaagaaaatggactaaagatccctctctttagtcccggaaggaaacaccaaccgggactaaagatcgatctttactcccggttatttcacacgggactaaagatagcgatatttagtcttggattcgtagtcctggttggaaaacttggactacagggggttacaaactgggagtaaagatggtttctccaccagtgaataggcgtatgagatttgtccacgtcatcacgaacaaaaattatttttactcgtagttttactcatgacagtaaaacttttactcatggtgatgtggacaaatttcaaacatccatttttcgatctaacagtagtttttaggtttccataaaatatgtggttttcactccatattttttctagatagatagttaaggggttcttcttacaattttagtatcaattggttatctggattgaatccacagcttaggggggatattgaaattagtaatatgcccgtgctaaatgctactgtacaattctattgtctttaataattttaaattttcacattagcaaaaaaaatattttctataatctgtgcaccatgtcggcttaccttccttttttttttcctcactgtcagctcatctttaattttttttcttcctaatattttcctccctatctgttcggcttccattttttctccggtatatttaggctgttctctagatcgtgttctccaaaagaaacccctcccctccacgtacaaaacagaacaatgaatttacacattaattaagtataacctaaaaaacttacaaatagattaatatgattttaaagcaacttatatatatatatatatatatatatatatatatatattgttaaaaaaatgtcacgtataatagtttgggaaatgtagcggaaaatgagacactggaggttcggaacctcaataaacgaacacagccttactgatatttgacctcaaatgaaatttataaataaaacacaatacaatactacctcaggaaaaattaatagcatcgattttcattattcagatgtgccatcatctttcacaagtacaatacatagaaaattgagtatattcccgcaactataaagagtccaagaaaatataatttctgcatgttacgaatttggatgttctcttaggtcaattatattgatttttcatttggcttatgtatataaaaaaacttgatttttctatttgtcacacaaggcatacgtcggccactgctcactgagcacatagtatgagggcgtgaatattaagccaaataattagtagttgatatgaagcagatgtcaaatgaatagtttcaccatatataacaagatagcaattgttggttatctcgttaacgtcttctttcaagatctacatgatacgactactaaaaattatcgattataaaagtccatatttagatagacgtacgtgttaacatacagtcttgttatcaactcggtgcaaactgacgtatgtagcacaagatggtatctagaagataatcacacaatatttcacctgaaaggtgatgacttgctatctaaaataagaggatgttggtgagtaaaataagaggatgttggtgaacctgcctttgctcatggtcatgaacgtttttataaacgatattcctagtgctcttccctgtggggtatacttgtttctttggcttcgccaaaattcttaatggttgccttcccacacctcttgacaatgtgacagacaactgaccatgtgaaaacacgggatttagaagatagatcgcaacatttggaatggtttatccttatgattaattaatgacc

SEQ ID NO: 61225 - DNA, 5905 bp, Oryza sativa
  unsure (1)..(5905): unsure at all n locations
cgggcggttgatcactggtacccgccacctggcaaccccaacctagggattggctttgcctcctccgatcacatggtagcaccgccaccttctccttcacgccgcgccctgcgtttgcccaagcggtgccacgcaggggtcaccttcttgtgccgctcctaccagccaccaccggcgtctctcgttgtggctccggggaatcagttcagccaccttcatcgcacgtgtcgcccccggcatgccgtgggccggtaccggccatccatttgcgttgctgtgtagacaaaggtgcggaaggaggagggaaaagcgcggtgggaggaacatacaagtcataaatcagaatacaatacaagatatgcatgatacttcatccggcccctaatataagggattttaacattttgcttgcactgtttgactattcgtcttattcagaaaatttgtgcaaatataaaaaacgaaaagttatgcttaaaatactttgggtaatcaagtaagtcacaaataaaataaataataattttaaattattttaaataagacgaatggtcaaacagtgtaagtaaaatgttaaaatctcttgtattagaggacggggggagtaacacatgaacttaccagtcaatcaacgtctgcactctgcagtctggacttgcaagttgaaatagtactatcatattgtactactgctcattgcccaactgatgaaaaaattgcataaataagtaaccgctgatctgacttgcttaaccggtgcaagcagtcgttcaccaccaagaactggttgtaatagtagccgtcgtactccgcctgccgctcggatgtcctgctcctgcaccgggagccgcccggcacggacccacggatccaacaccgtcttcaccttcgggttgacgccgccggcgtcatggaagacgagacgtatggctggagctgccacaatgcgacgaacaaatgtgaggaaggcgagcgagagcacgagaacgacttgatgttgacgcacgggactgacgaacactctgccgcccgcgtctttcatagctacttataccctgctgcgcgcccgatcgactcccttgccgccaggcgccgcccagcacgaccagtggcggagccagaaaatttccacgtctaagactgagctaatgagatctcaaatattttcataaattatatagcattttttaagattataatgggtattatggagctaggcatggggcccaagccctagctgccccatgcctgattccgcccctgagcacgacgaaccatgaggcaaggcagatcggcgggcagagaaggcaaggtatatatcaagactcaagaggacgcgaaggatgtggatggtgatgatgggagaggcggaaggggacgggagcgaaagggtgataagagtatgagaccgttggtgttgcgcgtgaactaaaacccattgttttcatttttatcctcatccctgacatgtgggccccataagctgactcagaatcaaatatgtcatgtgggacaaaactaccttcaaaaccgttcaggagtcaatttgcaacggttttgagagttgggggatgggttatacccggttttacggttgaaggatgtgattcaaccaaggatgtgaattgagggatagaaattgactaattactactggaaatataatacgaactgggcctagtgcgccagaatctggattcgagttacgggctgtggcctatgattcggcagctttggaagcccatcgcatctcatactgttgttgctgttagtttcagaaaaagaaatgtgactcccatacaaaatgaaattttgagcaaattcaaaatttcgaaaaaaataaaaaataatcatggacgtagtgcttgatttgcagtgtactatggtgaataaatttattgaaaaagagtaagataaattcaaatttgagagcaaaattaaaagtcaattaggaaataggaaaatgaaataatgaaatgggcctaagtttgcactggtcatgcggccctttaaggcccatgtggagaaaatatctcatggtattctcatctctctaattttctgttattatccctaaactctacacacatttaagtatttctccaatttaattttaacattttttttcattttgttcttctttcggccaaacatctcgcggttaccacgcaaatactacagtaatcgcctcaaaccgcgcggtaaccgtaccaaaactataataccgcagttttttttgaattcaaatttttgaaaccgaaatttacaatgtttttcacggttattgcgcggttaccgcggggggtcggtaaccaccccaaaaaaagggtaaggggaaccgtggtaccacatccccgtttgtaaatgttttgaaagaaaaaaaaagtatatatagctttcctaatcctaacaaaagaaactcatgaacataggccactctacaaaatacactctaccgaacttccgtgtgtgcatgtccttaaatccaacgaacaagtacatcgcatcacattcattaaaaccgtccgatcaaagatgagcggctcaaattaatttgagtacacctaaaaagtttccagtaaaagtaaaaaaaaaatacatcagagaaaaaaaatatgcttccttttgttgctcgaggcatagcatagtactgtatatttgtacacattttgtatgggagtcacatttctttttctgaaactaacagcaacaacagtatgagatgggcttccaaagctgccgaataaataggccacagcccgtaactcgaatccgatttctggcccactaggcccagttcgtattatatttccagtacgtgtcagtgtgtcaggactaacgaattgaaaagatggaaacaaaacagcgacgacgaaatcgatcgtggcaaactgcacgccaagtcaagtcaaacacaaattaatcaaacaaatcacttttacatcgttgtatattacaacttattcggatcgttgacaaaaacaacttaaattttgaacacacaataatgtacgactactaccgtttcttttttttccaaatccaaaaggaaagattgccatccatcgcccaattgccctccaagaacatgcaccctgcacaagtgcagaggcctgcatccccctcgaggtagatcacgtccgtcgcacgtgtgcaacgcatcgtgtgccatgtcatcagttggggaacctgcagtcgcggcggatctcgccgccggtggccggcgacttgacgccgaccctgccgagcttggtcatggcggcgacgaagtcgttgaagaaggcgccctggttggcggcgtagcggtcgacgaggccgcgggacctcgggtcggagtagagcgtctggtcggagccgaggaggccgcggccggcgcggaggttctggtagaaggcgttgtcgaaccggagcggcgtcgcggcgtcgaggaacgcgaagccgctggagccgcagctgccgcgcagcatcgccgcgaagttggggtccatggtcgggtcgccggcgagcctgtagccgaagaagctgcacgacgccgccccgatggtgtgaccccctgaaaaacaaattcgacaagacatcgttgtcacatcacacgcgtcgccgccgccgccattgctgtgcatgtagctgctgccatggcaacgtaccggagagggcgaccatgtcggtggggctgaggccgaggctgccgaagtagccggtgagctggtcgaggttgaagttgccatgaggcaggttgacgctgttcctggtcgacaccctgccgtcgaacctgccgagctccaccgcgtagttcggccctccactctgcatcatgcagccaagccatcaatggccattcttttttcacgaacgcgcaaaaagattgcacgtcaatatattggaaggagaagagttttttttctacacaacgtaattggtcagacagacctatgttaaaagaagaaagaaaaagcaaaacaaaaactgtagctaggaaaaagaaaaactactgtggcagctaaacggaactccaatcagcggaaaggagggcagagccacactacactaccaacaaacccctcaaaatagcaacatcagcggaagaccacatacggccctccgagagaatgaattccagaaccatttgtgcgtgttggaatataaagtgaattattcgttttttctcatcaacttaggcttttagattgtaactcgataccgcgcaaaaatgggccggtaaggtagggtagatacaggcaagtgagtgtgagttaccaggaagatggagtctctggtggcgagggccaagatgtcggcgcaggacaccctgttccggcactgggggtcgctgtcgacggcggccttggcggctatcaccgtcgtgaacccctccggcttcagcgtctggtcgtcggggttcctccactcgtcgtcgccgttcgggttgatgatcatgatcgacgcgtcgcacccgcggacggcgcagtcgtggaagaagagcctcagcgtcgccggcgccgcgatcggcgactgctgcatcgacctctgcacggacccgcgcacgatgttctcgaggttcgggcagatcttggcgtagtagttcttcctcaggttcgccgccaccaatggcgacgagatcgccatcgccagcgcgaggacgacgaggaaatggaagctcctcatcctgtcgctgttttttttttccttcactacttgaacttaaacaagcttgaaatgttatataaactgtatttgagctcgaggtggttttgcaagcgatcggtgagtggcgtttatataggagagtgatggcgtgtgtcgtcctcgctctgagagcttctgatccatttgtttagggttttgcctcgttgtgcgtagactcagaaggtgataatgcaaatgatcatttgtttaactgaggtttaactggtcaatttggaactggtagttgatggccatgattaatcacacacagctaagctcaaaacctgatttcgagatgggcaaaactgtgggtcctggctttctgctctattatcgtactctctgcatttctgcatatactagtccagctctgatcagatgaacattcctacagatctttatctcttttgttttttgggaatcaacattcctacagatctgaatgtctctgatgaactgagatccgggtatgatacacttcttcggtgtacaaacattattcttttgtaggattcttttttttttggaaatttttttgtgagatctgtccctctgaatattgatcatagtactgtaattccgtaacaaaaacaaaatgatgatattttgtttctctcaactttggatcgatggaacagcatatctgaattccaccgttaaaacaaacatttctaaattcctctgttctgcattccagaaagcagcttccattatattgtaccttcacaaaagaaattcaagtagcttccgttgaagaatatagccatgagcccatgattgactagcacagagtttgaaaacccgttgcatactcgttctgtaacgtgtgcctccatgatttgctttggtgacgagggggcttataactgcagtttttgtttattttttgaaaactataagttcaatcgcaatgtgtgggtagacctgacctggtacatatcgccacacgcaggtcggcaggtgccaacattaagacgaacaccgcacaaaatgggtgccaaactgtgagcttaaggacgtcacactgggcaccgaactcgtccataatatatatagtatcctgctgaatttttttttgttttttcagctgaattcctagccactagatcgctccatgattcatgcaactattaccgggcccgcaacttgatttgggtttggatgaggacggatttgggtttgggtnccgagctcgaatatcaaatatcatngccacacg

SEQ ID NO: 61226 - DNA, 2297 bp, Oryza sativa
  unsure (1)..(2297): unsure at all n locations
ggcatgaagacgatgggcttcttttatgatttcaagcgcttttcttttgtgtgcgtgttctcttccggggtggtcagggaggcggcttatgtggccgtcgctgatgagagttctacggcagttggcttggtggatcaagtagtaagcttggcggcttccgtggcggctggtaaggcattcacactggttcttgctggatttttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcaggcggcccccttgccgccctccgcgagggcgattttgtactgtgcggggggccgcctgcaaatgggcggcgagggggcatggaattttgcaggcggcccccttgccgccctggggagggcgattttgtactgtgctctatatttttgtataaatatcaataggtatcaaatctttttatattgaaaactatacaagattaaaatctccaagactggtaaaatataattttattattttttagggcatatttggattgtcaccggacaaatattttgttaccgtacaaatattttattaatttttagggcatatttggattgttagtgccaaatttttcttcacgaccaaatatttggtaaggtaaaattgcatttgatcatatttagtttgctgccaaaatgtaaaattgtagtgaagaatgttctacataatctcaaatatagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggccttttacccctgtcccttctaccctgcgccctaatgtgcccgtgggagtacgtgagtcggtccggggtatggcacggcaacccgtcctgcctgtacaggtgtgacctctggctgctcctgagtgtgcgcctctggagctcctccaagctgagaagagcctaatacgtcgtggtggtctgcaccgtgcaagtcgtcgtcgtagaactggctagtaggaccagtcctaccggcgtgagacgaaaaggccccagtaccgaagatcccggctgcaaatcctgctggacaaggaccatcagtttcgtacaggtatttaacagtattaataaaaagtaaagtaccgtgtgggcgagggatcgacgctccgtgagagtaagagctggcgaacgcgcccaaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatgaatgatcaagttacgacggggtgatgttttcgtacaaaaacagaaacaaaacttaaaaaacctctgggctgagcagtaccgtgcgaaataggtgccgtaggtcgaggtcctgctccgtcggtaggcgagcgagaccgtggttgtaccggaccagctggaggtacgacgtccacggcgctgcgacaggagaagacgcgcatgaccgcacgcatcttctcctgcggcgnggtgcaatcgaaattcaaaaccgcgcg

SEQ ID NO: 61227 - DNA, 18027 bp, Oryza sativa
tacatatatgtgtatagtttataaaaccagataagagatatgtcaattttgtgaacaatgttactatcactttatcagatgaataaatgatcaaaataaaagttatagatcttgatgagttattcaactttgttgttgataactttttcagttgaaatcatttagtatttgaaaatgttgtttgaagttgtcatatttttaaattcaaattcaaacggttaaaaaattgttatatagaaaaatgaccaaaataaaagatatagatcttgatgagttattcaactttgttattgatgactttttcagttgaagtcgttcactaacaaaaaaattctatctgaatttctcaaactttgaatttaaaatatcaaattgtttaaatagagttagatggagaaatgaccaaaagaaaaattttgcacctcgatgagctctacaactttggtttcggtgacttttccatctgaaatcatttattaaccctaatttttcttcgaagttgtcaaattttgaaaattcaaaatttgaattgttcaaataaacttatttgtacaaaggaccgatacaatagttgtagatctcgatgagttatacaattttattctttatgatttttgatggttgtgtatgtgaatgaatgtatatgaatgggggatgttggggtgtgacatatcctggcctagggcttaatagaattaatagaatgctcataccaacaagctacaactactcttccggaagtagttctccacaaaaaactttgatattaaacgtgcttggtctggagcaattttaggatgggtgaccgatcgggaagtaaacttcgtgcacacgaataaggacaaaaaaaaaggattggcctgagaggggctggacagcatggcaaggctagccaaaaataaaatttattttttttaggattatactcatcagtgacgggcattaacttaggcccgattgagatgactcatctgtgacgggctatagtttgacatgtcgtcagggtcaaagctatcagtgacgggctttaattagggcccgattaagataggttcatccgtgacgaccgtttgcccgattgagataacttttcacattagtgacttctagcctgtgacggatgccgtacccgattgagatgggggttgccgccagattgagataatggtatccgttctagtgaacacatattctaacattatagtataaaacataagtatctttttttctttataggaatagactcaatttggttaagtcgatactttttgcactctcaactttctacccttgaaactaaccgtaagaacgggtagatggtttatccatcagttcgtagctaacaagggtcgttgcaatttgcaaaaaaataatatcctataatagtaaaaaatagtgataattaatagtattacgtacgactgtgatagttcaatacgatggacaggaagttagattgggacatggaagcagatcatgcatgaccgtctcaatcgcgcgcaacaataatctactctcttcgtccttaaaaaaaaactaaagtaatctagtcatgagttataatatttgactaatttgtcatatcatgggcaagataaagctactagcagatgggattgtacgtgattaaaggcacagaaaaatgcttcatgaggtggtagtgctgagctttagcaagcttgcgtgcaacgctctctcctttgctcgacgagcaccagatgaccccggcaagagaattgcatagcacctggtaatcccaccaactctatcgtcctcccactagtgaatatttcctccatttttctttcagtgtgggttggatcaaatcatattctctacactttcttggattaatttccgcgtaatttccaattaaaaaaactgcagcactctcagctagccagcttgatgaacactactagttgttcctacaattttcatgcaaatcatgtagtaaatacagctctataagagacaaataataccaccggcagacagtagatccaacgcatctagacggtttttcgcagcatcaaagatttgcttccaggtttcctagtgcctctcgagtaagcgcactatatggacacttggacagtgatgcagagcgtggctaaaaggagatggtatgattcttatatttctgctttttgttgtgcaacacattaatttggtctttccatctaaatcgcgtcgatgtaacagactttttattttccacaaagatgaactttcgctacccaaggttccgaccaatttctatggccacagtatttaaaagttttcgcttggtattttatatacatataaggagcatatgtaaaagtgagagagtttgctatctatggaaaacagtagttaaatttactagcatttgcaagttgcaatcatgcatggaaggatggaattgcacattccatatatatgagtaaatttcacagaactacatgtactttaaatcaaattatcgtaaaactatatatttaaggtaatgtgtcacacaactataaatttaagaccaagtataaaaaaactacaaatttaataacaaaattatcacaaaactatagggtatgtagtttacatccttacctctaatattatgtttgagttataattgttcaaattttgtgattaaattggtgtaaaatctgtagttttgtgataactttgttactaaatatgtagttttgcgatattctaccttaaatatgtagttttatgataaatttagtgttaaatttatagttttgtgatatatgttaaatctgtagttttgtgatagtttggctaaaatccatatagttttatgaaatttactccatatatattgaatatattattgaatgttggctcctatcgtgcttttctcttctgagggactcttgtaatgtatatatgtctagattttggagtaagataagtttaaataactctttctttttcgccttgatcaagacattgcatcaattttgtaaaaaagaaaggatataaggaatataattacatccccacgctatatagctataggacacatataaccataatgtttgaataaggtgaatgaagcaaatacattaatgctttccatgaaacacacaaaaaaaaccatgtattttttatcacaataattgaacaatttctgcactatttctttagaaaatcatgcgatccaactagggcctacacgcacatttgcaaacggtgacatctattgccatgtttattctaaacaaataactcttgtttatcaagaatctatgtaacaccaatatttttttaaggcaacaaaccaaacatccacactttaacgaaatataacggattataatgtatcccccctaaccacctctcatttaatttttactcaatattacccctaaaggcccttccactcctcacataccccttctctaataagtggcattatagttttttccctttaaccttaatctctcttagatgagtacaacatagtatttattaattctaaatttcaaaaatattaaataaaaaatataagtaaggcttcaagttgaataaaactctatatctattattataattctagaagttatttaaaaactaaatttagagtgcataattagtcgacatggtattgttaattaattactaattactatagtaaaacgctggataccacgaagggacatggtagcgatcaagagaggaatgagcgctctaggagtcgaacatgagacgtgcccgcgctccacagcagccccttttgccacctgcactagcacgcagtctcacttcctaaagtatcaactatcaagtaaatacattggaacattaaaataataattgataaaggtactaggatgattctatatacaatttagaattagactacatttgagttttgtatctataaatgcaattatattgtttattatatattaaatggtatttaaatataatccccaataaataagataactgattaacaactaatattgttgttaacgcgaaaaacacgcaatggcctaagagatatgcttaactctagtgcaggtccaaagaaattgccttcaggttctcagcgtgctagctggtttgattgtgcaaccaacaagaaagaaaaaggaaaaagttaaatccaccaacgatagcagatcggctggattgccgatgacgtatcttccggagccatgccgatgtgacttgcatcggaccagcaagggaagataaaacgtagagattattagatctacttgattggctgtagatgtcaatgatacatagcctatccaacgaaacacacttagatcgggtgattgggatagatcggatgttatgccgagacagtataaatcactcaatatctaactgtacctcaaagcagaggttacgtaggttcatagcatagttgatggggcaaacctaacgtgtatcggctagtactccgataccgctttatactaagatatcagcgcagataaaatatacaaaacaaagatcaatatggcaagcagggtgcattaacaaattgatatatagaaagcctaatatgctttaagcgaatgagatcttcatataaagggcagatttagacgatcaagaaccgggtagggaaacaaaacggctaaatcaggtaagatcggctgaaaccccgatactatctctattagtaatcaaagaaagagctagataagacgtctcaagatagcacttaacagatcgaacctaaccgatgcaacattaagcgtgaaaagaaacataagatctaagcaaatcaatgagaactcattcaagatggtagatatactgcacaatctagcttggtgtcgatatctaaatttatcggccgttttcgatgatagaggctagccgatgaagttagatgacgaaatctatctagattatacagcatatatgataactcggtgaatcacataaacaggattagagtgtcataaagatgtaagcactaatccagagaacacaaaccgccatagcaagctttacctctttgtcggagatcgaacccgatgtagcccaactcgaaagcaaaaactcgtcgaaacaatgagaatagaaaagggtggcgatgcgccgaagtattattgaactgtcgttctgtgattacaaggtgtcaggtcatatttatacccgaagtcagggccggcccttgccctatgcagccaaggcgaccgccgggggtgggggggcaacacctaatactagtaatctagtaccttatccgatgttgagatcaatgatttttattcagaattaaaggtattgcaagtgagttttctaaattcttcgatatgatgtccgcgcctgagattctgaaatttgttatgaatgcatatttctatccaaatgtttcagatgcctattgaattctcttaaccgtacctgtgacggtagcttcagctgagaagtttttcaaaattgaagttgttgaagaactatttgagatcaactatgtcacaagaaaggtcaaatggcttggctatgtgctcaattgagaaggatatatcggacactattgatcttaattccgttctggatgattttgcatcaagaaatgcctgaagaagtatctttacataggaagcagtggatacgatggggttctattcttcattaagttaatgaataatgatattagttccaagtttcaaatatattgttattttggtcgactttatttcttaataattaccaggcatgttaaatttaatatatggatgtattacaagaatatgcggatgggccaaaaaaataaatagtttgggccagaaggaaaagaaacagatgtgagaaaaaggaataagttcatctaaggtcccttaactttcaacgaatccgattttcgtccttcaaccacaaaaccagatacaacgggtccctcaactatcaaaaccggtgcagattagatccctcggcggttttgaaggcggttttggctgacatagcacctatgtggctagtttgacttggtcttgatctgacgtggcattgacgtggcgcttacgtggcaattcgatccggaaaaataataaagcccgtgggacccacatgtcagtttcacatagaaattaataaaaaatggtggggcccacgtgggccccacatgtcatcctcacccctcttcttcctcctctctcccaatctcccctctttcctcactgaccggtggagcggggcgatggacggggtggagcggggaggccggcggagcggagcaggttcgcgggcctcactgaccagtggagcgggccgatggacggggcggagcggagcaggttcgcgggcagagcggcggcggcggcatgtcaccctcactcccctcttcttccacctctcaacctttttgtcggtggggagccgacgcggtgactgggcatcggcggcgcgccggaacacaaggcaacgacggcgtggaggagggtggtgccgttggcgcggcaagggaggtgctggtgacgatgggggcggtgggagaggaggagagcgtcggcaacgcgggaaagggcgacgaacggcgcggcaagggaggagttgagcgggcgggtggcgggagagcgagagagggcgacgggcggcaagggaggagctgagcggcggcgcgcagcgggagagaagctgggcggctaccgccgccgccgaggagggcgtcgcaacgggcggcagagagatgggcggctgccggctgccgtcagggagaaggtgcagttccccgcttcttaccattgccgctccggctaccaccgctccgcgtgccccgctctgctccgcccgcggcccgccgccgccgtgctccgctccagccgccccactccaccggcccgctccggctgccgccgctccgcctgccccgctccgctccgcccgcggacctgctccgctccggccgccccgtccttcgcccgctctagtcgtcgccgccccgctccaccggtcagtgaggaaagagaggggagatggggagagaggaggaagaggggtaaggatgacatgtggggcccacgtggggccacgtaagcgccacgtcaataccacgtcagatcaagaccaagtcaaactagccacgtaggtgccacgtcagccaaaaccgccttcaaaaccaccgagggacctaatctgcaccggttttaatagttgagggacccgttgtatctagttttgcggttgaaggacgaaaatcggattcgttgacaagttaagggaccttagatgaacttattccgtgagaaaaatatttgggccaggagacaagaacatccggatgggccaaaaatacagtttgggccagaagaaaagaaacggatgtcaaaaatattaaaaacaaattggcttcgcccggactcgaaccggagaccttcagtgtgttagactgacgtgataaccaactacaccacgaaaccgatgttgtacttcgttgaaaaatttgtttttaatattattttagtacccctaactttagttgctttcagaaataagttctaaatacaaaaggtgctaatactcataattgaattctttcacccgaaattcctatatgctatgcttgacgatcccaaccggaataacgtacacagttttgtccataggataaccatactcctcaagtcccatttgctaaattcagaggtataaaaacagaggggcttgtactagtagtagtagcttgtaacacgacagccaaattacaccagcaactagtacgagtacagcaacaaaagtagtaggagtagtactacatgcataatctcatcggctgcatgcgtccatccgggttcagagctgcgtttggaagatggtgacgtggcgcaggcgctgcgccatgtcggccaccgagcccaccgccgcgagcagcgacacgacgagcgcgccgacgttgagcgcctgcagcgccacccacttccggctgcctctctgcaccttcgcctgcgccatgtacatggtcaccgggaagtacaccgtgagcggccagaacgcgacggcgccgagcagcccgagcacggcgttgaagaacggcagcaccagcgacaccaccgtcgtcacggccacgaacgccgtgcgcagcaccagcttgcacagcgtgaaccgcaccgcgcgcccgccgcccagcggcaccgcgtactcccggtggaagaacgccgactccggccaacggctcgccagccacttctcgtagcacgcgaacaccggctgcgcgtacacctggtacgctccgaccaggtggatgacgacggcaacgttggcgatgtcgacgagccagaacggctcgaggaagccggtgaggacgttcccgggcgcggcgttgccgaacgccgcgtacccgacgcacccgatcgacacgtagaagacggtcgtgacgccgatgccgtacaggctcgccctcttcatcgtcacgttctccgacggcggcgacttcaccgtgtcctggatctcgatgagcagcatggagtaggtgtacgcgaaggcgatgttcccgagcgcctgcaggaagtgccacgccttggtcgacgcggtgacgcctccggcgccgaccctgacgccgaggagggtgccgtgcgccgcgccgtgcgacgcgaccttagcggcgctgaggaagagcccgacgaaggagtaggtgaacgacatgacggcggcgacgacggagatgagcgtcaccccctccaggctcgggcactgggacaggacgacctccgcgaggccgaacagcaccatgtacatcgtcccggacgagccgcaggtcgcgtccggcccccttgtagtggtggcagttcgtgcgcaccactgacctgcattctcacggcccaaatcctagtacatgttactgaacaaaaatttgccaagatttttcagggtggccaagaagctggagctaagcttacatgatgctcgtagcggtcgtgatggtgtaacccaccattgcgccccagagaatcgcgtactgcgcaatgccacacacgaccacgtctcgaggcccttcacacgatcgatcaaagcaacagtcttgtcagaaatcgcagagattttgcaggagaaaatgcaggtaagtctcaaaggttcttagctaccgaggcatgagcggacgacgtccatgtaggtgtagttccgcttgccgtggacggggtccggcgtgcggtagcagtcgcagaggaggacggcggtgtagtaggtgatgtaggcgcagacgacgagggcgatggggccgagcacccaccccatctgggccacgctccacggcagcgccagcacgcctgacccgatcacggcggtgatggcgtgcgtcgtcgccgtccataccgttcctgtgaaaaggaaacaaaattcagtttcgtcagtgccattcttgcgttcttgtgagaaaaaaaaaatcctgtgagaatgtctgacaggtcactgtcatttacattacgtgtgacattcttgccttcttggtctcttggaacacctggctgattaagcatgaacatcaataaagatgcagtgcattgaagagattgccatatcagcgcggctaaaaagagatcgccagatcatagatcaattacagtgggcatgatgcaacattgcacaagtcaacttcccagtagtgtaagaagccatcattttttcaaaaggatctccaggattccatcatgtgtcataaacaaagaatccgtttgatctactgcccatgcgctggataccataacgtaaagcagaccaactaacgagtacaaatagagcaacaggttcatatattacgcatgtgatttaatcaccatgtcctaaagcagtaacacttaaaacaactaaagaaatatttgctgtcttacttgtgttaaactaacgaatcatcgcaaatgtataaacagactcttttgaacaacgtaagcacgcacatgaatgaaaacacttatgtaatgctctggtggcctatgtggagtatgatgtggtatcccaaccaacatcaacatgcaaaggaagtatgatgtgaaatcaggcacttgctccctgatgtaaagtactagcagggctaaagtacagtcaaacttttgtccagtaaaattccttaattacaatagacaattgccccgaaatcctattatttgacatgagtgtacttatacttaactggtcattgtcaagactgcttaatggcccgctcttcatcacagcctatgatagctagtcacaactcacaacagtacacccaagataaccagaaaaaggaagtagtagtacaacagaatatgcactatgttttactttaataccatgaaagctatttgtcgaattaggatgcgtgatgtaagtggagagagcacaagctgcaggttaatttgcagccattcatcgatacctaatccattgctccctcacgcgaagaagaaacgttccaataggctattgccaacaaatagtgttttccattgtttctgggattccaatataacattaggataatgattgcacatattgaaattctgcctataatcctggagtattagtactgctgtaccgtataacactagtaaagccaaggccacttggacttggtagggtatatagtagagtagaggtagtgcctgccaagtcattggcgatttggatcttgcaagaggttgcgtgctgtaactatatgggaattaggacccagttcctgcataaatactatgccactaacactgttactatccttcacgttgtcctagtaaaagcagtggtaacagaagcttcacgcaatggatttcgcattttcaggtgttggttttatccaataatgctagcatatacgcaagatgcctctattaaatctatcccgagtttcagggatgttgctgcaatgctgtgacgagtgttgtgtgtaaaacagaagaaagaatatgtgcgtattcgggagtgtagcatctcattagctagacatgcatccaagaaacaagacatgtaaaaggggacaactcttttacatggcatttctttaagataaaacactaaaataggcattgaattcattatatggcagtgtttaataagagaagtgtaaattccctgcctctgcatttgcagtgtgtatttgtttggttcttccagtacggcgcggcgtaaacaaaatggaaaagaagggtttgactttcagtgcccatgcatgcgtgtatgctccatcagacggcttggacagcaaaatcatgcattgactaattccaaatcttttttttttttgcatgtacttggagaagcaaaacgagagagtcctacaaggtttcgaaaggatgcaagacaaccgcatgttccatagcgcgctgaagtctgaaagcgtctttccactgggcacacatctggctagctctcacttgaaagagaggcacaagtcaataaccaccctccaacgtacgccagcaatgcacgtttctgtccaaattcagcaatgacagaggctcgcagatctaccacactcaacggtatgtggtgacaatgaacatgcagctaaactacgatgaacaacggaacagagtttcagaggaaacagcagctaaatactctgcatgaagcatgaactgttcaggtgccttcctagcagaagaaagacaggcagggtagccgtaggatagtagtaggattttcggcgacgacgacgactgtgcaaacgcgaactggaaacagagaggatcctgagaattacctgttctgacgcggccatcgtcgtcgacggccacctccttcctctccaccttctccacgtccatactctctctgtgtacgagtttccctctctctcagtctccggcctctcttatctgagcggaaaggattttgagcgaattctgaagcctgtgcgctgcagctatatatagagctggcgagcttttgcacctgacctgtttcccactgtagattcattcttttaatacggtcacgaaaccccacgaatcctactagtacctcagagtcccctgtagaaaatgaaggttttccacgtcatttttttagtagcaataactaccaccagattatatgcctgttacatttagttgaacctaccaaggtgttcacaaaggtgcagaagttctggtgacttttatgaatctgattagtcaatttgggatgaatctggttggtacttgcctactacattcattccataataattatattcttaagattttatttttcctaaaataattaccacgatagagtattaatatcatcaatcacttattcaattttcccatattctattttcaaccattctctcgtttttatatgtacaccatttaatgaagcgagcattataatctttcttttcaaatcttaatacgtagtacctgctaataaattataattataattattttgggacggaggtagtactttgtaaccacatgattgaaaaatctgaactaataccttctgcagttgagttagtgagcatgttatccgtctgattttggtaatttctaaatatccctgaagagaagacagtgatgctgatgatcattcaggtggtagaaaatgaagtgctggacatatctcagcctctcaggggctcagggcttgacccaaaaggaaagccatcttctgcttcatcatgcggccgccacgaagcacacattgctacaaagctgcatgaatcatgagattgctgctcttctcctctcatctatcatcgtgagatcatcgtccatctcttgacgccaccaaaagaatttcaggttcagaaacaacaaattgtttcttgcgattcactggaaaatcaaacacggctcgtaattcacggccggaaaccatcaaagtttgctgcgtggttccaaaaccatcaacattatgtacaccctgtaatctgcctatatatggattatatttatggatatgtgctgtgtgcaactgtgcaacagcgtgtctttgctagctcgtgccaacgcagccaaacagcctcacgtgtcgtcatatccctacacacagtagattcagggctggtttggtttgaggcctaaattaggcctaccaatatttgacaatttcaatagtgattagtgtctatttggtttgaagccaaattttggcatgccaaaaaaataggccatttcaatagtgaacttaggctattttggcttcaatccaaacgcaactttgccttactaaaattagtcatgccaaaacttaccaaaatttggtactgacaaaatttgataaggcctatttaggccacaaaccaaaccaaccctcagtgacgaagctgaacacctaaagctgggctgtatgggccagtttgggtccaaataagaacaccaattaacgccataaggctgtgccacggcccaggcccaggcccaggcccaacccaatcttacaaaaaaaaaaacaagtaaacaaccccaagccacggctccgagaaatacaaacacgaacacggcacacacgtctacgtgagcccacggggattattgttcgagtcaaatatgttacaagcaaacacgtggttgcatgcggcgagccggcgtgcatcgcgtcgaccggttttcagttcttggcggtggtgaagcggtacgaggcgtaggagagcgaggcgttgctccagctgcggtggatcagctccgccttggccccctcaccggcggcgccgagcgcgacgtgcagcgggaggaagtggtcaggcgacgggtgcgccaccctgccgtgcggcgccttctcctcgtaccgcttcacgtcgtcgtgcctcccgccgagcagcgcctcctgcagccacccgtcgaactccgccgcccactgcggcaccggcgtgccctcgggccccatcctgcggaggttgtgtgtcgcgctgccggagccgaggacgaggacgccgtcgtcgcggagcggcgccagcgccctgccgagctcgtagtggtacgcgccgtcgcggccgctctgcagggagagctggcacaccggcacgttcgcctccgggtacatgaacatcagtggcacccacgcaccgtggtcaagcccgcggctgtggttttccttcaccggcccgaacccggcttgctccagaagctccttggtcttcatcgccagatcaggagcgcccggcgcagggtacttcagctgtttgcaacaacattattcggtatggtcagatactgatgcgatcatgcaaatgcaacgtcattattcagaagggtagatactgatgcaatgaaattattcagtactatggtcagagatactgatgtagtgattacgttatacgcatataccttttgcttccaggaaatataacgttttccatgcatgatgcatccttttgagcggaatggatttaagttatagtatgatttagtaattgtttggttgcatataagaaaagagtacaaaatctttctattgaaaagttatcatacgccaacaatgaatctaccttcaaccacacgactacaggagcatatatgatggataaatagtactccattcgtcttaaaatataataacttctagcacttaagatttgtcccaaaatataaaaacttcttcactaacattcttttctcaatcaatcacaattcttcaccattcaattttcctacatacctgcacttctctctcccatttaattctgactactttcttaatacttgtgtccaacactaaaaattcttatattctgggacggaggaagtagcacatacttataataatgcatatatagtacctaactaaatacttatgagtagcaactttccttcgacgaaaaggaccaataagctactagatgagtaatcaaatccttatggtgatgcatatatactacctaactaaatattttgtacggcagctttgatgggtgtggtttctccgataacaggttcacccaaattaccagagtacacacccatttttattcgactggcttaaaaacaattgcgtaaatatttactcttggccatcataacctttactagtaatatccacaactatcttatggtgtatatgctagtccttccgtcccaaaatataagctattttggtgaatgtgacacatactagtattatgagataaaatcccttatattttacaacggagggagtaactcaaatgctgaacagagtaatgaaaatgaaactaaatttaattagccatttagacatagctcacagcaaaatccttgctgactgatcgactgaacgatccggcagatgctagtgacaagcgcactttacccacttgtagtagtttggtatgcccattgcccacaaatattccctaattttgctcacagcctcaaacaaaatacacaatgtcatgtctgcatcagatgggatgctggggttggtaaaagttcagatcagctaaacttttgggcatctcttcctactcccatgtttaagtggtaggacctactcccatgtttaataagcatatctaagatgcaatgggacatgtacttcacaaactagcatgaaagatctagtataatactagcatgttttagtctttgattgcgctccaatcagtcccacgtgatataaaatatacaacacgagatacctaaatactccatgcataataatatatagtagtataacatatatggagaagtaatcttcacctttgaccagtttcccctacatcaggcgcggggttatcacaccccagcggtaagtgaggttaccgtgcgatatttgtgacaaaccatacaaaatttatcgaaatttcatttattattttaatttataagaatttgttggggttattgcagtattaccattaccatatccggaggtaaatgcaataaccgtgcaattacggccgattttgtaaacctgcctaaggctatgagcatgcggagaaatggtatcatgctgccatggtgttgcctacgagtaaattcagaccagttgccaaaccaggtttcagcaaccatgtagtgtggttttccgataaccaaggcagaaagatcgatttcttcccatatattctgcgcgatttggaatcaaaaccatccaaatttgacgtcttccctatagcatgtaggaaatccgaatacccaatccttgaggctgtgttcccaacatcttcaacctcgttttccgcgcgctcatttccgaaagtgtaaaatgcccaaagtagaagatgctcgaacaaagaaacgaacgaccaaggtccaattttggcggaatcgctccacgttgtacggccatttctcaatcaagaaacaagggattcgattcgagggaaggagacggacggacggacggaccttgtacatagccttggggaagccgtagaagtcgtggatggtgtcgttgttgccgcggatgacgttgaccgtcggcgcggccgcctcccagtggcccgacacgacgaggatcgcccgcggcaactccgcgcccgccaccgccgccggcagccacgacttgaagaatccctgcgccgcgatggtgtcgtcgatggacagcgtgggcgcgccgtgcgacaggaagaaggtgtccatggcgccctccgccgcgcgcctcgtcgtcgtcctcctcctccccctcctctcggcttcgagggcgctcccctgctgctcgtcttcccccggcgtcggcgtcggcgtggtcgtcgcgcgcgcgtgcaccgcggccgccgggctgggctgcttgctttgcctctgacccatcctcttctcctccttatacggggccggcggccgcgcgcgcggtgcggaggatgactgtttattttgcggtgtttggtaagtttagttggtcgacgactcgacggtctggaccgcggactcggcccctcatttggactttgggatgtcgctgccggcgcgcgcacgggcgtgtaagcagtgacgtaagaaagcgtacttcgctggaggcgcgtgacaagtggagaagcggatttctggaatcggccatggtctggatgttgttggtcatgtgaatctgtgagactgtgatcctaccaacttctctctccttttttaaggaagggtctcatgactctcatcgaatggatgtttggattgatgcttttcagccaaaacccatcgaattgcttattaggctgataaccaccagccacaaaaaatccttatcaagttaaataagccaaataagccaatcaatggtttttctttagcttaaggggaaaaagctaactttggctgatcagctaaagctcttggcttactgatgagggccgaaaatatgattggctgttatatcttgttatacttgtgtctcgcccatcctaggggtaactgttgcactgcgaatgatactacataccgtgttgttactgtatacttgtacaatagtacttcttttttaacgattacactatatatacatacgtgcgcacatattactacacatgcaacaccacatttgcactttcacgaacattttcttaaataaagaaccaactgtttatatctgattttattgaatttttgttgaaggtccaattgcacctactaatctagcttggatggcatgatatatgttactattggctacagtgtttgagaccttgcattgcttgtgtgttggcttcactgtcagctcgtccaatgtaccgcagattattatataggagtagctacttcaatgccaaacaaaggcaaaaaggtaggattgccttgtttcattgctagagaaggtaaaacatcaaccacccaaagaaaagtaaacatcagaacgccagcccaacagacagcaccttatgaacacccaaaacttaacaaaaacagactacagagtaccttaaacaccggacaccaaagcatacagcgaactattgacattcagaaattcgacaaccatttctataaattaccatcgacaaacatgtttttttcctacaaaatatcattgtacaagtgtttttgtaaattcccgttaggttttcatttatagacctccgttaagtcttctaaaaggtctattttactctacgatccatagaacactatgtgaggggaaattattttatttgatctcttgaggggatgtcccctcgttgtttgcatgtcactgaaatgattatgaaaaaaattgggatgatgtattaacatgtga

SEQ ID NO: 61228 - DNA, 31591 bp, Oryza sativa
  unsure (1)..(31591): unsure at all n locations
gtctttttcgttacaagatgtagaggttgaatttgaacttgcatgtttgtggagtgatatatcacatgttaatacatcatcccaaattttttaaaattttttcataaccatttaagtgacatgtaaacaaaaagaggggacatcccctcgagaaatcaaaattcacttccactatgtgagcacttactggattagaactcttgaggggagataacataccatccaaatgattatgaaaataaataacaagacagattaatatgtgatagatcactccacagacatataagttaaaatttagcttctacaagttaaaaaataaataaactatgattagttaacttatattcatagtcaactttatttttttttattgcagctattagaagttgaatttaacattacatatttttggagtgatctatcacatgttattttttttatttttttaataaccaattggatgataggcaaataacgaggaaataccctagaatagttctcctcgcagtcttttgcacccatagttaaataacaacatattgcctaattagctgtcaattttttttgactgaattagctgtcaaatttgcacacgcaaatacggttcagtgatgaagctgaacgccctgttgcttcctaccttgctcggtaggatgggccagttcgggtccaaataaacatagcagttatcatagtgatatcaacgccatgagaggctgggccacaacccaaaccaccatgcatgcaagtttattgcaactgaaaaccacaagacacggccgttaggaaatacaggcacgaacgtacgtctacgttaataggagtatattaacgtagatcccacggagattattaattgttaagagtaaaatggcgatgatataagcaagacatgtttcactctttgcatgcggcaatcggtttgttcttggtggtggtggtgaagcggtacgacgcgtgggagagcgtcgcgttgtaccagctatggtggatcagctccgccttggcatcctccccggcggcgccgagcgcgacgtgcagcgggaggaagtggtccggcgacgggtgcgccatcttaccgttcggcgccttctcctcgtactgcttcacgtcgtcgtgcctcccgcccgcgaggagcgcctcctgcagccacccgtcgaactccgccgcccactggggcaccggcgtgccctcggcgacgggcgccatgcagctaaggttgtgcgtggcgttgccggagccgaggatgaggacgccgtcgtcccggagaggcgccagcgctctgccgagatcgtagtggtacgcgccgtcgcggccggtctgcagggagagctggcacaccggcacgttcgcctccgggtacatgaacatcagtggcacccacgcgccgtggtcaagcccgcggccgtggtcctccttcaccggcccaaatccggcttgctccaagagctctttggccttcttcgccacatcaggggcgcccggcgccgggtattccagctgcatgggatgccatgcatgcattattcagttttttttttaaatttttgaaaggagggaacaagctttgcctcgtgatcagatcacaaggcaacaaacatgatgcatgcatggtagggaaggacgaaacgcgaacagttggacctggaacatggacttggggaagccatagccctcgaagtcgtggatggtgtcattgttgccgcggacgacgttgacggtcggcgtggccgtctcccagtggcccgacacgatgaggatggcacgcggaggctgcgcgcccgccaccgccgccggtagccacgacctgaagaagtgctgcgccggcatcgtgtcgtcgatggagagcgtgggcgtgccgtgcgataggaagaaggtgtccatggcccccgcgccccgtagtcccgtacgttgtgtactcctcgtcctctcggtttcggaggccactccctgctagctgcttatcttatctcgccggccgcgtcggtgtcggtgtggtcgcgtcggcgcgcgcgtcgcgtgtgctgccggccgggttgggcttggctttggctctgcccccatatccttctatttatatacgcgccgcgcgcgcatgggcgcgtggtgcgttgcaacgtcgccggcagccgatgaggcgtgcgttggttgcagatgattgggagtgcgttagttgcagatgattgggtcagccgatgaggcaccatcgtacgtactgtacgtttcacagttgtgcagtagtagttggtcgatatgacttccgatctactactccagtctactagaccgcacacctcacctcaagttgccggcagcaaaagctgcgcttgaacagccagcagctctcgcgttctaaatggatgttaagctttggatatagatagaatatgcatgatggagcaaaattctcacatggttgaattaaattaaatattataaattgctaacaaatagtatagaaaaagtggtctaagcattcaagtagatgtttaaagtggggcctcattcattcgctcaagatcataacatgagctacttcaatgccaaacttaaatgtacgtataatgctagctcaacaacctcactagtagaaaaaaggtcttcccttactgtcaaaatatgcctttcccggtggctagactaaccgctagcgtcgaaaggctagtgaaaatctaaggttttcacaagcaaaactttaacagctagcgataatcgttttcgcttgcggtagtgttataccggccgccagcgataatcgaattccgttagtggcagagataatcgattttggggaaagaaaaagaaaaaacccatgcagctgccctctaaccgccagcgaaaataaatatgcccacatgttgctaccctgcattaaaaaatccatagcgccaaatctcaaatcccaaatccacaacaagcacaacttccaaaaaataccatcacagatcctaaatccacaaattcacacaaaaatttcacatcacaacacaaattccacatcacagatcgagcacaaaaattttacatcacaaagattaagaggtgaggcatcacagatcgagcacaaaaatattacatcacaaagattaagaggtgaggatggattcgttgctcccaagggagggcgtggatggccggcagcggatccgctcgccggcgccggctctgctccccaccgcccctcccacgcgccggtgccgccgagcgccgccactggcccctccccccgtgcctctcccgaggacaggcggcggcggatccactctcccgaggctcgccggcgccagatccgcatctcgttgtcgagaaccaccgccgcttccttccccgcgccactgccgcacctccttccttgcgccgccgcccccttccccactcagcaatggagagtgaagggaggctggcggcggtggagaaagaagggaggctggcggcaatggagagagaagggaggagggatagaggagggaggcagagggaccgtgcgctaccgcgcacttgccttccgtcaccgtcgccgccgcgcgctgccgcttgagaaccgacgtgcgctcgcgttttgtcaccgtcgccgccacaagccgctgctggagccaccgcgcgccgtcgcccgagaaccgtcgtcggagctgccgccgccgcctgtggggagtgagtaggagggtgcatctggagggaggaagaggaacaagaggataaggactaggtggataaggagtggtgggtggtgattttttaatgggcggtgatatttttaagtgtgtgatttttttaagtgcggcgtttaaacgctggcggtaggttaagaagcaatagggttattttttgaaatggacttcttaaccaacctcaagcgaaaacggattttcacttgtggtcctagactcaccgtcggcgaaaatgaattttcactaacggttctaaaccctctattcctcgttagaatttcacaagcggatttcttatatgaccgctagctaaaaaaatagagtaccgtcataaaaaatcgtttcttaagctatggggttgggaacccatctcatctacacgaaaaacagagcggtccgttagtacgttattaattaaatattagctatttttaaaaatagattaattttatttttaagcaacttttgttttttttttaaaaacacaccgtttagcggtacatggttaggaaaagcgagagtacatggttaggaaaagcctcgaacgaacacagtcacctcacgctcacagtgacactgacacaagtgcatagccgtatacacgacgacatcatgcggaagtccaagcagagcaacaccgtccccaggcagagcaatcttagtatacctcgtacgcagccatagggaattcgtttttggtcacgaggctttacagtttacagaggaaatgaagtttatctagatgcataattttgactaattgacttggacggagaccccgctgttgaaggtcaagaacgtgcacagtatctcgatccctcaaattcccgtgcgacacgtctgctgcttccatcgcttgctagttacatagtccatcctggttcagctatataacttgatcaatttagagatagtgagcaccaagaatcaatcaatcgagcagaaatttgatctgtacatctccagtcaccatggctgccgccggcagcagcaaaaccgcgagcttgttgctatgcctggcgatgatctccttcgtgcagctggcacagtcctcaccgagcggcgacaaaggcatcaaagggtttcacggcaagaagctcagcttcaccctgtaccagcaggagaccatcaacaagaccagctacatggtcgtcgccggcgtcgccggcgccggcgtcagcgagaccaccacgcccttcggcaccgtctacgtcttccgcgacgacctgacggtgcgccccgagaggtcgtcccgggtggccggcgtggtggaggggacctccgtgacgaccagcttcgacgggctgaggagcctgtcgctgggcaagatcacgctcgaccaccgcggccgccggggatccatgtccgtcctcgggggcacgcacaacacccggccgtccgactgcccggtggtcggcggcacaggtgacttcgcgtacgccgtcggctacgtccggacgtcgccggtgaacctgcggggatcgtcggtcacgttcaaggtggagtttcacctgtactggccaccgtatgctcattacgctccaacttcaaagcactagacaagtcgctgtcttccaccttgatgagcgcgtctgcgtgtgtactcgtttctggcagtccgatattatatcatgcatctgcctattttttttcagtctctcgctgagtagttaatatagagtttgaattacctctgggaggtatttccgtatttggtgtaataaaattcaagattgataatctgaggaattttcatgaaaaaattaaactactacggatgatgcgcttatcggacgcttgttgttcggtgatagtactacttaaaaaagatcctcggatagtcagactttgcagtatacaattatgccaatgagatatgaatcttgagccaattatatcactaacatatgggtattgggttctactttcgtacggttcacatgtcagaaagtcaggaaagcctcatccatactactttcccaattcaatgtttaagttggagatggagaggttgtggattgggatcacatgcagtggctatagccactgcaacttatgcagtcctaaggacatcattggaatataaattaacgtcctagatctttccttgatactgttcacaaatgaccgtacaaagttagtttctgtagcatgtactgtagcaattactgtttaaaacaactgtagcatttatttcagccgttgattgccttgatccaatgatgaaaaatggttccaactgctaaacttgcagtctgtcctatgactgcaccggatctggattcaactctagtcgggcatgcacaactgaaaccgacaacaaactttgttccatttctcaaaccaaacggaaaagttattagcaatgattaattaagtattgattattacaaattttaaaaattgatatatttgattttctaaaacttatatatagaaagttttacatcaaatacactatttagtcgttcggaaaatatatttaaaaaaaccaaagagtagctagctaaaaaaactcagccttggttttttttaactatcatggcacacacctttaaaattgtcgaatggtgtattttgtagaaaaactttttatatataagtttttcaaaaattcaatacattcatttttaaaatttataatagttaatagtacttaattaatcattaatctttcattccattttacgtgtggccgttaatccaggtcaaaaagctagcgaacactgaaagctcccgtgcgccagaaacacccgagaatagacaaccgcacagtaacatacacacggcagcttcatcggttttccatgggcactttcggtgtttcacgattttgcgcacgggttggcccaacccaaaccataccgtgtgcgattttgctatagatttgtcgtgtgattttttctctcggatttgtccttttttaggctgttcgataagtgccaagattcgtgcacatatagcgatgggaatccgcataggattcagtcggacgggttagagcgctaatttctttttttgcgctttaaaaaattgatatgcacgctgttctctctcgttctctctcaattgaaactaaaataaaaataaaatacaaaattacagtcatatataactaaaattatatttgtaaattcagttgatatgacatgtaggtgcattgtaattttgataaaagtaattatgtaactaaatatgtatttttattttcttttgtagtccgttggatgtaaatttaagggtagaaaaaatctgggtgattttttcttagaaatcacctgacaaataaatagacaatccctaccgtgtgtgcttaaacacacgagaaccttcccgtgcggatctagactcccggtaacattctatgtaacggactctttcagacggcacggtggcttaccgtgtgttcgaacagcaataatcaatcaagcagccatctccatggaaagctagtgagcagcaataatcaatcaaaaggattatttagcagttagcaccacctaagctcaaattcttcttccgtttttctctttctctcggtttcaataggccaacacgggaagctagtgaacagcaataatcaaccaagcagccatcgccatggcagctaccaacacggccatgagcttggtgctgtgcctgctggtaatgatcatctgctccacgcaccggttgctgcatccccaaccccagcttgcggcgacggcggcgtcgtcgtcgtcgtcgccgttctcgtcacgcagcaagataggcaaggacatcatcgacaagacggtcagcttcaccctgtaccagcaggagaccatgaacaggacggggtacgtcgtcgtccccggcgtcgacgcgcccgcgcccgcgagggtcgtcgtcagcgacgccggcgagccctccgccgacaggcagcccttcggcagcatgtacgtcttccgcgacaacctgacggtgcgcgccgacagctcctcccgtgtcgccggcgtggcggaggggacctccatctcgacgagcttcgactgcgaggacggccggaggagcgtgtcggtggccaagatcacgctccaccaccgcggataccggggctccgtgtccatcctcgggggcacgcccaacatcaccaggccgtccgtgtacccggtggtcggtggcaccggcgacttcctgtacgccgtcggctacgtccggtcgtcgccggtggacacgcgtgggcggactcggacgacgtacaagatggagcttcgcttgtactggccgctgcacgcctatttcgctccaattccgtagtaacacatcgatcaacgttcttccattcgcgtcttattccaactataattccatgcagaagttatttttggagttaatttgatacatgaactaagaaagatttaaatgattttattgccctataaatattattgtacatttcaaatggtgcattgatagatcatttattcatgaggcacaatattgactaagataatgtaaggggaataaaggaggtcatatgtgatgaggtaattaatttgtttccacgtccattactcctggttaatatagtgatactgaaagttgctcaatccattccaaataattgacaccggcactatttaattttaaatttaaccatcttttgcacaaaaaaaaaagaatacatgaaaaatatggtatactagcgaacaatgtgctgtcaaaaatattatcatacaaatttctttcatcataatataattatttaaaagtatttatggttaaagtgaaccgactgtagtcaattatttgaagaacagaggtagcaaattctgagtttaaacatgaatattttggtatttagattttaccataacatttaccacggaaggttaaatggcctcacacctctttgtgcactcttattatatagattctgtttctattttataaatcggcgggatgctctaggatttacttggatggaagttcaaatgtggggcagacacaccaagggtgcgctccacattatatatgttttgtacaaactttatcatttgttgagaaggaggtggtatggactcacaagaagtgtgtgcttttataggtctggtaataggctccaaacattgatcgatgaaggatttgcacatccattcaatctaaggacttaaatctagctaggcgaaacgagatgcacatcttaagttatgcttagctcccccaattattttttacattgaattgtacattcaagcctgtttttctcgcatgtttccgtatttcaaaagtacggtcgagttgttttgtttgcactaaataaaagtactgctcccaacgttcaaatataagaatttctgcgtgtttcccaaattttgaaaatctcacagaaaacacatatattttggaatggacatagtactccgtagtttcaaccgtacacttctctacaaattttcccagtaaaaaaaactcaactagcatcaacggtagcaattaggtcgaaaactgtgatacgataaaaccatgttacatggatacacaataaagatatggctagtattggactagcgacctaaggtacctttttttttctggataatctgtttggatgctcacctcattttgccacaattttgtgctaaaagtatatcaaggtataaattgtgcggctccaaaattaatggtcatatttgtgtcaaactttggctaagaaaagagcctatgatttgtgggaccaaaagataagaaatcattgcatgctaaaattgtagaaaccaaccaaacactagccatattttaccacattttgccatataatagtcaagagtggtaaaatacaacaccaatgaagcatgctctaaacacttgaatgattttgtaattgttatttaagggtccaaacaaatcaattgactattagaagttaaaatagatttaaaataggcttttaaagaaatttatgtaatcaaatttttatgaaaagttaaacatgaagcatgtcatattaatccatgatacccaatgtgatatttgcccattgtagtggggcctgtctgtaaatatcattgtgctttaagctagtttaataaagtatatactttcttcgtctaaacaatatccaattatagagatataaaaaggtgacaatatcatctgaggcttttggtctcagttagtcttgcaaaaaatataaaaaaaatgcttttgaagtttttcacaaagtttacttttatattgttaaaaacacatatataaaaaatttatttataaattattttttatttataaatataccgtttgtgacttaccagaacaaggagagaagagtctgttcatcggtccatcacggccggacaaacctcgccgcttcgcttcgcttcaccctttttcggttcgctctagctcctcatcccgttatgccttccccacctgccgctaccccacgcccccttcctctccaggtctcccccctccccttgtgcgacttgtgtcgaacaccgcagccgccacccgtagacgcgacctcagcaaccccacccacttcctctccgtgggcgcccgccgcgcgtcttgcccccagatccggcgcccaccccaggtaaaagccctcgcccgagctccgttgctcccgatgcgcgcgtgcagggagggatgggatcaggggaatgggattgggggtttggggcgggatggatcagttgaatcggctgcgctagtttggaactcgaacagcttgcagtaggataggtgggttgaatggtcgcaggtgttgcgcttttctgatgcggtttcgtttgctgctgctgctgtgtgaaggtagccggttgttgcttgcacgcgtggatcacttacagaaccatgcggcggtaggaacttgggcaagattccagatggttcgcttgtttggtgagctcttgtagcattgattgtgctccgttcgatttcattttggtgcaatccctagcactctaatttttcttgcttggaataaatggtgtaattattagactttatttcagttattaaacttacaatgatcgatagttatagttcagtacttcggttaccctgtttcactgtgctgttttgacttctgttatagcatgctgaaaactgaacttgccaaacaggcaattgatggggactttccttttttgagccagcaattataaacttataattattgatagcaaagttcagtattccagttactcaatttcatactgttcagaatactggctaaataagtcaattcatgttgttctagtcttgtgaggcttccttttctcctgttccaaactattgtcacggttttcctcccgatgtgcaaacattgctttgttttcacttaaatttatttgactcatcttgtatggttagttacattttaatatggcttaaaaccataacggatcattactgcagctttcttatgaggattaataatgggagaatgaagatgaggaacaaacaacggaaatcatctgctctcaactttgatgcaggatgccgatcttccttgtcttttattgtatggagcttggtgggagttgccctcattgtttgcttcttttctgttgtccgtcaagcagacactaggcagaaccatatttatttcagacatctatctgctaccagagagttagaagagattgaggaggaacatttccgcttgccacctcctcacaaggttaatcctcgtgcagtgaaacggcgggggcctcgcaaggctccaaaggttattgatcaatatctggatgagtcatcagcagtgcatgccttgttcttccctgatgaaagaagtgcagtgaacccaacaaaaggtggaaatgacagtatgtacttctatcctggtagggtgtggctggacactgatggacatgccattcaagcccatgggggtggtattctgtatgatcatatcactgccaaatactactggtatggagaaaacaaagatgggctaacctaccaaactcaccccaagagtacatatcgggttagtataaattctagtataatatcttccttgttttagtgactggttatcttagcaatttgttctgataccaaaaaaaaaaaggtacaacaatggattttgagacaagtctgtggctgattggtccttaagtacgtatgtactgataagtggttgtctttataattttccaggttgacattattggggtaagctgctactcatcaaaggacctatggtcatggactaatgaaggaattgtgcttcctggagaacctactaatttcacccatgaccttcataaatctaaggtgcttgagagacctaaggtgatatataatgatcatactggacaatatgtcatgtggatgcatattgatgatgcaaactacaccaaagcatctgttggtgtagcagtcagcaactctcccactggtcctttcacctacctctatagctttcgcccacatggatttgaaagtagagacatgacaatcttcaaagatgatgatgggtcggcttacctcttctactcttctcgtgacaatactgagcttcatgtcagtccattgacaaaggactatcttaatatcacggtagcaatgaggagaatattaataagacggcatagggaagctccggctgtcttcaagcttcaaggaacctactacatgatcacctctggttgctcgggttgggctcctaatagagcattagcgcatgctgcagaatcgatcatgggcccatgggagacattgggcaacccatgtgttggaggcaacaggtttttccggttgacaacattcttatctcaaagcacatttgtgcttcccctccctggcttgcctggtacattcatcttcatggcagacaggtggaatccttcaaacttgaaagattctcggtatgtttggttacctctgttcattgggggattggcagacgaaccgttggattacagttttggattcccggcatggtcgagggtgtccatttattggcacaggaaatggcgcctacctgaaagttggaagggttatacctgaattttgccctacgcacatgaagtacatacaaaaattacagatgatagatgcaatcatggaacagacatagtttgaagagtttggtgattgttccgaatatttcttgagatatctagtcagtgctttcgtaggcctttttgtaacgcaaaaatagtctgtcaagaaaaattgtataacagtgcagctctcaaaacaaatatttgacttgctgtaacatcctccaaaaagaaagttgaaatagcttgagcgtgtgttcatcccgagattatgctggtaacaactaacaggtagtagtgtttctagttactgtatccgttacatgattgatcccaatgaagcagaactacagttacgcaggcacgcttgaatgtcgaacctgtgatcacacatcttgtttaacatccattttcttcgaaaactcaactgattgaatgcctgaatctgataaactagtctcgctggggattgtttatgttgacaagcagccaacacacatgaactaattcatgaatacttgaagccgatggaaacaatgttccatacttcatagttgcatgtgctactttagtacttaagtcatgtcaaaatattgtcaacctcagaaagaattgacatggaacaacagatcacagcattaacaaaagaacaacaaatgactcggataaattccgttggtgatctaccgcttaagaatctaccagattgggaaaaacaaaaactgcctgttaattgctaaagcaaaattttaagcagtatatgttgagtaccagtgccataatataacatcatttccccaaaatagctagagctgtttcctcttcttggtctttgaccaactagatgcatgtttcttcaatttgtgaagtattgttctctcgctcacccgcagcaccaaagaatgatagagattcctttcgttgacagaagagcatgcttgcagtttttgcctgtcatcttccaaagtgtttgaaccatagaggctctccctcatgtcaacaagggatacaagtgcagaacaaacgctctcattaagcaatagcttcttaacatcaggcaatttttcaagcccgctaatatctggatgttgattggagcttgttactctgacaaccttaagcacactactaatgctgtcgacctcatcatcaccaatcagatcatgagccacgctggccagcttgtcataagcatcagacttcaaggagatgatataaagcaggatcaaaagttcaagctggggctctccatcatatgaaatctcaaagtagtcagcatcttggctggtgcaacctgaatagcccagattatgccagagtgatacccttgctcttgcatatcgacgggagtacttagaagagcaccacttagtaaccagagctaagtcgatgttgacgatgtcatatgagttgtccatctctgtgaagccatatcgatgaagcaaagcagcatttcccatggtaccgtatgtgttaaaaacctacagtggaacaagaggaaacataaagttgcctcaaaacaggaacctaactgatatctaacagtgatacattaagcaatactttggacccaaataaaagatggtaagcacacaattacctcctccccttcattgacatctctcacaacaatcatttccaaatcttcatcgtcatctcctacatagtatgaacaaaacaaccataatgagtgaagctcaaaatcaaccaagtacatgtctaaataaggtctaatgatgttacatgcagatggtcatggatgtaacctgaagggatgtcggcagaattttctatagttgactgttcatcagcagaagcattgtttggatcttcaccatcttcactatctgagtccgaggcttctaacactgaagtgaagtggacatgttccccaccagtcttgtggttaaaactgaaacaaattggatggagggcatttccatattaacgctcagacttaagaccagcacaaatacatcatcacctaagtatgtgcacacctgatgcattgtttccaaataaccaggtaaacgagaaataatctaattacatgagtagattgtaacttacaggtcagccaggggaaccattccagacccatgatagctatctattcggaaggacctcgacgaaagtagactcttagcagagaaataattctccaggctaaaatcatctgggtcaacctcaagttctcctgacaaaatgagtggctcaatacactctttccagtcctcacatatgaactgcctgtcttgcttcactatctgcctagaaattttgccgtttttagagccatcttagtgatcagccaataacgcaatatgaaacatgaaatgtgtgcaacaggaaagtacatcatatgcataattagctcgcattatgctgatttgaaaaggaaaaatggccatagttgtaactccagggagccaaacattgcaagatagatcaatttcactgcctaccatcgaagcatcaaggcagatacaaatcgtggaagcattgcaacttgttactacaatagaagggctcaccttatcgagctcggtgccggccaggaggcgctcggcctcatcggcgggccagacgagcggcacgggctcccgctcggggatcaggcggaggtaggcgtcccacggcgactcggcgccgcgcgcgcgctcatacatgacggcgacggcgagcgcgaggggcccgccgagctccgcggcctcgatggcctcggcggcgccggaggtgcgcggggtcaggcacgcgccccgcgggatggtggccacgaggtccccctcccggagcgcggcgagggcgcgcacgtagacgccgccgccaccgtcctcggcggcgtcgaggcggagcgcgttgctgcagacgacgccgtggtcccgcatccaccgcctgaaggcccgtaggcggctgcgcggtcgcggaagggtcacggatcgtagcgcggcgggggagcgcatacagagaagagcaaagcagaggatcttaccgtgcggtggaggtggaggcggaagcttccatggctggcggcggcggcggcgtcgcgaactcgcgaccaggttttcgttgcggaaatcggtgaggcagcaaccgcgctgcaggcccagcagaggcccaccaaggcctgcaacgcgtgtatgttaacaacccttttctctttttttttttaaacacgtcaatatattagaaggaagcagagttatacttgcacgatgtaatcggccagaggatcattgccacgaaaaataggaaaaacaaaagactgttaagaaaaaacgctactcttatataaagggaaaaataggaaaaaaaaaacaaccctcttcttctaaactatgtaatctcgagaacaacgaaattcgatacaatctcaaaagaaaaaaaaagaaattgaatgagaagaagtagaggaagtttttaaaagtgaaagtgaagaagaacaagcgagagagagagatagagatcgacgaggttgaaccaaagctgccaccgctatgcctcgttaggattggtgtatttgcttaccaaggacttgcttgagaagcttgatcatgggctacatcatgggctgggctaaccaatcaacaggaagcctagtgggttcttaacagtgtagtttcccttttgcctgaacattaaatcgcaggtgagagatcggacgggcaatgatggccataattcaagtttggccgctgatcccaattgatttttgccagcagcgctctgtaatgtgcgtgcacctgctgtaactttctgcctgcaggcggccgcccacgccaaaacacagcacaggttgaggtagtactcgtatttgtttcgctgtctttcgctttgctggttggttcgtactgcaaacttgaactcacaccacaggtggtggctttaactaatgccgtgcatcagttgaacaagcatagagtagttcgcttgctcttcagcttgtcggccgcaattgaaatttaaattttaaatcttaattttaaaattaggtttcgatagtttcatcatatttttttcacgaatacgtaaaaagattgcagtcaatatattagaagaagaatagcagagtttagttatacaacgcaatcggttagaaggccgttgccaatggtcaaagaaaaaagaataaatacagaaaagataagctcatgtaaaaggaaaactacaatcgcaaaggagggtggggtaagggtcccactacactccggcctatcataattttttttcaatcaagacttttaagtcatcaaaaatacagataaaaagttatttacttacaaatatacaattagttgtacgtgaaaatataatcgtaccagcaacaaaagcatcttaatgtagccctttgcatgttctactttcagcagtagccaatgcaagagtactactgcctttagccatctgtgaacaagttttcagatagctaaaaaaaactcagggcccctttgaatcacatgaataaaaaaacggaggaatagaaaaaatatagaattctaacatgaatgtaagtgtaaaacagagaagcaaaacacaggaaaaacgtaggaatgaccgtttgattggaccacaggaaaaactgaggaatttgaggagagataaagactcaaaggatttttccatgaggttctacctcttgttaaaattcctccaaaacttgaaattcatagggttcatttctttgattcaaagggctttgtaggaaaaattcctataggaatgaaatcctctaagggcccctttgaatcaaaggatttatgtaggaatttcataaattcaaattctatagaaaattttcctatttggccctttgattaaaaggattaaagctttccaaatcctatgaaattcctatggaatgacacattgcatgtggattttggagaaaatttactaagagctctaacctcttggaaaatttcctttgagtctatctctctcatccgattcctgcgtttttcctgcgctccaatcaaatgaccgtccctatgtttttcctgtgttttgcaatcctctgttttacacttcaatttctgttagaatcctgtgtttttcctattccttcgttttttctaccctgctatttaaaggggctctaaaattcctataaatttcctttgaatcaaagcggcccttatactttcgcccgtttaaaccagcgctagatctgccaggttgatgctcgcaatgtggaaggtgtaacgcaaacactgtaaatcagtaatgatattacagtagcagtgattaggcgaaagtacagtgctacatgcacgagattaggtatgcatggttaccgaaggtacaacccctgctgcctcctgccagcgaagtaaaggaatcagcaagaataaaggggggagcgcgattagtaatcaccaacttttgcaatctgctgcagcaaatttatacacgctctgtacatgtagctgtggatcagcattaaccatggcgacaagaagacaagcgctagaaaagaagaggaaaggcttagctgttgttgacaatgcgctaattaattgatggatcttcagcaaggcgagctccaaatgcaatgcagccatgttctgatgagatgacgcagtagtagagattgaaggcaaggtcccggatggtagatgaaactgtggcagcagatgtcatatcatttctggattcactcaacaacactgatcaagctataggtgagtgaagcttggaatggatagccaagccagcagctgctcgattttcatgatcttcacacttgcattgcatgctgtgatccatccacgaagcgttatggccgagtgaacacctggacatctagctagctgtacgttagtaggagtagttcgccggcaatctatgcaatgcatctacggtttcattacagcgtcctgcagtactgcttcttgcagcagcgtagctcgatcgaatcgcagtcctgcatgccagggatcgggatggctggctggcgtatcagaagtctagacgctcgagtggcggggaactcgtcgaccgatgcttaggcagagattgtccaggtctccaggaatagctagcttcagaccaggtttctgtggatgagcatttaccggttgtgaaatgctcggggccagccggctgtgaactgtatttgtctcgtcctctatacacctacagtagtatttccaggggggtaaattgactgcctgtagattttggttatacatccttaaaaataggagtatactctctctccgtataaagaaaacaacctagtactattaaaataagacataacttagtaccacaaatataaaaaaagtttgtctagattcgctgctgtattaggttatatccaatctaataatagctttttttaagagagaatctcttatatgccactgaaaattggtcatatcccttatataccattgaaaattggctcttttttacggcattgtttagttccaaactttttcttcaaacttctaacttttacatcacatcaaaattttcctacacacataaactttcaatttttccatcacatcgttccaatttcaaccaagcttccaattttggcatgaactaaacacacccgtatacgtccaaaaaaaattggctcttttcgtgtatgcaattagtccaaatttacgcaccctctcatatcacttttgtctgttgaccgttaactctcaaataaaaaagatgtatttgctcttatgagtatacgacatgcctaacaactcagaatggcaaatacgtctttttacctttggagttaacggtcaacaaacgaaagtggcatgagacatgggaagagccagtttttcctggcatataaggattcttttttttttaatggagggtgcatgacgaaagcaatttggcatacaagcagaagaatactcgtaaaagacatttgatataaaaggttctctctctgtaccataatataagggattttgagtttttgcttacaatgtttgaccactcgtcttatttaaaaaattttgaaattattatttattttatttgtgacttactttattatctacggtattttaagcacaacttttcgttttttatatttgtaaaaaaaattaattaagacgagtgttcaaacgttacaatcaaagaatcaaaatccacggagggagtaggatttgcctctgaatattcccagtcaatccaatccccaatgcttacaccaacaatagctgtagctatgctttatcactgctttcactgtccacacatctcatctctgtccagttcaactcacaagtctgtctccatcactatgacatctcccataaattgcagcaaaattttctcccctctcctttcatcactagcgctattaatttccacagaaaagaggtcatgcagctccaagtcacatttatatgtgcatggcagcagcagcagtaccacctatcccagccactagataaatgcgaaagcctccatggctgcattgctcattgatcatctgcccaccattagagacatcaagaacactctgcactagctcactcaggttgcatccaaagatcacaagatctgaagatcacattgatataaccatgagcagttctgaagaaaggatgttcgagatggatgctgacccaacttcatcaccagaagccagccccaagcaccatcacagtacatgccacatactagaggttgatcaatctgtcactctgggctttcttgtgccattgttcatgtaaatgccttgttagcctttgtttcttgcttactgtgtctgcaaaacacacgtagcagggtctcctcgggaggtgcacgcaggtggagatggagatacaagagagggccatgaagcatgtcatggagattggagaggagaggaagagaagcagcttgaagaggaggctgatgatgaggctgaggaaagatggctacgatgcttctctctgcaggtcttcttgggttgccaccgctgagcatccaggaggtgaagtgtttgttttttttttctttacttttgtttaagatattttttttcttctttacttatcttgttgacacaaaatttttaatgctattttgtccttgttctctgatttctctgttaccatttctgtgggtgtatggttcatctgtaaatatctaaaactggactagttggtctgcagaaaatgctgtcggaacagcatgtttcttgttttggtaaggaaatatgaatcacagaatttccatcttctgcgtgaacttccatggtgatttgctcctagtaactggagtaactgatatatctttcaccggctttttaattatactctttccattctatatattttagttttgtcctaagtaaaatttctataaacttagtttacaataacatatgcagcatcaaatttgttttgttaaatctatcactatatcttgatggtgtacttatttattattataaatgttaatatttttctacaaatttagtcaatgttaatagaatttaacataattaaactaaaatgactttactccgtagtatggaacggagggagtaccatttcacaaccccagtagcagtaaaactttcagaatcttggtactcctacggtgacatacaggtaatgaagcattgacattaattattgacttagatcagtgtaccgtgcatataatcactagtaccattactacccaatcatcgttaatatgctgacattggccacagggtcagcgagtgatcaccgttagcttcctttaatttaagtggccgaaacagtgagctgaaaggttgcagatgcttttgtctcgcaggtgattacgagtacatcgacgtgctcgtggcagtaggccatggtgctgacacgtcgtccacgtccaggctgatcgttgacgtggatttccggtcccagttccagctggcgaggccggccccatggtacgcccacctgtcgagccggctgccgccggtgttcgtgggcccgccggagaagctgcggcaggcggtggcgctgctgtgcatggcggcgcagcggtcgctccgggagagcggcctgcacgtcccgccgtggaggcggcccagctacgtgcaggccaagtggctcccctgccgcggcgtgcaggcatcagcgctgccaccgggcggcgagtccgccgcggcggcgaacggcggcgatggcccgcgggcggtggtccagtggtcggtggggaaggagaggagacgccgtggtggtgggcaccggaggtcaggcctctcggtggagctatccgactccggcgccggtgaggtgagctgagctgagctgtggtgtgcagtgtgccacgatggtggttcgctggtttcattgatcttttttagctcccacggtaaaaactgtgggatcgaggtgtagaaggtacatgtactgcagactccactgtactccagtagtttagaccaggttagattggttgccaaccagtcgggtgcagtcagtgactgttctggtagggccaacgtggtatccagttttgcagttttgctttcgcatcaaccgttgtttagctgcgttgatgttggcatgcatgccgcctgtggcatccggcgccgtgttttgcgttggacattttggaggcttaacgccaagcgaatagctagtgtggtgatcaaagaacacacaatccaaagtcatctatttcaaagtttacaagcatattgtacgtactacaacaactatagtgcaattactgtgatctgtgggtgctggaggtggagtatgcctggtcctgtggaatgacagtgcggagagaggggctagcttgtgggttcttatcgttttactggtggtagtaaatggacgctgtacgccgtatatatgcgcgccggtgttgccaccgtcggcgtcgtatccggcacacggggctccatgcaggaggtgggggggggggggggggttgaacgggagggagtggagctgtgtaaccagccgcagctttgtcaggcttgggtgtgaccggcatgtcatcaccatttcacctcgcctgtacgagtgtacgccagtattgtgtggctgatggaaatgctcttcgtggcgcgagatgattgacctctctactccattgctccccatactgtgcagtcctctactatactatccccatggcccattgcagcttttgcaaggaggaaggagaaaaaggaaggtaaaagaggggaatcctacgcggagaagatagagatatacgtacagtgatctggctaccaataactgaacaacgtgaacacacgtagtacaagtacaaccaggtgttgtgttttccacgcatattttgcctaaccccaacaaacggttgatctactcctccgttttacagttgcaaaacatagtaggagcctcaactgggcctctatggctggaagaaggaaacgctatatctggccgaaagctcaactgggcctctatggataatgagccctaaaagttaggaataagttcactttgtgaccctcaaaagtgacagaaatttaattcgtaaccctaaaccacaaaaccggatatctcaacccctaaactcttaaaaacggtgcaatttgactccctcgacggttttgcagagcggtttcgctgacgtggcgcctacgtggtgatattgaccgagtctttgttccacgtggcggtgacgtggcacttacgtggcattagaattaaaaaatatgtgtgggaccgtttgtcattcacacaaaaagaaatatgcacccactgacatgtagggcccacatgtcagtcatccttccttattggaaaaagtccactttgactcccttaattatcagcagaatctaatccgtaaccctcaaccgcaaaaccggataagatgactccccgaactattgaaaccggtacaatttgactccctcagcggttttggagggcggttttgctgatgtggcgctgacgtgttgatgttgacctagtctccgtctcacgtggcgcttacgtggcattcaaattaagaaaatttatgtgggacccatctgtcattcacacaaagaaatatattatgggacccactgacatgtggagcccacatgtcatcctctctctctcttcttttcaccggtctgcaagggcgagagctggacaagcggcggcggccggcggcaggcaagcgacactaggggtctagggcagcggcagaggcggtcgagggagtggtcggcagcggcggcggtgggaccagatcttcctcctccttctctctcgctcatctctttctcccctctttgtgtggtcggcaggagtggtcggcggcggcgggataacgacgggacggccggcggctgtgtaacgccccgacattcattagccattaacacagctaactcacaccggggtgttatgcattacctgtgatatagtaccagtccaaggatacactagctggtacacacagaataaatatggaatcaaagtaaattactttattacatcactgggtagtagtccttacataagatgccatcatggataggcccatagatgagcaacacaacattacagaaaaccataaaagcgacggcgtagaagcgaacaacgcggagcactaagcgactaagcaactatgcactaggcgaagaacctaggcatctatcttattccacaggcgaggcttggggctaggcacgaaacatctagaaatcttcatactcggcttgctcctacagatactcctcggcggtcgggtcgacgtcttcatcttcatactctatatattattataagggcaagggtgattacttaacgtactcaacaagccaggggaaagaatgacatgtttggtttaaacaataaggctaaggttttatttgcgaaagctgcctttctggcaaagtgatttatttcacaaaactcctagtgagtgagtcaagttttaggtgtcgggaggaggctcacgcctcgacccattccacaagttgctttgcaacaacttgtcacgattaacaacaacaattaatttgtttcctctattagtttcttctcacaacaatacatagtccacacagttatctcagcacaacaacgccatcatcatggccctaacaacatctcggtgtcggacgacaccccaggtcacacagacccgttcctaaccacccaggttagccgtctgccacacaggcggactctggtaacgttacccttcccagtaaccacttcttcacagacatttgtcaaacaaatctacgctatgagaaacaccttatactcgcccttgaccgtgggcacggctgttcgaacagttcattaatctctgcagaggttgcacgctttacccacacgacacgaaactgacattgtttacccgtcagcaacgaaagttcgtgataaggcctttccaaagctaacccatgaaaatcgcatgccacctagttgggctaaaatccatagccgagtatcaggcaatgacaaccgtcatccactcaggaaataccgaggatgccacctactcctaccggtaccacgccacaatagaggcaaaaagacacccatgatgggcaaaaatgtgtaacactccgtctcctcatcctcggcattccacaaccattggcacaccaactcccatgtgaaaacaatttacttagccagaggcatcccataaatatccgtgtggtcgcactgtaacgtgtttggatggatttcccaaaggaatcggtccttaacgataatacgtagccaaaccacaatgactccgcatcatcaccacttttcacaacacattttattttaaacatgtatttggaataacccaagtttcccatacggcaaaacatcgtaagcatggctaagcgaaactacctcggtaatcatataacgataccggtgcaaatatttgtggagttatcaaaggtatggaaacatcaacctatgtaatataaatgcgactattaggttggtccgtcggtcgtataaacgatccgaggcctaaacatgtttttcgtgtatactaagcaatgcatttttcaaacaacatatcattgcaaatataggggcaatgtgatcaaagaggcttgccttgcacagggcgcgggtcttctccctcgaaaacaacgtccggagcttcctcgaactcgggctctaaacgcgaaaaacaaaactaaataagaaaaggcaataaaactagttcaaaacagagaaacaatggttccactgtgtagatctcaattttagaaaaatttaggaacttgaacgggtcaatcggagttacggttgattttctacggattttcaaacgatcaaagcattttctggaaatttatttattggacgacaagggaatattctgttggaatattccgctaagctaacagcaaaaaggggaggcccacctgtcagcggttgttggaggaaaagagacgcgggcccggctgtcagtggcttggagggagtaaaggagcacggggccgggctgtcagcggctcagctcggcctctcttcttcttcctctcgctactgctcggctcggtctgggacgacgacgcaccgcggcggcgagtcccggcacggctaccggcggcggagaactccggtgaggcaccgccggcgacggcggcgctaggaggcgcggcgcagcggctctaggcggcggctcagagagtgatatcgtgagaaagagagagtagagagaaatggagatggtgatggtgtggggaggaggagcttgggttgcttccccttttataggcgagcgacgcggtggcgagctggcgaactaggcgcggcattccgggggtagacggctagcagctagggcgggattccggggcggacgagatggcgacgcgatggcttggcgtcatgcaccggtggcgactcgacggcgaaaacaacggcgacgcgacacgaagtgacgcgcggagagcgggaacggcggcgagacgggggtgacgcacggccgacgacggctatggccgggatttggggcggtagggctagagaggggtgacgcgagcgacggtggcgactcgacgcgagagagagggagagacgcggctcggcggtttcccgggaggagatagacgacaagacgacgaggcgacagcgaagggacgcgcgtccgcgagagctcgggatgggacggcgcggcgtcagcggtggtggcgacgcgacatggcgatggaacggggatgacgaggggtggcgttgcggccgttatccgttggcgtcgacgcgacggcgacgggatggagactcgatggatggagtggacggcgacgggacgggggtgacgcggggcgacgtggctccgtgtctcccggagagggcgcgacggtttttttcgtggagtttggcgcgatgcggctttggcgcggcgtgcggggcggcgctacgtggccctggcacgttgcggggcgcacgggagggtggtatggtgcaacgcggcacgggaacgagggcggaacggtgcggcacttgggcgagacattttgtcgaacacctggcgtgcatgcttgtggctggtctggggaagaagacgatgagcagtgaggggctgggctgggctggcgcaggaagaaggctgtgggccggcctgcttagggggagctgaagagaggagggatggaggggagttgggcctgggagagaaaagagagaaggaggcccaattcgaacagtgagctttcacaattttcaagagatttgtagagtttgaattttgaggagatttcaatggatttgaatttgaatttgacctagggtatcacaggtatttgaaggaaatttctaggagaggatttgagatccatttggcacaaaatcaactaagaaccaaattaactccaatttttaaatgacaaactttttaaataaaagcacataaaatacggatgctacaggctgacgcctccaccctgccgcacagcagccgaccagcctcgtcgcggcgcaccggaaagaaagccctcgccacgcacatcgacgacgccgcaggtgcccatcttgaggtacatgatgggcccgtacttgcgcgctagcgacgccaggtcggcgtgcggggctgggccgacgagcgggagcgcgccgaggacggggacgcccgggggtcccaaggggaggcggcggccgccgccaggggagggcgggcggtaggagcagagggagaggttgaggaggaggcaaaggaaggcggcggagagcacgacggggtcggtgcagagcgcggcgagctccatgcatctggagcgacgaggcagggcgtcaacgacgccgtggggagggatgggcgaggacgtcgacgactcgcggggggagagaaagagaggcggcgagggggactccgctccaggttgggtgaactctggccgggatggggttggaggaggcgccagccaccgccactccggcccccgtccgccgccgtcgccgacgatctagcccccgtccgccgccgccgacgatgacgatctggcccttgctctggccttcgcccgcccgccctcccgccgncgntagcccccatcctacgctcgcgaacagaaagagagagaaagagagggggaggttgaagaaggtagataagagaggatgacacgtgggccccaaatgtcagtgggtcccacatatatttttttaattcgaatgccacgtaagcgccacgtgagatgaagactaggtcaacatcgacacgtcagcaaaaccgccctccaaaaccactgagtgagtcaaattgcaccggtttcaatagttcggggagtcgtcttatccggtttcgcgatttgaggatcacgaattagattctgtcgataattaagggagtcaaagtggactttttccttccttcttcctcctccgtctctcccttctctttcgttctctccccttcttccccttcggccggcggcggggcatgggccgcggtgtggtggcggctggcgggagctgaaccggcggcggcagcgggagctgacgcgggagctatgttagaatctctcctctctgaatgtttaagtactaatcactagcactaacataaacacttgtatttactcggtggacacaaacacacaagaactgaacaaaacacacaggcttttggttgatgtggctaatcacaactcacaccattttcttcattacatagacttaagtacatgcaaaagataaggatcagccaactaatttggccttgactcacgccttactccaacatgcagatgccatgcaacaaggtaactagctagacctattcttccgccacaaaatcacttcgtggccttccagcttgagctgcagctctgcatgcatcttaacacatccaactaaatgcttgcatgcagccgctaatcactagttctacatgctaatgcaacagcctttacacatcgtagatatcggcacgttcgtccggccgcatcgcacagctcacagcaagcacgtttcacacgtactggctcggatcctttgctgccacacactactaccttgtgcaaaacctatacaaaccaaatgcatacactctaaagacaagattattgctaacaagctagctggagcggcggcggcggcggtgggctggaggtgatatgggttctggagcggcagcaccgccggtgtggtggacggagttggtgcagggagctcgtccacccggtcgatggcgacggtgatgatggagacaagggagcggatgaggctgggcagtcggtgctgcgacggggctgaggctgaggctgcggggggagctcgtccttcgaggcgatggccgtggacctcggcgtgatgaagaggtggtcgccacccctcctccggcggtggcggcagtccccggagtggaggagtcgacgatagtgaggccagcgctcggcgagatgggacctgcgtgctggacatcaggctggccaacgccgacatgcacgctggcaacatcctcacctgcagagacgaacaaggccatggcctctccctggttacaatcgacaatggatactgtcttcctgagagtgtaagcactgacgctgatagattttcttctagctaattgatttccattttgttcgttggtgatcatgcatcgatcacgcatgtgcagtttgaggattgcacattcgagtggctctgctggccgcagtgtaggcagccattcagcgaggagatggtggagtacataaggtcactggacgccgaggaggacatcgccattctgaggttccatggctgggacatgtcaggcaagtgtgagcgcatcctgtgcgtcaccaccatgctactcaagaaaggcgtggacacgggcctcgccgcgttccacatgaggagcatcttgtgcagggatggggccagacggtccccggagtgaggagtcgacgatggcgaggccagcgcttggcaagatggggtcggcatcgtggaggaagtcgaccggcgggggttgtccttagcgtcatcgacggccgacgatggaggctgaggtcgaaggcggcggcccacacactggcctcgctcgtcggccgacacagaggcgccaatgctgaccttgttcgccgccgccgccgccgctccggattcagcttgggtgactttgtgttggcatgtcacaacgtgacattgtgaggatctctgccatcaaaaacacatccaacagctcgtttggttgggcccgtctgcaggtcggaaatttagccgccgatccatccgtcccgcgggagtcggcgcccgccgatccaacccatcccgtttcgcctcgcccgggtccggccgtcgccgcgagccagcgagttgttctgaagaacaaatcaaaagcaaactccagtcaggatgcaacaaacagaagctgtttgatgtccataggctgatgcttgtgcaggggcagtgcggccggcaagggcagtgcggcctccaggacgtcccctcctccacgcgctgagctgcagatcacagaagaaaaatgaggccggtccgccacggctgcagatcaccacgactgcctggactggctcggcagcctccatccgcagccgccaccgcacgagggtaggcctggtggccggccgctgctcgcctctactcgtgccggcagggccactgcggccatctcgacacgcgcgcgcggcggcccacggcggcggccccactggagtcccgcgacgacagcccccttccgagcggcggcaccggcccccttccaagcggcggcggtggtggttctgggggattcgcgagcagcacgctcgggcaggaaacggagcaatgcggggtgaaaaactgaggcctgcaggtgggccggcgcagaggacccttggatttattttcaacgccccagattgctctaatgtcacaccgtgccataccatggcaatgtcacagaatctgagtcccgccgctccagccctcgccgcgtggaagagggggaagaagaaagagggaggagtcagtgggccccacaaatttttatgtgtgtgaatgacaaacgagtcccacatatattttttaattctaatgctatgtaagtgccacgtcaacgccacgtggaacaaagacccattaatatcgccacgtaggcacgtcagtgaaaacgccctccaaaaccactgagggagtcaatcacttttgaggatcacaaggggaacttattcctaaaagttactactagtttgagggacaaatgatgaactttttcccgtttggctcaagcccacgcgaccatccaaatccagttggaacgttatcgcgagtaacgtgcggtgcggcccatctgtgtgggccgtggagcgagtagattgggcgcggattacgtgcaggccgggcggcctgcttatgcgtgggctatcggcaattcggagagcttcgtgccatcgtaggatggccccggagtgattacctgcgctggcccgcgcggtgcggagaggatcggaattagatatggcgtcaaacgccgtcgtgcgttgcggactcgcggtcggcaggcgggttgcgcgtgttccgtgtgggaggccttgctgcgtgccaaccagcg

SEQ ID NO: 61229 - DNA, 3271 bp, Oryza sativa
cgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttatcgttattatttctttgttcaccctagattaaacaaaaccccaactagtggacactctactcatggtgccactagtacaattataggtagatgcttcgcttttaattaggtaacattaggcggttttacaactctagactttgggaatattcatatcacctggacactgtggaattgttggagtattgtggaattggattcacactgccccctctattcaaaatccccaaaaatggtttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgacggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaagacaggttcgtgtgggttcacggccttgattaataatattgtatagctctaggatcgtatttacaaaatagcttgagcaactaagtgccttttaatgctgtttactgcaaaccctaaccccctatattatgactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtacctgccgtcaagcgcctgtggtcgtcaccctagtcttccgctgtttttcgtttgtcttcatgtgtgctgggccttcgccgcccatgtaataaattaattatttacgcttccgcttgttaaactctgtattgtatcaacttttggtgtaccttgcctcctgggacaaggaataatacacgcacgtaaggaacgcccgttgggttttttcggtcgtgacaagatgcaaagccgatatgcttgaacctgtcaaggctgaaatcaaacgtttgtatgatgctggttttattcgtccttgccgatatgctgaaagggtttctagtgtagttcctgttatcaagaaaaatggtaaggtgagggtttgcattgatttcagggatttgaataaagctaccctgaaggatgaatatccgatgccaatggccgatcagttggttgatgctgcttcaggacataagatactaagttttatggatgggaacgcgggatataatcaaatctttatggccgaagaagatatggataagacggccttcagattatcctggtgcattcgggcttgtttgaatgggttgtaatgactttcggctcaaagagcgctggaggtaggtaccagaggctattgaattatatatatcatgatctgatcggatggttggttgaggtcaatattgatgatgtggttgttaaatccaaagaaatagaggaccacatagccgatttgagaaaggttttcgagaggactaggaaatatggtttgaagatgaatccgacaaaatgtgcttttggtgtatcggctggccagttcttgggatttcttgttcatgaaagggggattgaaatacctcagaggagtatcaatgcgatcaaaaagattaagcctccgggaaacaagacagagttgcaggagatgatcggcaaaattaattttgttcgaaggtttatttctaatttgtctggaaaactggaaccttttacaccattgttaagattgagagccgatcagcaattcacttagggggcagaacaacagaaagctttggataatattaaagaatatttaagttctcctccagtattgatccctccataaaaagggattcctttccgattatatttgtcggccggtgataagtcaatcggctcggtcttgattcaggagcttgaaggaaaagagagggttgtgttttatttaagccgtcggctcttggatgcagaaacaaggtattctcctgtggagaaattgtgtttgtgtttatatttctcttgtactaagttgaggcattacttgttgtccaatgagtgcactgtggtgtgtaaagccgatgtgattaagtacatgctatcggctccgattttaaaatgaagagttggcaagtggatattttctttaatggagtttgatcttcggcatgaatcaccaaaggcgattaagggacaggctgtagccgattttattgtgggtcatcgtgatgattcaatcggcttggttgacattatgccttgggtattattctttgatgaatctgtatgcagtcatggttatggtatcggcttggttataattgcgccttgggggcaagttttgaatttgcctatgctattaaacaccgtgtgactaataatcaggctgagtatgaggcagtgttaaaagggttacagttgcttcaggaa

SEQ ID NO: 61230 - DNA, 8129 bp, Oryza sativa
caaaaatttaaaaaaaaattaagataatctttcgtcatagagcacttgagcttgcaagaagaaatatttaatgtctatgctattattgagataaaatgaataaaaaaggcgttgaatacgagaaagatcgatttgataatcctaaagatctgattatagtatagggtataaatatcttatttctgatcttctgtgtatgcttgtctttttgcacaaattaaaaggtaaaaatctatttgtgatttcatatggactagattttccttcgctttgctaactaacacatttagcacatttcaatccatcttgaggaagcttcgtcgatcacacttacatccagttgcataataggttactggtgatagatgggaaaatatatggaaaaatcctagaaactaacgttggattgaatagatggacatcgtaaattcgtccacgtcatcacgagtaaaaaattttctcgtagcacaagtaaaaaatattctcataggtttactcataaatagaaattttattggaagtaaaatttttactcatgatgatgtggacgaatttcagacatctatttttcgatccagcggtagtttctagatttccactaaatatgtggtttgtactacatattttcatattttcatagtttaagaggtatttcttacaattttactatcaatgggttatgtggattgaatccacagcttagggggcattattgaaataatggtttttatttacttcctaacacgccataatcacaaaattaatgttgtaaggcataatattcgaaggcccaaaatcatggcccatcctcgtgaataggcgggcctctgaaacaaagccgagtgcccatgtgcatttcacatctaaccattttgtctccaaatcatcatacggacctcctttttttttgccacttatcacaaaaaaaacgtccaaattggttcggtgtcgtccttatcaaccgagaaatttgtatatatatatatgccatcggaaaaaaaaaaaaacgttgatttcactaccataccatgtcaaatgtgcttcgataaatattctcgatcaaacgaagggtattcgctagcttgaaatgccattgtggacagtattgcccttgtatatgcttcctcccccctccaacgctagctggccattggtcgccgtcggctccggctgcagctcacgccgcccaccaccatctccgatgaacacccactgcacgggctccagcaacaaggctagctagctagctacctcacaacttcagccaggagctaggacaggaagaagcaagccggccagctgggccagaagcttctgcccgtacctcgtcctcgtcctgtaggctgtacctccacgggtgcctcgtcgtcgcctcagccgcggacaagctcgatcgggaacgaattctcctaccccacatattatgtgtgtgtgtgtgtgtgtgtgtgtgtgtgtgtgtatatatatatatatatatatatatatatatatatatatgcaggggcgaagtcaggatttttatatcagggatgctaagattttccgcaccattcatcgccgtggcatgatgatgaagttaagactgtgttacctcgacgtggttggaaactaatccctctaactcgcaaaacggagcgactcattagcgtataattaattatcagctattttttataaaagggattaatatgatttttttaaagcaactttcatattaaaatattttacaaaaaaacacaccgtttaaccgttcgaaaaacatgcacgcgaaaaacgagggaggtgaattgggaaagggagagaattgaataacacagcctaatggcatcggcagtgaataatgcccactagtgccataaggtgggcccacgtgggtccagtctttgtagctaataacactttctataatgtgtacagagcaaaggaggcattacggttggtcccatctaaataaaaaatcgtaccacttttcaactgccacttcctttcttctccccctcctcctcctcctcatctgatccctttcttctctcacatcctgggcggtggactcacgggcgaggtcggctccggtggtggcggcgctcgtgggcgtggctggatccggcggcgggactcggcactcacgggcatggtggatccggcaacagcagcgacgcccgtgggaggaagaggaggttcgcggcggcgcccacgggtggaggcggaggtagcgaccgcgggaggaggcagcggcagcggcgcccacaccaatggctcatgggcagaactcccctcgcgggagaaggcgacggcggcgtcgacctgcgcgaggaggctgtggcagcggctcgcacgaatccacgacagtggctgcggactgcgatggcgctatccagtagtcctccggtggcatgggagactgtggctattgtgggcggatctctggcggtctcctcccgtgggtgccctcctctcattcccggtggcacggcaagcaatagattggttagagagagagaaagaggagagttccatgagagagaaataatgagtttgttattccatatgggcaggcattagctataaggatgactcatccaaacaatacctatgatgactacttgcacaatgtgtaaagactacttgataagcttaataccctctatattttcacattgtagatgccttaagaggtttccggtttgtaagagctattttatatagaaaaattattacatgtataaaaatatattacaagtttccggcgacgggcctccgcttcactccggcaaaagctaacctttaaagatgtgcaaatgaatttggatcacaactcaacaaactccaccttgagacaaattccttcttgtagtataaatcaatccttcaccctgaacacaacaaagaaaaaacacttccggcgtcaaatagcctcttgggctaaaccactatacaaactaagcttgagcaaagctcaaccttagcaacaggaactggctttgtcatcatatcagcaggattatcttgagtgcttatcttatacctttagcttaccttgtgcgactacatcacgaacattgttgtcgaatgacaactgcgtcacgtcgaagaacgtggaatttggatggaaaagtagtattgacttaataaaatttttgggatcccccgttacatggccctagggggctatttatagccctagtacaagctgttaccctctagggtttattgtttaccggggatattacataaatgcccttatgatgatgacatttacaggggtaaccaattcctattgagttgtggacctcctaacagtcttcttgggccggaccatgaaagtggcgaacaacctttttgggccaggctcgtgcgaagctgcatccctgcttcgccatgggcttggccattgtaccccgccaatgggcttcaccatgggctatgctttgccatgggttccgccttcatgcttcgccacgggctctgccttcatccaaacttggcttctggccgctttgccgttccttaatagtttcggcaggtttgggcaaaggccctcgcgacatgcctccaacgaacataatggtacttgatatcaatgtgctttttcctctcatggaacatctgatctttagtgaggtatatggactttgactgtcacaaaacaggttaatgcaagaatcaactccacaaagctcagcaaacaatcctttcagccaaactgattccttacatgcttcagcaataaccatgtattttgcttcagtggtagactgggcaacaacaggctgcaatgttgccttccaactcacagcacaactaccaatagtaaacacattacctgtgagtgatcttcgcttatccaaatcagaaagaaaatttgaatccacatagccaacaagtcccttatcagtcctgccaaacttcaagcaagccgctgtcgtgcctccaaggtacctgaaaatccactaaacagccttccagtgttctttgctaggatgagccatgtatctactaaccaaactcatagcatgagataaatctggacgagagcaaaccatagcatacatcaaagaaccaacagcactagaatatggaacccttggcatgtattctacctccttatcagtactagcacattataaggctgataatttaaaataaggtgcaataggggtactaacaggctttgcatcatgcatgttgaaaggttgaagaactttcttaatgtaactttgctaactaagaaataacaaaccagaatatcgggttctagtaatttccatacctaaaattttgttcacagtgccaagatctttcaattcaaattcattattcaactgtttttccaaggaagtaattttttcctggtttttgacagcaatcagcatatcttcaacatatgccagtaagtatataggtgatccattaataaatttaatgtacacccaggtatcatattcagacttcttaaagccatgtgccaacataaatgaatcaacccttttataccattaacgagaaaactgtttcaaaccatataaggatattttcaaattgcaaatataatcctccttaccaggtactatgaaccctcttggctggtctatgtatatctgctccgcaagctctccatgtaaaaattatgtcttcatatctaactgctcaagctcaagatcatgcatagtaacaatactgaagaatgtacaaattgaattatgctttacaactggagagaacacattactataatcacactagtaatctaactgaagccttttgctactaaccttgccttaaaccttggaggctcactgagagataaaccctcctttctcttgaagatccatttgcaacggacagtcttcttctgttttggcaagcgcacaagctcccatgtgtcattcttctcgagagattgcatctcctcctgcatagttgagatccacttttcacgatcaccagaaacaacagcttcagtgtatgcagccggctcatgagtgttcttcacctgcttagcacaattaaaagcataataaaccatatcacattcctcaatcagacggactagagctccacaactcctctttgttctacgatgtgcaataggttgatcttgtggctgcaaaacagggggtgagtgctgaacagtatcatgaacatcattatcaacaatttcagtttcctgatcatccatgtgctccacctgcacgttgacatattgctgctcctcattagaaccacctggtataacatctgtggacaagctatcattaaacataacatattcattgaaaacaacactcctactcaagaaagtccttttattttcaggattccataacttatatccttttactcttgaaccagtggcggatccagcatgggggtggcggggtctcgaacccccactactggcgtgaagactatgagagaccccacgaagaccccactaaaattttttaccatatgtaaatgggagggtggactgtaactttatttaatttgctcagaccccactgctatttatttctagatccgccactgttttgaaccataaccaagaaacaaacacttaatagttttaggctctaattttccattatcaacatgagcataagcagtggcagccaaaaactctcaactgtgaataatcagcaggcataccagaccatactttaatgggagttttcttattaagtgggatagaaggcaacctgttgatcaagtagcaggcggtgttagcagcctctgcccaaaaacacttgttcatatgagcattggacagcatacaacgagccatcgagatgatggttctattcatgcactcggccacaccattctgttgcggagtgtacgggatggtgtgatgcctaacgatgccttctttcctgcagtaatcatcaaaagcatccgaacagaattcaccaccattgtcaatgcgaagtacttttacctccttttcaatttgtctttttatcataactttccactctttaaaagcaacaaaagtatcatctttatttttcaggaaataagtccacacttttctagagtaatcatcgataatggtaagcatataacgagcacaaccattagagggcttacgagaaggcccccacaaatcagcatgcaaataatcaagtatacctttggtgcgatgaacagaggtattgaattttaccctcttgtccttaccaaaaacacagtgctcacataacttcatgttaccctgagtacaaccatccagcaggttcctcttcatcaattttgccataccaaattcactcatatgtccaagacgcatatgccataggttagtattactaggttcattattagaaacaatagcagcggaaacagaaccatgtaatgtacttcctctaaggacatataactttgcagaattcagatcacctatcatataaacaagagaaccttttgatacctttacaactccacctgaaccggagtatttgtatccttctgcatcaagtctggtaagagagatgagatttctcgccatccctagtatgtgtctcacaactttcatcatgtgtgccatgccatcatgcgtccacgatctaacgcgggttgtcatctcccatatgcacgacatctccattctgcacagatgttggtatttcttaacgatattactagaaatataattcccagcaatggcgcagaaaaacttctggtatattgcggttacagagttcatccgcaagcgcacggatataccattgtagcatttcacccgagagtattccaagggtatcatatttgtttaatcccgtgggaagattataatagagataatcgtactaaagtctaatttatatattacttgttacaaccaaagtctaagcaggggttaatgtaattcagagagtatagtgacactaagcagaagcattcatacactcattcacaattatataagttaagtggaaaaaatatagaaatatcttattcctatacttcatattatacatacatattatacatacatcctagttatagcattacttagctaataccctctttccgatgccctcctggtgcttcgagaagccacccctgattgccgagtttcttacgacaatccgtcatgaacatccaaccggggctaaatacggaggagtaccctccccaggaaattaacttaggactatatacacgcgcggaggaatacccgtactaagctgtcaccatcagcggcccacctcgcttccatagcatataaccctaaataatgatatccagtaatctaaacaccacgcttaaattaccaaatactactctaatatcatcgtcatgacatagagtcatcgtaaatacgatcattatacccacaccattgcatctcccagataagctagcatcgtaataaatataacttggacatataataaagttggtattcatatactcggaaagtaatataataccgcaatagtataaaaaagaatattctaataaaagtacaagtcttacaaaagaagtaaaagctactagagccatacccgaattcttcctaagactccgaggactgaagattctatttctatttctattccactatactctacagactatactaaacttaagaaatgtatgaagcttcttgcttgaggtgtgtggagaaatggagagagtgaagtccttttatagcctcctaatgacggttgtgatagttggaatggtcggaaatgccttccaaccgtcattgggatgcaatcctggatgtacacgccgaactctggcctcaacgatggagatgggggttcggccgaaccatgggctggtccaatctagcccatttttggccggcggccacctggacttcttctctttgcagacttgtgaattttggcccaattgatcatgtcatttatgagttcttgtcccatttattgataagtctgattctcgacatcgttcgattgattgatcgcctgttttgatgtcgattcccctccattttatgtttattccctgcaagaggttagtaatcctagtgctagtggaatatttattattaaacataaatatgcattgcaagcattactagttctcctttattttggtagtattgacggtcaaaactaatcgctaacgaccgtcaacaacagacttgtaag

SEQ ID NO: 61231 - DNA, 32239 bp, Oryza sativa
gtccacagataaatccgcaagcgcacggaataccgctgtagcacttcactttcgggtgaccccaaaaggatatcaaactcagggaacgtgtgtaatttagctaaggctaagactatccaaggacaacaactgatgataggcaggctagagaggtcttcctatgtgttttatttacctaagctaagttgaaggtaatttcctatctgttgcttcgggcaccgacccctgctggtctgccagcgtggttccggctatagctctatgatgtatccgtacgtggaggattactgggatgagattcagggctgtcaccacctgccgcctacctctgacaaatccgtgggatacacaacaaacaaaggtaatctctaacctagacaccacatctaagttattaattactactctaatatttgctcaggaacttccttttctatccagagtcctagaactagagcgcttagtacgaatactaaacaatgaactcgcaaagatggaaatatatcttactcagaccaaataattaaataacataagaaaggatcacgaatgcttacttaacagaagaagttctccgaacccggagcagagtgtaccgacagctccggtactcctccagaattcctcctaggaagctacactcgtcgaggtagaagtcggatgagcgccaaacttccgggcactcctctagagcttcccctcactctataccttattctagtgtacaaaagatacaatagagcctcttgtaattcatctcaaaattgtgtgttggaaatgagagtgagctcctccttttataggcaggtatgacggttacagcctatgcgaaatgaccaaactaccccggaaccgccatcaggaagtaatcagggccgtccacatcaaatttggcgatcaacggccaccaaaagggttcggccgaaccagggacggctccgttcggcccgttttttgtcgtggacactaattttgaggccctcagcccattggcatgatagttgggcccatttggagttgtttaattgacttacgaggcctccaatccgtgtaaatgtgtcctgaatgcgcggaggtgcagtttgtcacttgacggatgtgttttcttctcaaaatacctgcatacacatatttcaccaacactagtggaaatcattagtaataatacctaccactaagttggataccatgttttatttcattatatgtaggtattgacggtcagatattatgatttaaggaccgtcaacaacaaccagcaaaaacgacaagacagtcccttgaatcagagttttcagcacccgagacgacagaggccttatcatcggatttccttttctccttattctgcagtttccaatattcttcagtgaagtgatttttcttcttgcagtacttacagaacttcttacctctggactttgaatgacctctatcattctagctcttgtcatgatcgttgatgtcgttgtaggttctctgctcagatctgcctctgacctgcaatgcttcgcccttggaggacaacacgtcagactgaaccatacctttcatcttttccctattctagagtgccttataaacttccgaaagggttagttcgtcacggcttaatagtatggtgtcacagaaatttgcatataaactaggcagttagcataacaggagaagacctaaatcttcatcatcaaactgtacctccatcgacactaggttggcaacaatctccttgaagaccgatatgtggttcaacactaaaccagtcttctgtaacttctgcgagaataacttcatcttcatatgcctcttactggttagatccttagatccatagatcgattctagtttgagccaaagttctacagcagttcgttcctgcaacacttcttgcaaaatatcattacatagatgaagttgaatcaacgacagaaccttacaatctttccgcttcttctcagcggtccattcatccttcttcttcttcccgaagctttccagcgcctcatcaagatccgaagattgcaccagaacagcccgcatcttaacttgccacagtgagaatcttgtcttgtagtctagcagcggtagatcatacttcatcgatgccatcgcggaaccctcgtgtgagaacaagctctgataccacttgttaggaaacgataggcaaataaacgataaagaaaatagatcaatcacagaagacatgagatttaacgtggaaaaccctcccaaagcaggagagaaaaaatcacgggcgccagctagaaaaatatcttcactatatcggggtgaggttacaacaccgaacagcggcttacaagaagtatatatgaaggtgaaaccctccggcgacaggcctccacttcgctccggcagaagctggcctttatatatgtgaaaatgaatttggatcacaactcaacaggaacgagttctggacttctagtcgcctcgtcgacgatgagctaaaggtttagggcaaggcgtattacaaatgggttgatggagagcaggttggcaggggacgctggctcgtcctatgcttgacggaggacggcggcggtggcggccaagatggcgggctccgtcatcggacgatgacatgacatagagaggaatggtcaacgttggaaggaagtggaagaaggaagatgaagatccaagggcaataccatccacgatgcattctagcaagaacaccctccgttcaaccatggcacttatcgaagcattttagcgaagccagctatttttgatggcacatataccgatttctccctctcaaccccctccatgaagacttaaatagttaattcatttgtaataaatcaattccattactgtaatgggcagtgtagcctagtggttgcagtgacttgagtagcacctaaaagtcttgagttcaaatctccataggagcgaatttcagattgggttcctaatttaaaaaggttgcatatatccagttgatgctctctatcacaccatcttagagcaattgctataaaacctttaaactgtcatataaactcaaacaataagttagaggagagagaagaaatcgtccattatgtaaagggtaatctcaatatataaacttcaaaaaagatcaaagaagaaggtcaataaattgaaagataaagaaggaaaaaaatattgtagtctattaggacaaattgcttgagataatatgttgagcgtgtcacttcttaattaactaatgagtagataatgtggataaaactggagatgattatattacctttacttataaaacttgttcttagatgtcagcggtgagcctattttgtatcttggcacatatcagtagcatcacttttaccatctttacataatccctctcaaaagattcaccgtttaccacatgctatgcataaattaaaactgcacattaaaaataatctgttatatatgcgtggcattttaatgaattttatcaatggactgataacagaaaacacagtcaaatctcgtaaattttggaccattcgattgatttaagatttacgcacactccctagccctaacctcctccctcttatccttcttcctccctctacgccgccaatgcacgacgataagcacacactccctgcctccagttccaccgccagctgccgaaacgcacaaacagtgtcatttggcccctccccccttcctccttcccctttcctccctcttctcctcctcaagccgacggcagcgaggtactcccatccttagcgtctttcttgtctccgacgagggtcatcggatctatcacctacaaccgttatcaacatcagtccaccacctgctaccaaccttgtggctttggcgccgacacctgtgcctcgcagtccgcctactccgccgcccatcatcaagccaccacctctcactcttgtgtccatctaaaggctgcgaactcattctctttccttcttcttactccgatctctaaatcaggaccataatccatatgtccttcttcggaattcatggtgtctccggagaagaagaagagaaggttgttggagttgaacaacaagggtttagagtacgagccacaaaactcatccgatggcctaaattaggtaatatttggggatggattttttatcgacgaaaggttagtaattccgttccataaacatccatacgaataaattaaatggaaatcattccctaaatctttcatatagcattaacttctcttttctcttttagacgcaaaatttaaaagcttattaatttctaccacgattttattataaataaaaggagactccaactctcgaaggaacgaaccgagaaaagaaaacagaagaaaatcaaagaagcggtgcgagaaaggggaaagaaaggaggtgcctttccatggcggccgagggttccagccgcggcggcggcggcggccggaaagcctcctggctggggatgtcatcggagggcggcgcggccaagttcctgtctggcttgccgtcgcgcggcaatttctcctcgatctccgcctcttccactctcgtacgcacgcccaatccctgactaaaacccccacaaatgatgtactttttttttaatttcccttttggcgttaagattcttgttgaattctcatggagggtgagaggattctgagatgaatttctttggctgtgatctgcgcagggacggctcagggtttacgtctgcgagcatgacacggatcctccaggtcagtgggagattcattcttgtagagattttgtagtagtatgttgtatttctgttaactcagaatgctctattttgctagcttcttaggttaatgttttaggtttttcatgtagtggttgtggtgttttgtgtgtggaggcttcgattgatggaagctgtctttaggattccacatgtccactagtatctgtggaattataagttttttttcttcttcttcttctagggtttatgtgtattttgcttaaagtataaagtaagaccgatgagtaaattctagtgtgctaaaaagcatgtacaagtgttgttttcactgtttaggatttgtagcgaatctagtgtcgctgtttatttaaaatgtctgcactgagaatctgtgctgagttgctcttagattatgtgcctcaatgcacatgaattttagtttttcatcgcgattcgttgcactcaatgcagccagtatgacggaactttggttcttggagttaatgcagtttcttcctttcaattttcattcattcttttaggttaagttttggtaatttagttgtaaatctatgatgtttctagatgaaactacagtagatggttactgcagaaatttcttccatagaaaaggttcttcccaagggactgttgtttctgttatacgctgtaccaatgcacaatttaggctttaatgttagaaatcatggaaactcgcagctctcctattttactgtgttctagtcaaaacaaattgaaatggagctctgcattggcagtaggtcttggggataggagttggtggagaatatcaccttgatgggttgttcacctgcttcatatgttttgtggctataatttgctggcagattcattaaaattttaactgtttaatctcttttctgtttagagggacaagttatagagaccgatacaacaaatattttgatcagacatctccagctaaagaaaaaggagatggatgccaaagaagccaaagaggccagagatgcaggttctaggaaccaaggggaaaccgtcaaatggaaaaggtaaatctgccaaattgacagtatgtgttttacagtgccttattggagcatccttttattactaattaccatgtcattccatgctttatatggactatggtactcttgttacatatgagatggctcatcccttgcagcacctttctattttattttgttctggtctttttctatgggtattatgtgattcattaatttttaggccatgtatttaggggtcttacaacacccatttgatcttgaagcataatgtaacatccttgccctaattcctgggtaagtcccatggagtttcagtaaattaatgagcagttgctgttggaattttctgtgcttaagaaagctctatggattttcagcataccatgctttattagtttagttggtttgcatacctacatcagttttcaactaagtctcatatttgtgaatgactttaccattggtggagattgaagagcagctgccataattattgaatggccaaatttgacctgtctagcttgaccctacttcaatgtcatgtgcttattggggcaaagcaggctctactattctacatttctagtcatatatgaaaaaaaaagtttatgagaccgagccttttcccctgacaatttcacttgttttttacattatcggcattgactggatttgaattccataaatctgattagttcacaatgatttgaatccactgccaaaagtaatatatggatttatgaacatggtatttttcttaccgggttacatatgattggtgagcatggcactaaattaggttgttcagcctttatggtgtaaccatacaatttggctccattctgggtactaataattctttatggaatgttttaggcctagcaccctttaaaaataccaagtctaaactcaaattgtttaaaaggaaaagatgagataagttcctattaacagtaagtagaagcacctgccactttttttgctttttccttttgatcctttttgcagagaatttctcattttgttattataggatgaattgtaacttggttttattcatttctgatgtatatacaaatatgtagttttatttggaatctgtcatgtcaacttggtgcacaaacaatactagattacaagtttacaaataaaggaagagttacagctggtgaattgttgctcttcactaacaagttatatgttgcgttccacgacttagaaagctggctagattaggttaatccatatagtgtttaatttagttgaattataacattcttttccacagcctcttgaattatcctgaaaaaccacacaaagagcaaattatccaaactcttctagtatatctattgatctttttttttctcgaaaaattaggaggaataggcttcatttcattaagaagaaaaggaaatttacacaggagagagacggaaaggatcctccacccaaacacgtcacacaaaagacaccaccaaaaccccaactaagcacctggggcagcgacctcacaaccccaactattttgtcattttgaataaattagtatcttgtacatttgtgagaagaacaacagatagtttttatttcttcagactctttacaggattaaatcctttagtagaaggtacccactgtagtggcctacagaacaaccaagtacaaccctaaccatagaggtaatctcccaccatgcagcattaaatttgtgggaacctaataaaacatatgaatcttccatttatccattacagatcatgttactgtttgtatcatgctatgaagccacatacgctctaagcgatttattggagtgatttctttcatacttctatgctgatgctgacgaatagcttggccattcagtgatccaggattaatacaagttctttgagtcatacctacttgtcctcatgaaactgtttatccttcttggttgcttattacttgggatgatatgactatataaattaggtctggaagtaattatttttccttttttgtttgactagagttgctcccagaagtttggatggccaaagttcatctaaaaggcccaatttgggtagctcctctgggctgtcttctgctggtaagttgtctaagtcttagtcttccagtttgggcatttgtgaatgtctgatacttgataatgctaagatacgaatagagagaataatgtttcatttattagcattttgttgaggaaaaagagagtaaaggatatcaattgtccagatttacctgaagccaaccctttttcaagcttctacccaaaaagaaaaaagaaagaaagtggccagagttaccaccttccattgaactttttgccacgactgtccacttgaatttgtgaagtgcccaaccaggaggaatgctttgccttgttctaggtttacaactttacatgttaagccactaactgtctttctattttaaggccccattcgtttgcttagtttggaggagcttttcagccgctgtgaaatgagaaagcccattagcacatgattaattaagtattaactattataaacttgaaaaatggatttatttgattttttttaaaaaaaacttttctataaaaagtttttgcaaaaacgcgccatttaatagtttgaaaagtgtgctgatggaaaacaaggaagttgtagtttggagttgaagaaaagaactaggcctgaatttaagatcagtaatatgctgatgcatgctttagcattttaaaagaagacaaaaacatgctcatgtacagtctcacaattcctctaataactttaataaactttcatattgcagaagaagcggcacctggattttcaggtcacacactacagacattcacagttgagaggttgcgtgcacttctgcgacagaggggcctcatgaccaaagggaaaaaggcaagcaaaaattgtcgttccaagttctcttgttctaaatttaagtggtttcatgcttttaattctgtcactagtatatgtatttgaatttttgcttgtagaatttattttagtagaatgtcagctaagatgactggatatccaccatttttgaacgtttggatgattctgtagtgtctgacacctgatattttcctaggaagcttagtcagttacagaatttgtccattagtattccaaatgttccctcaggacttattcgttgcatggcatatggtaggattttgtttctgtagaagcttcataattttttagtgaaagttggctttacaaaataaaatgaatgggatgataagagcctgagctttgtcatgtaactgcagtattgtgcctaatagattattttaagaacaaaatatagaagttcccaaaacaagcttcttctagagatgcttgtgttgtcagtaggctgttgcttttttctttcagtggcagcacattatggtttttgttatatttacactatttgattttgacgccgcggatgtggcattagtaaatgaactttcttgttaataaagcattgacagtcttcattcttgcacattagaaaataacacaggttcccaaataagaattattttcacataattgatcatgcctacattgatctacctaggccataatcttttgtgcgagaagtgtattcaattttttgatgtatgatgtccttcctactgcaggatgaactcatcgctcgcttaagagaatcacaggactgatctagagaaagctcgtgccgtactctctttgtaggttgatgcaatgtgtttcctgatttgctatgtcaagctttgctgggagcagaatgagaaccaggcttcatctgttggctggatgttaaggctctaggagatgtagtcacttaggttgggccttgagaacttgtgcctaattgcattagcttgtcagaaatttgggcttgggttccctgtttgttagggcttatccagtgctttacttggtacatgtagaaggctaatctggcagtgtttgtaaccttttgtctcatactggaggagttaccatgctaatttacaagcatagttaaaagctaatcgtaccatgtttgaccaattgagctatggaagaaagcataggcgtgaacccagctcagaagtgaatggcagatagcaaaaaagaatagacttggaaatggaaaaaaatggagcgaaacaaaggcatacaaattggaaaatcagcaggaaatgtgctgattactcgtatcgattgctttaggaaatatcgcagtcttgagcagataaattctttttgtgtgtgtgatctcaattctacattgtgttaggtgcaaacatcacttctttaacctaatgcttcctgcaactcgagctgttttattgggtggctgcaaattgcaatttactacttatcttccaacttataaccctgaaagaacagcattacagaggccgtttcttcctatgtttgcccctttatttcttactccctccgtttcacaatgtaagtcattctagtatttttcacattcatatatatctatctagattcattaatatcaatattaatgtataaaatgctagaatgacttaaattgtgaaacgaaggaagtatatgctttgctgcgagatagaaaatatggaatacaaaggagcctcagtaaactagaagcaaacagtcgtagagatggtccaaagtagtggtcatctgtcaattgtcatcctctcagattttaaattttttgctgatattttttttctgattttaaatgtcatctgtcaattgtcatcacttataaatcttttgctgattatctttgtattttttttctatgacaaatggaatagtttcaacagaaaattagacaaaagacagtacaatcaaaataaaattgggttttactccctctatcccatattaagttcacttttggttactctcattcttagtaatcatcgcattggagtttgtgaaagtagggaataattaaattgaatgtaaataaagtggggaataattatattgggatttgataaagtaggagcattatagtttttttagtgtttgtattggtatgtgtgagaccgttgaaagatttaacttattttaggatggagatagttgtaattataaactagcatattatcagtaaatgacagttgggaataaaaggtctccttctcattggtggtgtatagcttttggcattatcaactgttcaactccctgtcagtcaagtttgtcacctttttcttttgtgttgtgattattgattacttcttatatttgttatctatgcaaacgctttgcacaaacataaagctgtcgcagttggcagaatttgtgttgcttctgtgccattgaaagtttcaatcaattggcatcactgactgctacactgcagctgtgcctgttcttttccatctagatctagaatcggatgtaacatatcctaatattataaatcggtactgtgttggttttttatgggacgaagggagtacacttcttctagctactaaatgctatatttttcttaaaaaactttctacatatatatttcttaaagttattattttaaatctattttttaactttataatagttaatttatccgtttgtacctctcgaatcattcatctattaagtattccattcaggtcaaaagaagacacccaattgaagtaaaacatgctagctgtatgatactttataatatatgattagtgtattttgcttgcacttggatgaaggggctattttaatattagaaaagattttgactaatggtgatgcctcgcttcgggatctgctcaaaatatgtttcttcttttctaaaaattgtttttgggtacagatggaccgtgtaaacagatcattgttcaaagccaactaggaaagtaaaataaaaattatttacatgttaaatgttaatgactagttattgactgctgatgaatgtgtttaacatgtgaattatatattatgaaaatatttctaataataaatctaaaagtataaattttatgatgttaaactatataagtttatagaaatctatggtcaaagattaaaatgttacttaaaataaaaacaatcctaggacgataaataatttgaaattgagggagtaccgtgtttgtactctagcagtctgactctaaataattgaacaatcatgaaaacttggccagagaacacaatccaataagtaaggcccccaagcttaaagttattccaaataatgtatttgactgatcattctgcaagcagtgaatatatatatatatatatatatatatatatatatatatatatatatatatatatatatatatatatatatatatatatatatatatatatatataatttatttggtgctctatggtgcccgggctacatgattcaaattgggtatatactcaattcaaatgagtatgaaatttttaaaatgtttaggtattaacattaactactttactaactagttcaaaacaagtttaaactaaatttaaacttgtttttgttagattttgattctaggtatataggatccaatcatataattagttgggtatgtaatcatggattgtgaaataaagttaaatttgagttgctttgtttataggtataggtatgaatcgaattcttataactaggtatatactcataatttaaaaattttgaaaaatttaagtgaatttttatattttataccatggtgccccatatgggtgtcctatatatatatatatacatacgtatatacgtatatatacgtatatacgtatatatatacgtatatatatacatacgtatatatatatacgtatatatatatatacatatatacgtatatacgtatatatatatatatatatatgaatctcaagtgaagtcaatataagaaaacgttttagaatcaaaaaaagaagaagaaagagaacatttcaatctgcaaatttccctcatgtacttcttgtttcatgcattccattccatgttactccgtgaacattcctgatcatccacactatttggcattgtatttctctgaccaatgagatcacgacaagtgcaaacgaaaaaactggcaacatctacatatgctctcccatgtgcattttgcagttttgactgcatcaatccatccaacacaaacactgtatatcttcatcttgtgctgccatttcagtttttaggagtggtcagtcctggcttgcacagaaaaaaaaaaagaccgtgaatggtcactcacaggtggggcctagccgcctaggaccaaccagccaaacccagcatgaggaaagccacccatagatatagcagcctacttacacataaaaataagagcttatcataataagataagacatgactagaaattacatattcagcttaccagggtttaagtcctaaattcagtgcatttttcaaaagaaattctaacactttccgaacgaatcatctgaaacaacacacctagaactctcatctcgagctggctcaagcgagattataaaccctcattggtactcgtgagcttccatttcagtttttaggagtggtcagtccttacttgcacaggcgaaaaaaaaaaaggccgtgaacagtcactcacaggtggggcctaggacgatccagccaaacccagcgggagaaaagccacccatacacatagcaacctacttacacataataaaaataagagcttatcataataaatgagccattggttatatattcagcttatcaggatttaagtcctaaatttgatgtatttttccaaagaaattgtaacacattccgaacgaaccatccgaaacacctgaaactctcatctcgaactggctggggacgtccaaaatccacgagactcgagtgagatctcgcgacatcataaaccctcgttggtaacagtttacaccaatttcaagacacgtgtataaaaatatgcacgcggctactacgaacacggtgcgtgtgtggttgtgtgcgcgcatcgtccagagcgaaaagtacactccataagagaggctggggattagatgataaaactaaaactaaacaaacagagcctgggctgtgggccattcttggcttggatttactgggacagttcttccctcttggatcaggaattcaggaggggggagcttttggccgaattgatcaggaaagatgcagctagctgcagcgttgcggtggaccaccggacggccggcgacgaccactggttgtaccgtggtgatggcatgtcccggcatgggaagctagcaagtgcatttcagatttttccaggtcccctcttctgctctgttgctgttgctgtgtgtgtctctttgttttttatgcttgttcatcggtcatatgctaagggaatcttttaatgctgatatatgaaggcccatgtgttagagcaggtacaatagcaggctataagcaagttataaacatattttaaagagataaaagaagatagagaagagcagcgggctacaaatctgtagccaactgcagcacggactccaaaacgtaatgcgtgtatgacaggtaggaccagacattaataatatagtaagaactattgtatgaattggctatagataaattggagctagtagttggctatactattaaacttgctcttagtgtgggtgggtgggggtggaagagtcttctctccaagagtaggactatcatttttctagtggttttatagggtttttcaccaatttattttttcacaggtttggaaaatagtttttcgaaatctaaaataggcctgagattcaagatactggggataaatacgaacttcattataggttgctaagtgtcatgtgtaagatagtatatgagttggcagctcttaaccacaacataccatgttgtaagctaaaagatttgtaaaataagattgttcacttttttttttagtattatcaaaagttcacacttagtaagataaatcaggtggctatacaggcatagatgccacacgaacaaacggagaaaatttttgtacattatatctagaagaggcagtatgttgaaccacatcttggattaggagggtggccggctgactcagcaccaacgagtgccattgttcgttgctgtaaaccgctcttacatgcttcatcttggtttgatggccacacaaatttaaatgaagatcaggaactgaattttctctttttatatataggtgtatgatgttgtgccctgttttatctaatcaaaagggtttcttaccactatgaaaataaactgtaaggcgcgttgatatcactatcaaatgcacaacctttttttttttaagagtgaacttcataaaactataactattttatcaaaaatgttagtatgctgaaaatttagctagacattttagagaacgacaataatattatataattttattagaaaacctcatctttacatctttgacaagtttgggtctcctgaaatacttgtgctcttgcatcccacatgacatacacacataggagataaaattatagttttgtaataaaatcgtccactattgttgcggttttgtaaaatacattcccttaaaattatagcaaaatgatagttttcatcaaacaattatagttttgtaaagtccacttttttaaaaaaaataatgaaactagtacatgcatgtacatctcgatggccagtgcattgtgtagtatttcctttaggctgataatccttgtcgttttagacaaggctattgttaaactaaaaaactttgactataaataatatttaaaacatttgtcaaataaatatggctcccatatgtataggttgatcttaaaaagtgctctgataaaattatatacttattgatatttctatatatatatatatatatatatatagagtaataaaaaatagttatcaaatttattttttgaaactgtgtccttgttcaaaatgataagtattattagtccggagggagtagtataatccaaagttcaaactctttgtttaatatagaaaaaccttgctttttgactgacatatttcctccgtcctaaaataaatcatcttatagagtttattttttttcaaaataaatcaacttctacattcttacctaccattggtctacaaataaaaaaaattatttcttcaataccctttacctatccacccatgcattaatataagtttataattaattaggggtatttgggtcgtccattttgggaatttaggtttgaagtatttgtggaacagatcgagggattatttctctagctatctagctaattaattcgattcattcatcagtttttatttgtagggataaatgagccatgtctgtactgcaaactgcaaacatggataggtcaaaaaccaaagtccacaatagctgaacagctagcggcgacaaggttccttccacgctatgaataagggtgctgcatggcacggcaaaatcatagtacgtaagtacatgctacatgcatattatgattgcatgctggttcacatgcggccattatatactccctccatcacataatataaaggattttaagttttttttacattgtttgatcagtcatattattcaaaaagattgtgcaaatataaaaaaacgaacagttgtgcttaaaatactttggataataaagtaagtcaaaaaaataataataattccaaaattttttgaataagacgagtggtcaaacagtgtaagcaaaaactcaaaaccccttatattatgagacggacggagtatatccgagtgcaacaagaaaccatcatatgattttttttttctttgtgatgaacaagcctgccattttttagtgctactttatttggggacaaaaaggttccaagaaaaaaaaaacatgagggaactaattatacctagtaccccaacaaagttagggtatgtctaataatagagtcaattatcattatttatcaataagttatgaaaaaaaaccatcgcatcgttatttacctttatttctaaaaaatgaaaactattttttaattagcacccgctggctaggcaatagcaatatgtaggaaggtccttatattgtttttccataaagctcctagcatattacagatttatggtaagtttatcgtacatgttggggtttttttttatagagacaattagacaaacatttatatgttatactcaaccatcattttttcattgtgtttcaactgtttctaagattaatttgaaggttaccactcatctagtttgccagagtactccaaattctttcgaacagtgagcctatatcttgcaaaaaaaaaaaaaaaaaaaggaaaagaaaagaggaccgctctttccagccttggacacataggatccacagtaaagtttgcaccccgagatggatctagcatagaggcggcgggatctcgagcttccactactggcgtgaggatagatgattgatgctattaacttcttgatacacatttgatcattcatcttattaaaaattacataactattagtatttattttgtcgtgatttgatttatcattaaagaaaatatgacttacattttcaataaaaaaattaaataaaacgaaatgaccaacttatgtaaagaaatcaacagtatcatctatcaaaacagctattgcattttggtcatcaatatgcaactgggcattacttaggacatcaatgcaagcgaagagaaacacagctagctgccgtgctcattgcgtagtagagtaactggccattgcattttggagtaaatggattgatataattttttaaagtaattctcatataaaaaattttgtaaaaaagcattatttaataattttaaaagaaaaacaatgaaggtgaattggaaaagaaggacatgaagacacggaccattatatcttgtctcacttgagcattgcagccattgtgtagctagcaattagctaggcattcaggtttgcagagtaacaatcatggctttgatttgacacggcatctgtgtcatgcgtgcttttcttttaggactgacggatacgtgtacggtatacgcttccatcaccacaactggctacagctactactgtgtatcctacgcgtgtgccctggacagacagacacaaggcatgtctcggataggagtggctgcgttcgttgccttgaacttgagggaaattttctcgcactccaaacaaaagaaactcgttatcatatgattaattaagtattatttttttattttatattaaatttatttttagcttctttcatttatcttaaaataaatttatttttttaattattgaagaacttttaaaattacagaataattatatttggagtagataaagtgatcaatagttgtattgggatttgattaaaataggggtgttctagtctttttctgcaaatacactatccgtcctaaaatataataatttttagccctcagaatttatcccaaaatattaacaacttttccaccaacattctcttcccaaccaatcacaaccctccaccattcacttttcctatctacctccacactccccatccaatcacaaccctctaccattcacttctacctattttcttaataatcatgtccaactctaaaactttttatattctgggacagagggagtagaacataccatttcgtctctccacattttatactcgtattgcttatatactacttgcagagagtaacttttgccggtctttcaattgatgttcttgaattaatacacggatcactctggtttaacactttcaggagaagaatatgtgtccatctcaggaggtcgtgcccatgttaggatggcaatttccctattggaggtaggtacccgcccctacggggacgggacggggctggttttccacccgtgggttggctggggacaggacccaccacatttgcgggggcggggccggataaagggttccacccaccccgctagtccctgtggggcccgaaattaagataaggccaaccagaaaagcccatctagtccatgtaggggatgataaacgcgaattcccaatcccatccagcccccacacatgcaaacgcgagcactcgttcagacttctaaacgcatgaaggttgtggtgttgactcacagaggtcctcttctcgcgattgcggcgcagcgccagatgcctgcacctcctcgcatcgccggcatcttgctcctcctcgcgctgctgatatctcactactcctcgcgtcgccgacatcccgctcctcttcgcatcaccggcctctcccttctccttgcatcgccggcctctccttcctcctcatgacgccggccaccttttcctctttgtgccacatacctcctcgctcctcttgttcctctcccaactaagtcttcttcttccaatggcagagtgagtgacctccagcggggccccggtcaggtagcattttgtacccaagttcctcttcggggctggggccgggggatgaagtcaagggttagggcagggtcgttcttgcccaacccagccccgaccgaccccattgccattcctaacccacatacggctcatctatgtattgtccttgccaaccgagcatacgcatggcctcaggcgcatgggacctctgctagtgggcctcgagaagctcaacctcctcgttgtggcaggtctcaccctccctcaccccctccccctacggcacagatccactagcagcagcgatggatgggcggatccggcggcccctactcctcctgcatggatccaacgacttcgagcgaccatgacgacaacgacagtagcctcaagtgtgatggtggtggatcctgacgtgatggcggtggcggcttcaacacgatgacgatgcaggggatccggtgtgatggtggctagggttttgggttttggatctatggtttttgtatttttgggttttgcaatttttattttttttgtcaaaattatttttgtagattgatggcttaagcacctgcctacgaaaattgtattttttttcgcaagcagttgcgccaaccacatgcaaaaatattgattttcgtaggcatcttggtgtaggcgggtcacctagccgcttgcgaaaattggttttgaccgtattaaaaatttgattcctatagtagtgtatgttcagcactctcctttcacgacctctattctcttgtttttcacgtgtacgctttgcgaactactaaatagtgtgtaaaactttctataaaaaagttattaaaatatcttattaatctttttttatgtttttagctaatacttaaataattatatggagtatcggatgtgacacattttagtactacaagtctgaacagactctaaacatattaaaacatattaagacatgtcatatccgatcaaagtaaatattttgagacagatagagtattatttatctattgtgcatatatgtattttatatatgttgatgacttagcaagttgacaacatttgtgtccacttgtatagaaacgctatacatgcataattaaggctgtgtgtttggtatttcggtttggtaactacttgaggcacataaaataacttactattgttagtgtataattaattaatattagcctaaaatataaaaaaagattaatataatacataaataatttctctatagaaaattcttgaacacgcttagtagttcgcgaagcatgtgtatataaaaaaaaggagaaagtagatgttgataaaggagagtgccaaacatctcgcctacgtgtccaatgacatggacgcctagtttatttcaatttgatcgtgcataatactccttccgtttttaaatatttgatgccacttttttgaacatatttgaccattcgttttattcaaaaaagttaagtaattattaattcttttcatatcatttgattcattattaaatatactttcatgtatatatatagttttacttatttcacaaaaaaattttaataatacgaacggtcaaacatatgctaaaaagttaacggtgtcaaacatttagaaacggagggagtatgcgtgaaggtcaatctactctcggagtctgattcttttactgtatactagcattgtcttttatttatatttatagtaatcattatattccgaaacctacatacgtattttatatggtagcgatgcgttttgtatttacataataattctagttctttatcggagcaaatatgttggctccagtttttattatagaaactttgtaaattgagcctttcccatacaaaagcttaatttatacacgtgaactttttcgaaataagatttcaggccacgcgagcatcgacgtgtgtgattccgattcagcttcaaactttcggtgtcaaaaaattgtatataaaacctttgcagaaagtttgcatatatatagaaacatagattgcgcatacacacaaaccacgctaaacacgtcctcacgcaaaaaaaaaaaaaaaaaaaaaaaaaaaaaaaaaaaaaaaaaccctcaaaaagaccgcaaaaaaaaaaaaacacgtcctcacgcgccacgtctgtcgtctgagcaaaggttgacacattaaaactgctccatgtacattaattcattcccaggagaaaaagaaaagagatactccctccgtattttaatgtatgacaccgttgacttttcgaccaatatttaaccatttgttttgttcaaaaaattttttgccaatatgaaaatatttatgtcatgcttaaagaatatttgatgacaaatcaagtcataataaaataaatgataattacataatttttttaataagacgaatggtcaaacgttggacaaaaagtcaacggcgtcatatatatatatatatatatataagttttttagctaatacagtaaattatcacttaatctattatataaggaaggagtacatcctaatgtgcccagctctcagcattcaaacacgaaataaataaataaaactagtcatgacaaatataaagctgccagatataagccatagcttacgctagatccataccaaaaataaataaataaataaatactcctatactccttacaaacatttataaaaaggtatggaaaaaaaatagagagagacaagagctgtgtttgtgttgtgtcgtgattggtatttaaatccggaaaaagggtccagccactacggttttattagttggcgacaagccaaagccgcaaccccacccccgacgtgctcctccgccaccgccgccgccgccgacgacgaccgccgcctccgccgcgatctctcgcctctcctccctccctcctctgtacgcagtgtactactacggtactaccgccgccgtagtactcgctggtgttggggagcggccggatggaggcggcggctgcggctgctgcggcggcggaggcgcaccaccacaatctacacgggtgcctggccgtcagggcgccggtgccgaggtgctcgctcggcggcggcggcgggggcggcgcggcggcgatgggtggatcttctggtgaggctgtctctctctcctgctgcgctcgcttgtgcttccattggcttctctggttttttttttcttcggttgcgatgtagtagtacgacggttttggtcgcctcccacctgcttgtgttattgctcgtgtggctggcggttgaagtttcttagtttttttttctctctctctctctctctccgaatttttgttttttttactcagaaaagggaagtttgatgcattctaggatttctttttgggggggtttatttgtgcgtcagaattatggggagatttttgcactgttccaaatgttgtgctgttcttgctggagtttttttttttttttttttggttttaccttccattggtgctgttcttaatctactgtgctcttgaacatttttctttcgattgatgctgctttcctctgctcctgccgttctaatccagcattcttgtattttatactatacattttcctttccctttttcacctttcttagaacagttccagtatctttggccactggtgtattctgatgatttttgtgatgttacctgaatatctcaaatttttatttttttttcttttttcattgacaagaagtcagcactggagacccaagaggaatcttataaaaaaaaaagctcttggtattgtcaatttctgtacttgctaccgcttttggccacatacttgtttgtggtggctcagagagaaagttgtggcataatcacacaaggaagctaatcattgatcttgtccttttatccttttgggtgccacattgctaacttctgtgcaattactcttcttttcggtattcgctagatttcaggcgcccgaaaatgtttcgatagtatctaataatgtcgcgcttcattgataatagtatcgcaacaagggactaattatctgcttcaataattatcagcacttaagtagctggttagtagattcacttgctgtccttcacctccttttttgtgctaatttcggtactaaatgatggcacctttcctctgtgttcttatcttggctccaaaagattgatatatattgatatgatatgactaaaccacatcatcaaccgatgttgattgtacagttgcaacatcaaaaaaaatgctggaccattagcttattgatgatggtggcaacccaactgttgcttttgcttttaagctgagttttggttgggttcatatgcgcctaatcttatcggttggaggcagcttagctgctctaatttggtgagaaatattggctgtgatggcatatttgttgggcaacttgagtagtgaccgatgagaaagctgcagagagaggggcatatatgataatgatatatctctgggttaagaacgttgtcgcctaacaccatgtgggaggtatcagtttggtcggctgcaaaaatgcttttgccatgtctgtcttatcctctggtgatagatccactggcttataaatataaataaggcatttgtaagcttgtttaagatggcataagcaaaggtttgtgtgtgtcagagtcactaggcctagctagctccatcagttttggctctgggatggtgctggggcagcttgcactgtggtccaagattgccagttcagtaatccttgttttttttcaatggtttaatcttgcctctcttttttttctttttgttgcattcggaatgcagatgttaattatggtttggtagtgtatattaatattattatattggtgatttttgccttgatagttttgaaaagtttgccattctcttctcttctttggtgaatatgtgtggtgtaatctgatacataaaagggattttttttttggtgaatcttatgagggaatgtacctgttcttgtgcagatgaagcatcctgtgggtcaccaagatggatagggaagagcctctcttgcgtatgcatcaagagaaaaggagcctatgagagaatatgcatgaaccttacaccagtgcaggtatgggcttgcgagatatctttactgtgcaaagatttgcaatgcttttatgccaatgtgcacagacagggcctttttctgctgtcagaaaaggatttatctgcagatcaaatcaatcaatagataagcgggcctgcttttgagtaaagatcacatcgcttaatcgcagactcgcagtgaccactcaaaagggattgtttaagctttggctttaagttattgtttttctttattcatggatattagtttttttttcaatttcagtatgtggtctgaccactgacatcagaaaatttacatttcagaacttcctttgaaactttatctcttcatatatatcactaatacagatagttaaaacaatcatctcttccaatttacaggaagagaggcttcagaggctgaggcaccgtatgaaggtttattttgatccttctagacgagatcatcaggtaaatcttgtactagcaataagccaataaatgaattcatacaatatgttacatttccctctgtctaactgcagtgtagatgtagacttgctatcacacactatccaatgctgtagctgtagataattattttggcactgaacatgatcagcagataaaatcatgcataacaatcagtgaactcctcagttttggtattgatgacactgatttgactagagtaccacagagttacatggtagtaacatgtactcgtatactttgatgtaagtttctttgtattgatatcacctgaatcctgataaatagcaaattatgatgataggaagcattgaaagctctttggcatgcaacatatcctgaccaagaactacaaggtttgatttctgaacagtggaaggacatgggatggcaaggaagagacccatcaactgacttcaggtactccaaactaaaacttgccacctgacagattagctccaaaaatatgttcagctggtgtgaagttaagtgaaaatgcactacatggtgcagaggcgcaggattcatatctctggagaatcttctattcttcgcgaagacattctctgtaagcaattcttcatcattgctttcattatctgaaacactgtagactgaagatcgccctcttgtttaatactgatcttctttggttggttaatccctgtaggcctcatttcagaggctgctaaagaaacaatgtggcaatcgagctacttgggagtacccatttgcagttgctggtgtaaatatcacattcatgatcatgcagatgctggatctccaatctagtaagcactgacccaattctgccagtaaatccagtctgtggaccgcagttgtactaattagacaataatattgtatgcagctaagccaagaacgtttgttcgagctgtttttatccaaatgctgtcaggtagggccagttaagtaaatacctttcctgcatcatacaatataccaacattttgaaacgaatttgtccttgctttgttcccccagaggatgagtgggcatttgatctcctctactgcgtcgcgttcgttgttatggacaagcagtggctcgacaagaacgcctcctacatggacttcaatgtaattttcctgtcaatgtacatgccatattttctccgtaactcatcagattgcattgttttgaccgatcttgcgattctgttgtgattcaggagatactgaagtcgacacggacacagctggagagggagcttctgctggatgatgtgatgcggatcgaagacatgccgtcatacagcctgctctgctagtagtggccatactggttgaacaatcatgattgagtcaatggttctgacctctgagtgtatagccccctcccttttgttgattccagggaagggaatttttgatggcatgtagagcaatggcctcctattgtcatgctgaacttgtcccactgtaaacaactcatctgggcatcaccacaatgaattagaattgctagcatccaatgtcaaagctggtgttaatctgtcatattttaccccatggatgtaacaacagaatcaacgagtgggtaaaatcaacttgcaacctctggtgaatggtgttcaatgaatcctcatttccttacttaacttgtcaaacttttccgatatgatgtcagccttgtcaacaatcctctgttcatgaacagaaaatcagctactatgaaattgccaaatgctgatcagttctgacatgctatgaaattgtcgtttattcttccaatgccgacgtcagctgtcgtcgccggccaccgtgctggagccggggatcttggaaagccgcgcccgcttcatcaccttcctcagcctgtccacgtcctgccacctcccggcctcggcgtacatgttggaaagcaccacgtagacgccatggttgccgggatccagcttgagcatctcctgcaccgccctctcggcgacgtcgatgtcgccgtggttcttgcaggcgttcagcagggctccccagatcaccgtgtcggcgtcgcaggtcgtcatgccacggatcatctcctcggcttccgtgaggaggccgctccggccgaggaggtcgaccatgcagccgtagtgctggatggtcggcgccaccgcgaagtccttctccatggacgcgaacacgcggcgggcctcgtcgagacgccccgtgcagccgtaggccgacaggacgccgacgagcgtggcaccgttcggcggcacgccgtcccgcctcatccggtggaacgtagcaagggcgacctcgccgtggccgtggtgcgccagcccggtgatcagggcgttccacgtcgccgtttgccgctcgggcatccggtcaaacaccgccgtcgcctcctccatggcgccggtcttggcgtacatgtcgaccagcgccgtcccgaggatggcccccaccacgggcgccgtcacccgcctcgacttcatgagctcgtgcacgcgccgccccatctcgagcccgcgcgaccccgaccgcgcgcacgacgacagcacggacgccagcgctgcgccgtggggctcgatcccgtcgccgaccatctcctcgaacgaccgcatggcgtcctcgtgcatcccgttttgcgcgtacccggacaccatggtggtgcacaccaccgcgctccgctcgggcaatccgtcgaacaccctgcgcgcgagggggacgaggcccgcgagcgagtacgcccggacgaggccgttggcgacgtaggcgtcgcgctccagcccgtgcctgacggcgagcgcgtggagctgctcggaggcgcggagggggaggcgggcggatgccttgaggaggaaagtgaaggtgtgcctgccgggagagtacgagccgccgccgccgccgctgccgcggcggaggagggagaagaagcggagggcggaggccgggtcgggggaggaggcgagggcgcggagcgtgatgttgagcatgaaggagtttggggcgcaggggagggaggcgaggaggcggagcacggctcccggaggggagagcgcggcgtgggcggcgaggaggcgggacgccgcgaaggcgtcgtcggcgaggcggccggagacgagcatggccgcgtggacggcggcgagcgcgcgcggggtcgcgcagcggtcggccaggagggacaggttcggccggcgccggatgccgccgcgggcgcccacggcggcggcggcggcggcggccattggcgtcgcgtgcgtcgccacactgtacacggaatcctcctctctgcgtcgccctcttcccaaaaaaatacgtatatagggcgtgtttagattaaaaaaattttcgttaaagttccaacttttccgactccgtcacatcaaatgtttggatatatgcatagaacattaaatgtggatgaaaaaaaccaattacacagtttacatataaattgcgagacgaatcttttgagcttaattacgctatgatttgacaatgtgatgctacaataaatatttgctaatgacagattaattaggcttaatgaatttgtctcggagtttacatgcagaatctgtaatttgttttgttattagtctacgtttaatacttcaagtgtatgaccgtatacttaaaaaaaaattggcacacgaactaaacacaaccatagtatcagattttaaacaacaagtaatatgattttatgaatttagatagatcatgaatattaggcatccatttataactgatggattttactgtaattttgtaaaacgtccatataaatccatttaatttgtgttcaaattgataaaatccttcatctcctagaggaagccagcaaatctagttgggtaggaggcagtatggaggttaaggcgttcctaaggtgtcgacttgatgtccttgagactgtaaagtgtcgctttaggatatactccaagttatctctgaggctctaaggcatcgcaccaaggtaagacagcttgaggcgacacctgggagtctcgcgctctatatcgctagtgaaaaaattagctttcgtgaaaagaagtttaagtgaaaacgagcccatgcactataggaaacatagagaggggcatctagcaaagcaatatgacatttggtgactttgctccctccccttcacatctgacagtagcgctctttgcatctggcaacgacgtacccatctctttcgatggtggagactctcccctcaacgagtactatctcctctcccccttcatcatctgctgagctactcctttctgttcttatttctatgctcttctcttcctcaatgctcatttcttgggccctccgttgctctggtgctctccctcgctgctcttggcttcccccctctccctaactactcttggcttcctagttcctcccgcttccttaactatttgcttcatgtgcatttgatgtagtacatagaatactgttgatgttattggttattaaaatgctaaattattatacccatctaacacttaaaatactcattatatcccaaaataaacaaatttagtactggatgtgacatattatagtactatgggtgtaacatgttataatactatgaatctggataggaggtttttcaaagacaattcatagtattaggatgtgttacatcccatactagattagtttattttgaaacagagagggtatgtactactatcagggctcaacaatttgcagcaacaaggtatataaagtgttgttaaaatgtagttatattacactatatttttgtggtcatattatattattaccattataggctgctttcggctgggctagctgccatagcggctgcggctacagctgttgtgaatggctgtagctaacagccgttttaaactatcacagtcgctgcggtagcaggagcaagtgcctccgaacaaagccttacctccgaacagacttgccaaaccactctccaagccgtattttaacaaaagtaggaaaaaatgccctccaacagcctctctaactgcctctccaagttatccaactggccaaaatacgcctctccctggccaaatctggccagcctctagctagccaccccagcttgccaaaggtgggccccaccctttttcaccgctccatcccaatttcgcagaaaatcaacgctccctgcactcgtcgtcggtcagccacctaccctcgccatccaccgtcgcgtggacgtcaccgcctcccctcgccgttagtcagccgcctgcccttgccgtccgccattgcgtggacgtcgccgccgcagcaaagggagaggggtggggaggagcttgggaatgtctcgccgtcgccgctcatgacttcagtcgatcattcccatctctgaaatatagagagggtgttgatgtccctgtcttgctttcatcacctgcttcaacccatcgaaaatcccccaaaaccaagatccccaattgctcgaaagagaagagagaaagaaacaagaagttgcttgaaagagaaaacgagaggcgcaaacaagaagggccactgccgccccgtcatcgccgtgcacggccaccgccaaccgccgcccgtcgctgcacacaaactacatctgccgcaagcaaaaacaggcttagggaatagggggagcaaggtgaggaagaaagaagtggtatagaggctgacgcgtaggtcccgctgtcatagactctgaatagagaggatgaatggagagatggttggagatgctctaaggatgaattgactagccaaattaaatggagagttaactaaatagatatttggcgtccgatttaaagagactgttggagatgctctaaggcgtgtagggccatcttacctcgccttaacgcctttacaaccattggaagcaggatttactgaaataattgttttccagtactatgcatgatgtcggtttcaggtgtttgcaaacagaaatgtagggttagtagacagtaaacaaaataagtaacaactttcgcaacaacaattttattattcctctttgctaaaaaagagctacaaaaccgtcgacggatggcacaataatgcaacaatatgcccacatttacaaatttatttattttgccaccattccggattttccatttattatttgcattgttcttacatatgctaggtagctcgccatcaaagcactcctgacattgtctttgcgtaccttcttcagatctcactaaacgacttgatagtccggaaaccatgattctcagggagcggtgcatttcccgggcgaatggagattattacctcaaaacctgaaaaagaaaatgtcgggaaagaaaaatataatatgaaatcttgacccaaggaaacgaatgatagcttgaaatgatcacatgattaggaatggcacccagagaggtcgactggttaaagctaaagcatcttatccaccaaataaaagcatgaacattcccatgaatatttgaccagaactagtcattacctgcactttttgcagcaacagcttcttggaagacatcggtgataaataagatctgagcaggactgtccaccccaagtgattgcgaaatctcaaagtagctccttgtttctcttttgttactgcggtttatgcgagatggaatcataatttcactaccatttttcagtatatgcagagaaatagaaatggaacaagaaatcatacccggttgtggtgtcaaagaaaccacagaggtattgtcgcagatcaccataggccgtattgccaaataatagcctttgcgcctcccggctgccacttgagtatatgtagacctatttgcaggtatattatttgttatcatgtcatctaatactaatacacctttttttgtattttttgcaatggatgattcaaaaatttgaaattgatattgtttagcactatctagggtcaacgttcttgacccaagttggcagctagtaataactatagtaaaccatgaaaacatattaggagccatgaaaagtttaaagttcacacttccacacgaatttgactaaagagataccttcatgccactagcatgccagtgctttagcgcctcggggacatcatcgaaaacaactccttgcagttctttactttcaaaaccagtcctccatatgtggccctggaatttgcattaaaaatgctgaaatccatcaaagaaacaggaatatgcttgcagcaccgaaaaagaatgtggactaatctacctggagttgtttcaacgacgtaatcttcctgtctgctttaatcatcgattcaacattagcaactaatgcattgataacctcttctttgtcagcatcgtcaggtggaattggaacagacccaacaattccatttttcaggtcttcttcaacctgaataatgaatgctaatatgttatatcttgcataaaacagagatgggcacattcacgtggcctagtggtaaaactcatggttctggtggtgaggactccagccactttccaccatggtggtaaaacagttaactacgtccacaaataggaagttgaggaaccaaaattggtatggtaacttagatcaaatctaacaattcaaaacaaaataattttcacagggctaatcaaatagtatgacttaaataccatcgacaaatacttagatggta

SEQ ID NO: 61232 - DNA, 726 bp, Oryza sativa
  unsure (1)..(726): unsure at all n locations
agaggggtnatctagtggtcctgctaattcagattttgttttacacacccatctgtgtngatccagagcatagaatattatagtatgaattgagacatattcttttttgttaattgtgagatgtagcttggctggatctggagaatggtacgcgattttagaaatttagagaacaatattgtagagaatgtaacttaaggcgtagtacagaaatgcgaggttaacgcagttattgttttcatcaagcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttggtgagaggatttagaatagaccaagaagtctacacaatgtcagtgtcagttgtagtgagtcgtgcaacaaaaggttatttttggggactaatgccgatggacagcactaatgcttggaaacggtatgtggaaatggcttttgaacggtcatggcccctggtaatatttgtgtcggtacaagagaaaaatataaatgtttcaatgcaacccgaagatgtagagggtcctatcaagtgcagggaatgttgtgtggaccatcgatgcaaaatgaggaaaatcaaccaagggaggagcagactatgggcatggcggatgaaggggagaag

SEQ ID NO: 61233 - DNA, 3115 bp, Oryza sativa
  unsure (1)..(3115): unsure at all n locations
acccatttacacatatacatatatactccatccgtcccataaaaaaacagcctagtaccgaatgtgacgcatcctaatactacgaatctagatatacatatgtttagattcatcgtactataatatatgcaaatatatatatgttgcctctggtttcgaatgtatgtaactgttggccagtacaacaaaaattttaactgtgaacatcaataaacattaaatggttatacgtcatgacatatggaagttttatggctattttgtttattttttttaaacaaaccaacgttatataaaaagaaaaaaggtatatttttttctttaatatatgtgtccatgagatgagacgatgacctcttcttccctctagctggatgctgatgtttccattgcgatgtgccctagctatgtgtgggggagggaagggagggcagttagtagctttgcaagctagctgatgggtggataggtcatggtaatggcaactgctttcattagaaatgaaatgaaagaaagaaatcaagaaagaaagaaatcgagaataaaaaatattgagataggccaagatgaggtgtgacaggtgcctctcttgttggtgccttgccatcctatcccatgttgacgactcatcatcgatctcgatcttgtgtccgctttgactttgtgttcctcctgttgctcctccttttgcatatgtataatccactgcaaaattaaaatatagctgtgtgtatatattagcatatgcgcacgtgacgtgacgacgtctggtttttctctattccttccttgatgttgttgtcacgttaattttaataatttaatggttcttggtgtacttcctgatacctctaaattcttttgttggtttttattatatctgcgtttgtgcggtaacttcttgaccgcaaaacaaaattgaagttatccaaaatctcgaaaatttttaaaacacaaccatacggatgaaaacatactgatactgattggaattgaacccgacagtaattctgaaaacattaaactatatataaaaaagcacgtatctaacttaatatgactatattatataatgatataaatttaaagttacactatgtaaattacaaaatattacccctttagccatatactcaaattagggatttggttgagtagttgatggaccactaaagtatgggccaaatagtaacatgaaccacagatactgggtatttagaaatacagtaactattgtattgtagaaatagtaatatccataaaaaagtaaagacaatgaaatggttggtagaacagttccgtttctatatttctttaccatttatattttcattctgtttggttaatattttcatataattcctttggcaagagttaattgaaatccaccacaattttgatagggtagctagggacggaatatatatatgttgctcgatttgataggaaaatttgtgttatgagcatatgaacattgattgatgttctttttttgttcagagaattaaactaaccctacatctgcatgcttcactagagaatattcttcgactctaaacttgaactttctcatttttcgttagtatatggttttttgcaaaagtttttttttctaaatagaagttgtttaaaaaacttaaataatttttttaagtttataattattaatacttgattaatgtgctaatgagttttctcgttttgcgtgcgctaaaattctatccccaaatgaggtgatcgaatggagctttcaaataaaatctctcatggtccctcaataaaaaaaaaggtgaaacttgccggtaaaacgaatttgaaaatctccagaaaaccactcacctcatcacctatctctgttaatttctgttttgtttggcttggctttccaatggagaaaaaaaactaaacgaaagacaaaattgtaggatcgaaagacaagaactaagccaaccagaggggggtgaatggttggtatacccaaaaaccgaaaacttttagcggaaataaaagttatcctcgaaatcgacggaagtcggtctgaccgagattgatctaccagtctgaccgaagcgtacccgccggtctgaccagtgttgatcttccggttggaccgccctggaatccctgtcgcgcctgttgtcaccgcgggtctgaccgcggttcacccgccggtctgcccgtcgcgatgccgccggtctgaccgtcggtgtgtcaccggttagaccgccgaaaccgggcgaaacacaaatcaaagaactctaaaagtggatgacgactttattgattctctcggtgttaacaaagtgcaccaatagccctccttagaaaattttcgactaaactcgaaaccctaactcaaaactcaactcaattgctctccaaagcgatagcggaaagaacacttggtacaaacgtacacatcgtgctcaaaaaatccaaaagaaaacttatccccctttttaaaagaaagaaattcccaattgaaccaaaaacatgctcttctcaacaactctccaaaaattcaccttgctcacattacttctcccccttttgacaatgatttcatcaagcataggaattatgttcattaatgttcaagagcttagtacacatatagcatatcaagtcatgtgttgcaataaaaagaagataaacccatctataatataacaagcatgcattaaagtataaccatgaaccaaagattttacaattaagcttgaatcaacaatcaaaattcatgatttcatatgatttataatgcaacatcttaacaagcacataggttgaagaataaacactaaacacatatacctattgcatttatcactctttctcaaataacctttagcacaaaataaccaagagaatttttttaaccttttcttttcttgagcctttttgctcatatttttctcttttattccaggtacgtccctgtcgtcaagactgtttccagggattcggctccaattattttgctcacatcgaatacgtccttgtcgtcaagaccgtttccaaggattcggtattcatttttttcatatttttttattctctttttcacaatgggtaccaaggtgnttntccattgcaagccgaattcaaaccatcg

SEQ ID NO: 61234 - DNA, 973 bp, Oryza sativa
  unsure (1)..(973): unsure at all n locations
ccgccatcggcaaggcaaggcaagncggcgtgagggtgttatcggtcaaagttgaaaggggtgacggccaaatcggccccctagcccagatctggccacccctgtcctagatgaaggtgcccggtgaccaaccatgggggtggccgctggcagagcagtggtaaaactggtgaaggtggagttgtagggctgccagtgcaggagttgtaaggacgggggaggtggagttatagttgaccggcgagttggggcccggtagaggtggaaataaagggggattgatgaggtggagaggtgctgctcgaggtagagttggccaacgagtgcagggctaacggaggtggaaatagagccttggcaggcaatgtgtaggtggccagaagaagtggagaagcagacacaggcccgccggtttaggaggtgcaagaggcaaggcacacaatttggcactggcaggaggaggctggcgaggtggtcggcggggtgtagtaggtgccggtaggtggagttgccacatggagaggctgttctttggctgatcgatcgttcgttgttgcaagtttgcttgtttggaaagctgcgggacacgatgaacaaatgtgtggtcagtgacctggtcgacggcaagggatccccataaccggctgaagttctcttctcctgttccttggaaccccttcccttctttgactagtctgtttctagactccagtcaaggggtgcccccatgataaggagagagacgcgggttctgttggagggtctgcttgtagagaatacgatgttgtcaatctgtttgggtttgaaagtttttgggcagcgagggtgttgtttttaagttggtggggcatgaaactcttggggacaacctttggttgtgatttcggagggagttggatctacttgaccaggtatgacaagcttgggataataaacccttatttttatattttggaagcgtcaagggggttgg

SEQ ID NO: 61235 - DNA, 92798 bp, Oryza sativa
  unsure (1)..(92798): unsure at all n locations
ctattagtttgcatcagaagaacaatcaaaagaagccgattgagtttgttaaatagctccatgtgtttcgaatgcaatgataatggtgtttcactcaacatattgatgtatattgttttatttcaggtatttgttcaatatccataatcagaggaagctgtgccttgagtttgagtatttagcctagtaggtttagaagcactacagaaaagtaatgtcttttatcaggcgagcagacccgtcaaccacttacgcagataatctttacatacataaatttggcactccaaattcaaatttcgctgcacgaagatatgcgtccgacacacagctgttccgttatgggcctgaaccatacaatcctgagaactccttttacaatcaacaggcctcaccaatgccgtacatggtaacagctgatggccattctccatcttctgcagacaattcctgctcagatgtggcaaaagactcaccattggtgtccaatgtatctcagcagaattctcagtctatatcagacaatcagagttctgaacttgaagtagagtttgatgaagatgatatcaggatgaagcttcaggagctggagcatgctttacttgatgatagtgatgacatcttgtatgagatttcccaggcaggtagcattaacgatgaatgggctgatccaatgaagaatgtcatactccctaactcaccaaaagaatcggaatcaagcatcagttgtgctggtagcaacaatggagaaccacggaccccaaagcagttgctctttgactgtgcaatggcattatctgattataatgtagatgaagcacaggcaatcataacggacctccggcagatggtctcaatccaaggggacccttctcagaggattgcagcctatctagtggaaggtcttgcagcaagaatagtagcttcagggaaaggcatatacaaggccttgtcgtgcaaagagcccccgactctttatcagctttcggcaatgcaaatcctctttgaaatctgcccgtgcttccgatttggtttcatggctgctaattatgctatacttgaagcctgcaaaggtgaagatagagtgcacattatagactttgacattaatcagggcagccagtacattacactgatacagtttctgaaaaataatgcaaataagccacgtcatttgagaataactggtgtggatgatcctgaaacggtacagaggaccgttggcggtttgaaggtcattggtcaacgtctagagaaacttgcagaggactgtgggatatcttttgagttcagggcagttggtgctaacattggggatgttacacctgcaatgctagattgttgtcctggggaagcactagttgtcaattttgcattccagctgcaccaccttcctgacgagagcgtttcaattatgaatgaaagggaccaactccttcgaatggtgaagggtctgcaaccaaagctcgtcacactggttgagcaggatgccaataccaatactgctccatttcagacaaggttagtgatgtaaaatatcttcttaattctttagatccactttagaatgttccagccaaagcttaccttttatattttgtctaccaacctgtgaatgtactttcatcgccaactactgactccttatgaatcatgatagcatcaaacatctgaaacatttcacctttggtaggttccgtgaggtttatgattattatgctgcactttttgattcactggacgcgacacttccaagggaaagtccggatagaatgaatgtggagcggcaatgtcttgctcgtgaaattgtcaacatcttggcttgcgaaggtcctgatcgtgtgaaaaggtagttcccagtgctattttctacttatacagtccactctcttctttttttttccctgaaaacatgcccaacctgcaactcccaaatagctgaccgtgaacttatttatgctgcagatatgaagttgctggaaaatgaagggcaagaatgacaatggctggcttcacaccatgcccatttagtagcaatgtcatcagcgggataagatcgttactgaagtcgtactgtgacagatacaagttcgaggaggaccatgggggacttcacttcggctggggagagaaaactctaatcgtctcctccgcatggcaatagagcttacagaatgagttggcattagtcttgctgttatttaggagcatctgatgcagagactgtaaanaatgtgaaccactgaacttgtcaactgatcttacctaatcgtagatgtctgcttgtcagaataatcgagttagttgaactatgttgtattagagaattggcacatgatcgtgttgtattctggggtagaattatcttgtcgactctgcttcatgtataaaattatgtgttgctagaatatgccatatttatcatcttgggagcctaaatggtatttgagcctgtgttatgacaaatcgatcgcaaaatcttatcataaatccagtcatgaaaaagaaagcaagctcacaagtgttgcttacatagatcaatggaaatatttatatataccagaatggcagaagaaatcatttgtttatcgaacagaccgatcctgtaaaatacatcaattttctctacaacatttgaaaattgtacaatgctagtaacttgtataagcttaaaagacaatacatcgatttttttttcctggagggacaatacatcgattttctctacatcattttgaaaattgtaaaataacatgtaatctgggtgaccagactctggtagtttctgagagtatgaatcgtgaacacaatatgctatacatgatatgtgcatgtcaatcttatcttcagtggaaagcacaatcttatctgctaggtaaggtgtgccatgtattcaacgaactaccatcactgccaggttgcgttttcatgcgtttagtggattccaaaagtccaacaagggacgggagaggtcgtgggacagggacattccttgatctgtacagcctcttcaaacttgcattcaagcatttcgatgatccagtaacgcacaaggtacccctttcacaatctgttgtttcttctcctctgaccatgcaaaggtttgaactttcagcaagatttgttgattctgactctataacaacttcagacttttcaggtttatcagccaccggtgacaaactgcactcaccaataggtgaagaccggattgagagtttttctaattgccttggggatgcagcacgctgacaatcatcttcagatcctgaataaccccttctgaccatgcaaaggtttgaactttcagcatgatttgttgattctgactctataacaacttcagactttttagggttatcaaccaccggtgacaaactgcactcaccaataggtaaagacaggattgagcgactttctaattgccttggggatgcagcacactgacaagacgggtcctcatcttcatatcctgaataactctgttgggacttcgatgcttgcactatgacaaaatcagtccgtgaatttggacatgtttcaacttcactgctaccatcacagatcaaatatgctgttgaatatgccctggcttcttcaacagcaatgcgctgattgcacagttcttctctcattatgtcaatttcttcagagccaaatcttgctcttccaaacagtgtaatatctggttcctgaactggaggggatggcatgaacttcagttcaagcgtgcagatatcaaagtctgtacattcttcaccactaggagaggctgaatgatcatgatcatcatcgacagaaatcgagtgatcttcatttgtgtgcgtgtcggaatccagcaatgtagaaggggaggacactgactttcggagaggattcttgaatatcttccacagtggatcatcagcagttaagcaggtcttgaaacattttttctttacatagctcaattccatggcaaagcatggtggtgttgttgaaattacccattgaggctggagaagttccaaggcctgttctaactcatcacgagaggaatggatggagaaacaaatgtgccagaccccacaaccatccagcacagcttctgttaggctaggtttctggctttgagcacagtgcgcataccactgtgttgagggacggataaatagaggttcaggctgaaggctagcccttgcctcttcaatctttgtacatgctttgtcatacaagttttggaatccaagaatctacaaagtaagaaagttgcaaatgaaaaagaataaaatgaacctctccatgcaaaacatagcacagaccagactaaaatgaacctcttagatcctgtactagccaaggttgattataatcctgaatgtactgttctgttctagcaaacaattttagtatgaaatgtagatagagaggctggaattgactttatcggtttctttcctttttgcaaggagactggagagtgtgctctgtcatatgattgttcaataggcctggcagcaactaattttgcttcagaacaacaataggacaaaggtcacatacagtgtgtactaccatgagcatagactatgtactcatagttagggattggatcagactgggccaaccaattgtttagttcctttccaagaaaatacttaagtgcatgcgcacaagattattcactacttgccctttatccttgccagacttctatcaatattttttgacgaaacagcagctgtcccaagatccctctaaatcgcaagaaaggtagtaaagtagggcttggggacgaccacttggggtcatatgtgaaactgggtacccacactcatttttgccgggttggccgaaggattaggcaagattgaaacagttacaacatcgacaggatgctgtcgaaactgggtacccacgctcatcactacatgtagatagtccatgcagtataaactataagccatctttcccttcacatgcagggttccaaaatggagataatggaagctagtggagtgtaaaaaaattacaatggaatttattacttggactagcctaccatacctggaatcgacaagatggatcttcagtgatgatttctggggctatgagagatagagctcgaaaacagtccgagttccttctcttgtcaacataaatctttgatccaaatgtccttgacacctcaattaggatctcttcgtgaccaagaagatcacatgcaagatagacaaatggagcatgaggatgcttccatatgcaagctataacctgcaatcactgaaacatttctcaatggtgaccatccatgttgtcatatgcacactcctacagttaccaacaagcacatttaatctaagcggagaggaaaacctgctgaatagctgactccttgcttggtagcttgaggaagcatttggaaaatgtgcagtccaggaacacaaagtctaaacggcaaatgttttctttccctttctttgctatgtacttcagtggcaaattatgtacacaatctggcgtcagccgacagtcccccgtgtgcagaatgctaccgaattgaccctcgaacaagaacataaccgcccctggtatcacagaacacgcaagcattagccgtggtcaacccttcccatttctcaatatacaaattcaataatgttgcgctgaaaatggcctcatagaacgatgaatcactccgcctgaacagcggagcaaaaactacaattcccatggatctgttaaaaaaaatcggccgctgaattgaacaatcactcccaccatcacaccctgatccctgacaactaagtaatctactatttctaccagcaaattatcaacttatatatagcacggtaagctgtaacacgacggtatgcagaactgaagaagcggaaccagaattaccagggcagtgattggcgtcgtacgccgtgacggagaaggccccggcggggtcgtccaccaccaccgtcttccccacctccatctccacgaactccccccgctcaagctgcgacaccacgagcgaccattcgattagcacggcacccaccaccaccacacgggaacagaatcggcttccgcgagtcgggggggcagttttacccggggaaaatggcggagggcgaggtcgagggtgagccgcgtcgcgtagacggcgccggggcattccccggagtcggcggcgccgccggcggcgacgaggtggtcccggtgcgcgtgggtgaggaagcggtggcggcggcggcgggaggaggggccccacgtgtcgacggcgaaggggagccgccgcggcatctctatcggcatcctcccgagaactttccgaaattacagttcagtcctccgctcccctgaacctcgccgcctcgtttggtggggccatcgggttgagttagttgtgcccgtttatatacccgcgggaagtggcgccttccagaggaagaaaggctaacgggctaatggatgataacgggttttatttttttacatccatccatgacccgctaataagtagtaccagtctgattttgatgggcccaagcgttggtatgggccttcacaaaccggtggcttgatacactttcggcccaataacagtacgacaatgcaatgtgagatccataaagatgcagcccaattaaactagattttttttcttctttttatgcatttctgctcggattcttcttcattatgggggcctggggggcatacagtatcgtacggtagaaaaaaaaatgggaaatggcttcacgcttgcaagaacagaacgggaaatacagtatcatactctctcgatcgggcacgagagacagagatcagtaaaaagaaaaatcaagaaaggcgacagcaataatctgcttaaccactaatcaatccagcagcagcaacaatgctttaagctgcattcttccgtgcgtgtcggccgggcgccgtgcggggccccgaacgcgtcacacctggctggcgaccttgtcgtccgccgacttgccatcggcgtcggcgtcggcgtcgtcggcgacgaccttgttggtcttggcgtcggccatctccaccgcggcggccgccttcttcgcgtcctccacctcgtcggcggcgtcccccttcccggccgccgccgccggcgtggcccccttgtggttccggtagatcgcgtagaggatcagctgcatcaagcccagaaagctcccgcatccattggggatctgcacgtcgtacaacacaacgatgcaatttcgtcagttaaactctttgcgtgccattcgtgtgcacggctatagctgctactcctatgctccctccgtctcatgaaaaatgaatatgtggcatatcctaatactacagatctggatatatatatatccagattcatagtatcacgaatctacgatgcgtcatatctggttctatatttgtttttcatggaatgaagggagtacgtacgtacgcccaacatgtgcgcgccaagttggacgagacaccgaaaggataaccgacgccgccggccatttcgcggcattgagttgcaaacagcgttgcttgtgcagtgcagtgctgtgcttttgcagcggtttgcatgtgcccatcagacagtacgatcaatcgagatccaaacaaaaacacaaaaaggcatcgatcggattggatcatatgtctcgtcgtcaggttacgtatctttctgtaatcaacgtcgacaggttgcttgtaggcttgcagcaattgacagcgaaaagaaagacgatgagtaaattaccgcgatgaaagggtcgcggccgagcaggccgtagatgaaccaggaggtgccgcacaggaacacggacagggagagcaggaacggcatgaactccacgctcttcgtcttgatcaccagcctctgcacaccggagtcaattgatcagcgaatcagattatggttaattttgttagttattactccctccgtttcacaatgtaagtcattctaacatttcccacgtccatagcgatgttaataaatctaaacatatatatctatttagattcattaatatcaatataaatgtgaaaaatgctagaatgacttacattgtgaaacgaaagaagtactatactagatcatttgtgtggtgtgtactgtcttaccatgatggagagaggcgaggcgtacatgcagatggagaagatggtggcggcgaggccgcagaagagcttgcggccctggccgtgcagggccaggagggagacgagcaccaccatggtgaagatggaggtgacgaggcccaggagacccatcatcttcagcctggccttcctctccgcgaagatgaggaagatcaccacgtagatggcctcgatcaccgaccccgtcccgttgatcgtcgtcaccaggatgttgttcggtgacacgaacggcagcccgtaccttcaaccaccattcatcgttcatcacaaaccaacagcaatgctgtaattctggttttctttaaaaagatatatatatataagtttcagttatagttatagatcggtagatttcagactgtatcttgtcaacaaaactccatctggaaagaaaagttttgactcccagaagaaagcatgtgggcatgcacacacaagagcggaaaagaaggagattttcagagctggtgcgatatggtctctacaacttttatgatattgtgctttgccttgatattttggtactaacactaacctgcgaagaatcgactcgcggatagtgtttctcacctgccaaacacacacacacacacacctaaaatcatactggcccaaaaaagctcacccactttttcgagctacaaacactcgaacgtgaggctgcatgtgcttgcacaacggcctcttgggcccacatgtcacagccatcctggccatgccggcagcaagggctatagctgctgctgcacacacaccagtgatacagtgtgtgtacaagttccttcgcaggagtcactgtcacagcgatggcaggtgggtccaggagtagctttccatcgacgaggcaaattggacagaggctacactaggagccaaccactgtggttcccatcaacagtatcatccagtgtttccggatgaattacggcaataggagtaaacatcaagttaactttcagtaatcagtagtactattactgatgagtcaattactaggttcactaaacttgctcatgttgtggagtagtgtgtgtctatcgagaatcacacgaaacttctgagagaaaacgtagtgtaatgttgtggggggagaaatgcagatggtgtggagaggagtgtgaggtttcagttagttaccaagcagatagcaggcagttgagaagtgtcatgttgtaaggcacgccggagaagtcctccgttgatctcttcttgatgatcctccagaaggtgacactgtaaaatgaaaaagagccatcaaaattttctcaccggtcagaagaaacaagcggcattcgtgcgaccgatgcacacgcatcaacgcatgggtagctgccggtgaggccggcaaacaagcaagcaggggaaaaattgcaagattttttaactttgataacttcttttgcgaaaaaggttgaccaaatatcatggtagatgaaactaaggagcagagcaagctgacactctccatgaacaaagacactctactatgttagctccttttttttttccagacacagagactatgagttacaggtatcttttgtttcttcttcccttttcacttgtttttttttccttcttcccacctctgctcacacgttacaagacctcacaaattgggataagattgacgataaggctaggcagcaaggaatcagaaacttacactggcgaaaggaacaggaagagagcgatgacattgcctggaaaacggagccaacaaaaaacttagaacgaattcacagtagtgtaaaacttcaccaaaaattaaccagcaaagtaggtagctctaggagcacccatacaccttcatttcttcgagtgttcgaagatgggagaaacaaatactacatgcacatatagacagataggaaattaagaacaagctgcagctagccatggcggcacactcaccggaaactccaaagaagaacctcgcgatgtgctccatttcgatacgtttatctctcctccttgtggctagaatagatcgcttctagctctcccgagagtactgcgctgaatggatggctggctttgctagcttctcagcggtggactactgctacacaacactacaacacggagctacttctaccaatgcggtgcctctgtgtgtgtgcttatataagggagtggagatatacagagcaacactggtgtgtagagaaatatgccaagctttttttttttaacgaaaaacagcactagagtgacttttcattgaacagggcaggagaaaatacaaacccctaggggtaaaaggaaaacggagaaccactatagctgtacactatacatagtgcgggattaactcacgcaaccgcttagctcctgctaaagccaaaaggcttgcctaatctttgattttcgttagtaggaagttcgttgccaagcttaaacagatgttgtttgaaatacgtacgacgataaattttgctcctaatctatgtgaagacagatatcagtaaatttgtcggtacttttatttcattgtgtttttagtagttctgtaggagcataaatatagagtagatgtaggaagccacaactattttgtgaaaactatcagtacactagtacaactttagctatgcaatttcatagaaactgcatcgatgataacatgatttaaacagaaagatgcaactttatatgtccaatatatttgagcccacacgccatacacatatgcaatactcgtgttgttgcatgtcgggtttattatgtcatacacacgtagaggatggagttacgattttcaaataaattattgtcattttccgtaatagctcgacaaagttgtaacaaattgttactttttagcctgtgttcagctgggctaggctgtggtagcagccagtttgaactaccgcagccgcagcggctacaacagtaagtgcctctgaataaagccttaatcatgagtaaattgcgttgatgacatacaaacttgttagataactatgatttagtacacatactagaaaaaccgtgtggcttcgccacgcatggtaaagtgaacctagctcattcgactttagtggagtaactaattagggcccctttacttgaaagaaaaatataggaacttttattctgtatagaaacgataaactttgctataggaattttttctatatgattctttgaaccaaaggattattgaaaactattgagtcttatcaaatttctaaggaatgcccaaattcatacaagttttggagtatttttaacatgaggttcaatatcatgcgaagtctcttatgagtttatctctctcatctaattcttgcatttttcatacggtccaatcaaacgattatttcatatatttttatgtgttttataattctttgttttgcgcttgattttttgtcagaattttatgttttccctattcatccctcaatcttcgtttcaaagtagccctcacaagacatatataggttgcattggaccgagggagaacagagaaagggacaattttgtttgtacaattgtacccctactttgatgtcaataccgattttaccctacattttagggttgttgttttttgccctatttttttcaataaatgaggcgtttacccctgtttttgatggaagtgagtgggattggacttagtgcggtaaagaattagagaaagaaagagataacgattttttaaattattgattgacccttttacccctagaaaatatccatgtaccgcttggtgtccctccaggcttgggcacttggcatcaactcttcccttcctgaacccgaatccccgttgtgaaacagtggcggcagtgtccgtgggccggccaggcaacggggacgacccgagcaagtgcaggccacctaacccagttgcagcgtgtaggaggaggctaggcattgtacaagaggccatggtagagaggaggacaatggcggctgctgtagctcagcgtagggaggaggtgcggctgctcgacgtgtcgaggaggcgacggggaggaggacaacaggtcaacgacggtggtggtggcttgatgataagatgaggcaacagcggcggcttagcgcgaggaggtgatggtggcggctcgacgtggggaggacgtggtggcggctcggtgggaagaggaggcaacaacggtggcggcggtttatgagaggaggcgacgacgacagcttggcacaggtaggcaatagatttgcttgacttgtttgtttttctcaagatgtcaaactttgaagcaaatttttgttgatatttatgttaaaattatcatattggtaaaagtttatcgaatttgcaatgttcatgtgctaaatgtgggcaaattctcaatcatgaacaaaaacaggggaagtttgcaacatgagtaagggtattgaatgccttctcgctaaagatttaacatcgttaatctgtccatcaaaagtagggactaaatttatctttatttcaaaaaaccatgggcaaaaacaaaaccctaaaatactgggcaacatcaatattaaacatcaaagtaggggtaagaatgaaattgccccaaagagaaaaggttatatgatttctatagaggaaaacacaggaaagaaataatataaatcacatgaatacggatacaaaataaggaaacacaataactgtaaaagaatggatgtttgcaacgtaggaattatagtgggtgatttgattacatcctgttaatcctcttttagtctctaaccaaagtatgtatcattacttctttaatcctcaatatccggtggtaggaggaagcaatagctgcctgagctttgccagccgtacggcggcaacgcgagaaatcacatagcctgcacgcgcgcaattagcaggatcgagccgtcccgcgaaaccggcgttgccacgtggcacaattcttctttcaattgtttgcatggaattcgtattataagatttgtaaaatgctcattatgatacacatatttgtctagtgcataagaactagtacaaaacgatatattgtgactaatcatattgaattagtaaaatgtctgcacgcacacatgaggacgtgagatatgtcgcatgtgtaaataattaacctttatacataatatttattttattattttattatattttttttaatatgtataattaacatggcttattatatgtttgattggacatatgtatattatatgtcttgacatacaagtctacataacatcccaagcaacatccaacttattaaaattagttacgacacgttggttagctttagtttgtacacactagataacttcgtgaccgaagtgagcgatttacaggttcatatattaaatcggacctaccttggaagttcatatatcagtagtgtaatttactctttaatcgtataattgttctttttgtagaaagatactcataaatatttcatttatagaagtgatggttggcgatatacgttattgacagtgtccatgtctagagacggtgagaactaatcgcaaaaggcaaaataaattaaaaagtaaaaagaaaatgaagggaatggctattggatgaatgttcatctgaccaacctgtaaacaatatgttgtctttcttatctacacgtttatttataaaagcttctggcagctgtaacttatctaataattataagttttcccccaaacaattcagatcatcgcctatgttctaatagtccggttgtataatctagaaaataaactaaaagctgagtttagcagcttctccagattttcagaaactgaataccaagatgatctactcaagtaaaacctcagctctcctactttcctccgcaatcaccatccacctccaactcaatgccacctccaccagtactactgtactagtgcacaccccttctccggctgcagtcggtccgcactgtccgcggcttgagaattcagacaacagagaaaagctacgtagtagcacacatacgtaccagccaaatccttcggcggtggaaccagcgaaatttgcgtggacgagcgtgtcgttttggggacattaatattgttgtcgtgcgcgcggccccgcactgccccggcatggcgaaactgcaggtctctgctcctcgactcctctgcaccagaagttccgtgctatttcacgagaccaacatgtacatagccagtttactcggctagtccactagaatcagcggcagagctggagtaaaccacagccacaagtgactgtacccctcccctactgatgggcacgttcagagagtgaacaaccgcacggagtttataaagtccaattttttctttcaagttcccctcttctcgttcattgatctggctagaataatgggcatatttttcttggctgtaacaaatgttggatgataattacagccacatcaaagatctgtagctcgtaatcatgatgtgaatatgcgttccaaatgctatagatttatttttaacaatttctgaaaaaactgaatcactgaatctagacgcaacgcttctcctaaacataagaacaaacagttgttatgtgaatgatcggtaagctttctcgatgacatgcaatctacttggctgcgtttgagagaagctcaaagagaagaaaaaaaatcatttcttttgcgcacacacttcctgaaccactaaacaatatctttaaaaaccatattaatccatattttaagtttcaaataattaatacttacttaattaggcatcaatagattatctcgttttatgtatattctctatttgtgtcttcttaaacacagacgtagtgaaagttttctaaatagaaagccttgttataggttttttcaccgggcctaaaatcttatatggcgtagcagctatttcctcaatttcaaaatataaggatttttaacatttaaatattgttgatgtttagtgcatcatttgttctatcaatcacctttcatttgtttttcccccattttacctccacgtactctctcatctccactcatcctttattttttacactaaaatccactttttaatcttaatttttgctaaacaatatataaatgcttatattttatagcagttcataaggttgaatcctccatttgacagctactaataatgatactccgttcgtattttgactttttgtttatactatttgaccattcgtcttatttaaaaaatcatgatactccgttcgtattatttgaccgttcgtataatgatactccgttcgtattatttttttacttactttattatttaaagtactttaagcacaattttttaaataagacaagtagtcgaacagtgtaaacaaaatgttaaaatctcttatattatggaacagatggagttggactctaaacttgaaattttaatcggattaacacggtcaatgccatgcatgtacacatgtgaccgagaggccaggacccaggagccagagacccagagtatttgacaacaggtctgggtagaacagaggccacgctggaattgtgtggactcttgaaatccgcaataattctgcatgcaccagctattgcattcttctgcctgataatgataattttctgcagttctctgctctgctgccatccgcggcaaaagttggagcacatcgcaatgcgtatgtgctcccctacacggaatttatccggtgcgtgcccttttgtcctacggtagtacggtgtgagccatgcccttgatgctctctgcctgctcgaacatcgatatttcccccacaaaaatggagaatgtttagcccacctaatcaaagccggtctgtttcctcgacaggtccacgtcctttttttcaaagatggttcaaattcggtcgcgtgttaaagaatgaaagcacacaggatatatcaacagatttgggtgtcaatgtatcatcgcccatcaaggcctaatttagttcctattttttttttctaaaaacatcatatcgaatctttggacacatgcataaagcattaaatataaattaaaaaaactaattatataattagggaggaaatcgtgagacgaatcttttgagcctaatcagtccatgattagccatatgtgctacaattaggctcaaaagattcgtctcacggtttccagtcaagttataaaattaattttgtcattcgtgtccgaaaaatccttccaatatccgatcaaacatccgatatgacacctaaattttttttcactaactaaacaggccctaagttcctttccttttctgctgaatgtagcgtccaaaccagaaactgtatattagctccaattcatacatatctctagatcgatgtgtttgctagctcaatcagtgtatgactaggggagacctgcaagtcacaaatcacgccgtgatcctgattatgatgtatcacgtatgagatgatgatccgtcggtccagtttgtcgtccttaatctggcagataagatatggcagcaatttgaacccatctactgtatgtgaccagagtcttgcactgacggcaaactgaccaagaaaaattttgtcattgactacgcggttcaccatcatttaaaatgctgacgtacaaaaggtagtactatgatatatgtacactgtactggattatatatatcctttggtttatttgaaacacaaattgtgcaatgcaaagtatgatgaattaatcatgcaacaaacgcgaatcttaaaaaggggagaaaaataaagaaaacagcgataagtaccttgcattacgtgtggacctcgccaaggtgtccatctgatggcgctctgtgttggctacatgcagctaaaccagggacgctgcatagtgcacggccagctgatccgaaccgatataccggtgacaaaattcgcagcccaatgattcgacgtccgtcttatccttcacatgcgatgcatatatactagccgagctgcttttgcagggtccagaaaatgaggtaaactttttggtttggctttgtacgttgcacatattctctggaaattaaaggccttgtcgttgagcatatcttacaaaaactttatgctcatgatgtggggagaacgtactgaaaatgaaatgccgggtagatatttcttctggcagatgctgttgtggtcgtactacatcatattcgtgattgattcgatcatatcagtgacagagttaagaatttaatcccgtggattaattactactagtttgtatttaaatgaaattatttatttattatataaaaatcaaattctatagaagtgttttttaaaaagctatagggtaagccaaccctatagtttatgcataaattcatccctagtcgaataccattacttcataatttagtggggtcaattttataaattctaatgaatttacaagtaaatagacttttaatagaactttagtaagattagggatgtctcgctggtttcagcttctaaaattatagttaaatactctcaaatcatcattaaatttagggaaaactaaatagctcattagttaagctctatgttaaccttactttttaataatttctatatccgtcactgcgtatacgtatatgtgtacgtccttatccaagcgacgacgtataggaagaagcctcgggataccggtcaaagtcggcatcaactccatacggctgcgtcaacaacaagacgacccggtcccactgtggagtttacgtcgaactgtgaacgacgctgttgcccaccagtagtagaactagaagcgtggctgatccggtcacggacagtgtcgccacgcaacagagaagtagtagtagccgtactattcgtagactctctgtttatgggtgtaaatgcgttcgtattttgcgtcctatatgtgagggcagcagtattatcccaggcggatcctagagtaaaaataacagtgaagaccgaacaaactgacaaagcttttaccattctttctcatgaatacttcctccgttccaaaaaaaaaaaatctacgactagagatttatagtcttagaatatgtcacatccaatactatattggttttttatgaaacggaggaagtatatagaaaaaaatgatagtggggttcgagcctcctccgctcctacggtagatctgtcatttgtctctggttcagcaattaaagttaaacacgaacccggatgatattgtggagttgtgttcaaccgtactggtacatgtacgtgcccgggcaaagcgttccataccccggcaggcttacctgtactcggtaaactgatatactccataatcgatataccagagcttctcatgatctgattagtcatggacgatgcgtgtaatgcatgtgggtcggcattgtccctgcctgaccgacccagatgcgtctcactcgatgccatccttcaatcacctaattaggtgctttcttcgtaaaaaaaaaaccaaccgaattaaagatgaccattttctaatgcaataaatctgtacatatataatttagtcgaggatggaacgttttctatgacaataaatctgtacatcattgtcctataaaatgttctacttcctccgttttacaatgtaagtcattctagcattttctacattcatattgatgttaatgaatctaaatagatatatatgtctagattcattagcaacaatatgaatgtggaaaatgttagaataacttgcattgtgaaacggagggagtatcttaattaggttggttttcttttttttacgaatagagtatgtacaatccaatcattgtcccgagagaagatcagatcgacctttcggcgtgtccgtcgtgtatgccatatatccagtttctcgagttcttgtcacggacttcaaccaattcttcgtatgctcttgagtagagtacaccatacggacagtagtagcgtggttactttcagcaaattcagcttgtgttttgttaggaatggacgacaatggatcgagatactgactcaccagatacagcatacgtacgtttgttgttgttgcatatgcatgcgacgacgatgcgcgcgtccggcaaacggaatcctaaatcacacctactaactttggactgcccacggacaccactcgtatatgaccatatgtgcaaagttgcaaatgcaagcaaacaaagcgaacgatccttgaacggcactgtcccactggctaataaacctacaccttgccacatgctactgaatttctagacttgtagcgactcgaaaaagttggcacaagaagctgcaagaaagcgatcggaattcggaatacagcgtcatctgttcgtctctacctgcctgcctgcattttgctgccatatcattgttgatcacaggagatgataatacaaatgggcaagccctgtttaagttcgattaagggtgtgtttagttgaggaaatgaaaatttttggatgtcacatcggacgtttgaccggatgtcggaaggggttttcggacacgaatgaaaaaactaatttcataactcgcttggaaaccgcgagacgaatcttttgagcctaattaacccggcattagcacatgtgggttactgtagcacttatagctaatcatggactaattagactcaaaagattcgtttcgtgatttcctcccgtgtaattagttttttttatttatctacatctaatgcttcatgcatatgtccaaagattcgatgtgatgtttttaggaaaaaaaattttagggaactaaatggggcctaagtacgcacataaaaaaagaaaaaacacccatcggtttataattaattaagtttcgatctttttaaaaataatttatctaatattttaaaataacatttatataaaaagattttaatatgaaatgtgttgttagtagtttgaagaacgtgtaacaaaattcgagtatgggagagttaagagcaagtttaatagtatagccaactacttactctaattcatctatatccaatttaatagctcatttatacaatagttacatactacaatattaatacatggtcccacttatcatacacacactgtgttttagagtccgtgctacagctggctataaatctgtagcccgctcctcttctctcttctcatttatcttcttaaaatatatttgcagctggtttataacctgctattgtacctgctctaagagcaagtttaatagtatagcccactaataactctaaattatatatagccaacataatagccaattcgtaccatagttgcttactatgctattaatatctggtcccaccctgtcatactcttattacgtcttggagtccgtgatgcagctggttacatatatgtagcccactactattctctctcttttcttatcctttaaaatatatttatagctggtttatagcctgttattgtaccttctctaagtatagcagcacgacaaagagcttttggccttgtggagttgtgggggagtgagctgcgagcaaattaaaggtggaaaagtgcacgcagaaattggctggctctacgcgccaacatgattcctggcccacgggcggatacgtgacaggtgaccccgagtacccgacgcgatgggaacaaaaaaaaaaagctggtttttgggcaagagttcttggatctttcatcatttcgtgcaattcggctgattgccggggcagcgaccgtgcactagcattcccgtcatcctgttagaaaggagaagtctgtgcttttgcattttcagtttttcatggtccagactacactcaatttttctgagaaacttatgttcagactgtggtacctgatcattgatcaatcatgaaagctagtatagcttccatctcacacaacaacaagttctcaatatgttagtgcatgtatatgtctggttctttcatggagttcggcatgttgctcatgctgttcttgggtcaggttctggcactgcgtctctctctctacgctgatcaatacatgggctggtgatatggtgatttggatagcgatgtgtcaactttaattttgggtgcacggttctaattgatggccggatcgcaacaggctaggctatctcttgatgtgaccgtttcggaaaataagagaaagatcttctgttgttacgcgacttaatggtggtatggccttcagcttgaagatgactaattggtgcaggtcattgcagaaagcctatagcgttctctctgaattatgatgaatcaatggcaggaaagaagatcgcatggccttctgccgatcgatcatgcaagctgaagaaaaagcctatagcagttttgatctgcctgtgtgtgaccgtgacaaatataaacgctccctgaaacgaagggcggtgtttcgctaggatctcatttctcaaatcattgttgtgcaattgagcattgccgttcatcaatggatctcattatttccttcagtttaacatgatcagattttgaggattcacgttctctgcttgaaattcatcgcccgaacgaatttatatacaattgatgcaattgatgatgagcaattgataacaatatatggagtagattgcatcccggccgggcagtattcgaggggacacacacttctttcccagctgtatgagctggattagttactttcttgatactattattcttgtccttgattgcttcgtcataaatagtagtacaccgctatttattctgaaaaaaccattgtgcatgagtgcatctacatatgattctggttttcttgccttgtcgactcatccgcgtttcaggggcagagaatgaagggcaacatacagccaagctcaggaaaacttcaaatttgctactgatgagtgtacagagtacactatcaccgcattaaaatatactttctgccttctctagttctcttcatcgtttatttttgttttatccgtctgttttcatcatatcgtgaatctggctgtgttcatcaataattggtgctagtaggagtattatcctgtcaagaaacccggtttaacccaaaataaataggcgcatgcgattcaagactgcagtatgtcgcgcagcaaagtttgtgaaaccagaagaactggagtattctgaatcctactgctgattgcttcggtctaacttcaaacatagcatcttttgcacgttttcaggggtgctgaagatgacagtgttacaacggttcagattcttgattacctcctgaaacatccgatgctagacacatcacaaggcgactgtgacctgattcttctctttagattagcagttctagacccctactccctctggttcagcataaggtgtttcgatttcattataaatcaaacttccttttatgtttaatcaagtttatagaataatgtagtaatacttctatgccaaacaaatatattataaaatatatttaatggtgtatttaatgagattaagggcttgtttggataggtgccctaccaattttttggtagtgccaaaacataggcaagttttggcactaccaattatttggtagaataaatttgtattcatcttatttggcttgctaccaaaatctagccaaattgtgatatcatagtgaagaaagttctagattgctaccaaatttgagatgggcattactaaaatgttgacaccaatccaaacaaatggtggatactatttatgctaccaaaatattggtatggcaaattttggtagcaattcaaaactgccctaagttggtattataagtgttgctatgtctttttatatatacattctgaaacggagagaggactagcctagaatgacataacgtaatcgcgtgaatgatacagacctgacggttatctttgctctcgaagtcgaagtgtttaatttgaaggggtgacagatgaagaaagcaagcaaaattagccagggcctggctatgaaaaaaaatcatgggtcaaaccgtcaaagcccactagctttttcagagttaaccagcctggtcaagcccaatagacccactgcagcagtgggcctagttatgtctatgtgggccttttcccccctacaaaatgttctatctttcagaaggaacacactgcataatttgttcaacagaggatacaaggtgaattttaagtgttagcaccaaccataatttgttgagaatagctaacagtaattcagttactaccctaatactcttaagataactaacagtttcatcgtttggcttatgctcatacatgcttatctgtattgcttattaaaaaaataatttacagataaaactcgtatatgcatgtatttaacaattcaaaagcaaatgttatagagtaaactacaataaaaaaaactcacaaaatcaactgtaaaataaaattttaaaatttaaatttcactagcttatactccctccgttctaaaaaaaaaatacaaaccctgggtttccgtgtccaacgtttgacttcccgtcttatataattttttttataattagtatttttattgttgttagatgataaaacatgattaatattttatgcgtgacttgtctttttaatttttttccatattttttttaaataagacggatggtcaaacgttagacacgtaaattcaggatttgtctttttttttttaaagatggagggagtaagtataagcataacaaaacgacaagactgtaaataggtaatgctctctgcataagcttgagctgcaatcccacaggaaacacctcatgacggagcagtcaccagtcagctggaatactaaattaagcctccaaagccgcgtcaaacagacgaggaaacaccgtttcgtcagttaagttcaggccccaacagaaacaccgagagaaacacgcggcccaaacggccggcatccccctcaaccgctcgtccgcgcccatcaaccgccaaagacttcccgcgcgcgtctacatatttcttcctctccctccgtctcctcctactctcaaaggcctcgttcgtttaatccctctcacggagagaattgaaggggatttggaggggatttatttcacacctatcgtggtgtgaaattattcctcttcaatcccctccaatccctctgtattgggattaatcgaacaagccctaattcgtgagaagctctgatcgatggcgccgagcaagctccgggcggcgctgggcgcggtcaaggacaggacgagcgtcgggctcgcaagggtgggcggcgccgacgaggtggccgcggacctcgccgtggccatcgtcaaggcgacggcgcacggggagagcgtgcctggcgacgagcgccacgtccaggagatcctcacgctgacgtgctactcccgtgcgcgggtggccgcctgcgtgtccgccgtgtcgcggcggctcgggcggacgcgggcgtgggccgtggcggtcaaggcgctggcgctggtgcaccgcctgctcgccgacggcgacccggcgtacgagcaggaggtgttcctcgccacgcggcgcgggaggcgcatgctcgacgtgtcgcaccggttcccgcaccgatcgtcgcgctcccgcgcgacgtgggacttccacgggttcgtgcgcgcctacgccgcttacctcgacgacaggctcaagcaccggatgaagggccgcgtggccagccagggcaaatggtgctccgacggtcgccgcgacggcttccccgacatcaccgacgggagttacgaggtgggcgaagcggtagccgaggtctgggcgctggtgccgagggacacgccggcgacggggacgacgacgaccgaggagctcgtctccaaggcgcagcatctgaagcacatactccagcggttcatcgggtgccgcccgacggggaaggcgaggacgaacaaggtggtggcggcggcgctgcacaggctggtgaaggagagcgcggtgatgtaccgcgagctcaccgaggtgatggccatgctcgccgaccgcttcgccgagctggagaccccctgctgcgtgcgcgtacactccatcttcaccagcatcgccaagctgttcgacgagctcgacgagttctactcgtggtgcagatccgccacgatctgccgcccgtccgaaatccccgaggtcgagcgcgtcgcgcagaagaagctggacctcatggacgagttcatccgcgatagacaaccggcgtcgtctcggtggtggaggtgcacgccgccggcgccgtccagcccgcttgcccccattgccagcaatggcgacaatagcagcaaggcatcgccagctgagccggcgccggcaggcgcactcgtcgtggtcgacgaccacatggccgacttcctgaaccttggggaagaatcgacgccattgtcgacggaggagcaagaccgggatctgacactgtccctgttcggcgatgacccagcgacgccggcgccgaagtgggagacgtttgacgacgaccaatgcgatgactgggagacggcgcttgtgcagtcggcgagcaagttcgccgccacccagagcgcgacggtgcttgcactgccaccgccacctggggccaccggcggcgaggtcgcggacccgttcgcggcgtcgctggccgtgcctccgccgacgtacgttcagatgatggacatgcaggcgaggcagcggcttcttgcgaacgagcagatgatgtggcagcagttcgagacgcaacaaatggcggcctggagttacagttcattgttgtaagatcgtaaaaaacgaaattaatgttttagagcgatgagaaatttcaatgctaactatgatacacgctaaatgaagctgattttgcaccataattttgtgcccgagttggaaccaaatcaagtgatgcactcgtttggttgagccgaagcgtgcctaagttcaattttgtggcgaaattgactgttttatgctatagctgttgtccttatccagatttaattagtacctatgttttaaaatgttgctaattagtactccctccttatcaaaataaatcaatctcctaatacgaggtggtttatttaaagagagtgtgtaagataagatatttaacaggattatgaatctagacatgagttacgtcctatcaatttggacataagatactattagattcataattctttcccgtttagattcatacataagccaacgtctcgcttattttgcggaataaatgaaacggtatatttgcaaacgaaaaataattttcgaataaattttttatatacgtgttcttagcgatctaaaaaaactgaaaaataattcgatgaaaaagcctaaaaaattagctccaaatttaaggttgaaaattaaaattttggctaataaggataaggataagaaaaagatgaagcctatagttttataaaatatctaatcttctactggctaatattgggatggaaataaatgttcataatgtttccatcaaaattcaccccaccttttttaacaaaaaaaaaactcacctaccactgacagaggggcacagggctaatggataattacggggatgcatcccgaaatccagcgtgaaacctcccaaaaaagtagccacgaaaaatcaacccagataaaacacagcagccgcacatcaccctgacatctctcaatcggacggtggataccacctcaccgcacaggctccccgtgcgctcatccgcaccaaaaaaactttttcctcccgctccccgcaacccagccccttcgacttcccgccctcgcaccatttccgtgaaccagttccaccgaaaaccagaaccaagctcaccgtatggggcccaccggtcggtttcctcacgcgtcaaacaccggttccacgtgaggaagctgagctcgtggaccttcccgcctctcccacccaccgcgagctattaaaccccgtctcccccatcacacactctccccacgcctttgtcccccgaaaccttcacaagttcacatactcgcggcctctcctctctccgtactcgcgaagccacgctccgggccgttgtcttctgtgtcgcttcgaattcgggaagaccctagtcactgcgcggccgccgagtcgggatgccgccggcgagaggcgggaggcgtgggagggggcgaggtaggcgaggtggacgcggaggcgccgcctctagggcgcgaggcgagaacgtcgtagacgtcgagccgatcaagctcggtgatggtgagtaggctggatctgggttctggacgcgatcggttttgggggattttgttcgggctagtgatcgatctgggggttttgggggtttttgttactgtgcgtttggttggttcgagagtttgtaaaatcaaaccgttggggattcggattttattaggggatttctggtggattttttttgggttcaggattgtaaggaagtagcattgctgtttttacgtcctccgatcggttcttgatgaggctgggaacggtttcccccctccatttgtgtgctcttcgcgtatttggaggagagcgctatattctgtggcggaagtatgaaatacatttttgatcaaggcgttcgaaactccgtaacattctgatccccacatatttggcagatgatgcgaaggtagatccacagacgaagtcacctaacgaagaaataacaagcgcggaggtttgcgaggtggagacctctgaggctagcccgcttggtgccccggaggaaggtgagattgaaagttcaaacttctcggacggcacggggttggtaatttgttatacccttatcgtttcggcttaatcccggtttcgatttatgcagatgaggggaagccaggttccactaggaacctgaagcgtcttcggaagacgatcacgatcgattccgcagccgctgaggagcatggggcagagagtgacgatgaaggtgagtgacggagtttgcttagctgacaatttctcggaattacgggtgccgcttgtcctgttaatgtgtagtacggttgtttgcattgtgttcaccttggttgtgctcagttttgatttgttttggcaaaatgaacactatataaaactccagatgttggtatttgcaatattagtctagaatgttgtatagctagtcattattattgtttgttttgacctgttgatttagagtttgatgttcttgccacagcaagttgccaagagttggctccatgcagaaggtccaagcgcctaaggtgcaaaccaactaggaagaggtccaaaccaactgggaagagggatttgggtggcaaggagagtgaagatgatgtatttgcaaatagctcgagcagttcccaggatggtaacagtgttatttacaatatattctgtcttgctgatcctaataaatttgtttggttgaagatttattccagattgatattttacagacgccgggaagttagcttctagaagatcaaagcgtctcagggagaggcttacatctgattattttgatggtgatgtgggtgaagacagacaccctgggaagtagctctgatgattatggtattgttacaattctcaactattgcatgatttctgatatgctgccagtctgctactacaaatgtaaaatttgcattatgtagatgaaaattgttcggctccccgccgaggatcaaaacgccttcggaacagactgggccccagaaatatttcatatgctgatgatgatagcgacaccgatgatagtaagtgggcaccctttgttatggcttgacataattgacccttttgtttgcagatcatgtgattttgtaattaacttcaatccagtttatttgggaaattggataacttgtagtttctcttctgctagaaagtcttaattgacataattaaaaaatactttgaaatattgtttaaccaaggatgcatttaaaacaatgtgaatagagtttttttacggaatggaagaaactatctattttcctcaatgcattctttttcaatatatatcttcattgatttgtgcactatgtgaaacttgcacctttcctatttacacgagcagaaagattaggacctaacagttgaatttattcccttctgtatagctaatatacaaataacataaccttgtttaagcatgttacattaactactgaaattaccacagatcgcaagaagattgtcccatgcaggagaacgtcaaagcgcctacaggagaagcggaaagctcatgatgtttcagaggtaagttaactaacaaaagaactcgacctactgttcttcatgaagtaataaatatctcatcgaaccttttcaggagagttacactgaagcttcgtcttgcatgttgtcgacttcttcttcatcaggtaataactaatcattttatgatcgataaatgtatcacctactttataatttaatatgattttgtggtcaagagattattgcaatcttgcattgtgcacaattaattaatatcaccgtacaaatatgtaaaatacctaggaaatattttgttttttactcctacctgttatacatggaagtgcgaagcatcaatgatccagagtcacatctaaacacattcaatattgttgatcacctttattcaatgcatttgttgttgcttgcatctataatatcgcatgaattgacaaccattccttctgtgcttcttaatgatttgtgtggaacctcagaatgcttgtcgtaaagttgatattacgtcgtgcatgtttcgctaatgacttgtgtctttcagatgatgaattattgcacaattctataaaacctggcagacgtaattcgggtggacctagttgttcgatctgtaaggtttgtcagcagttctgatttattaattttctacccccccccaatctttacatgaaatcctaactgattttttttgcagattggaattgcctgctctttcctcatcaaatgcaagaattccacttgttctcgtagcttccacaccttttgtcttgatcctcctttgcaagagattataggcacctgggaatgttcttggtgcaaaagcaatgcagcaccagcagtcaaggtgacagaagtgttaacatcaaaaaaaatccaaagacttgttggccacagacgaattcttcaggaggcagatttccagtatcaattcctcgtgaaatggcaatctctttctcatcatcatgactgctgggtatgttaaccttcttgctcaatctatatttggtgtctttttgaatgacttatctttgctgtctttttttttctttttctgtaaggcaataggtgtttgacttttcctttttctgtaaggcatacttgctagggaacctccctctaccaacacctttcttgtttgtagcagtacattatattgagtttctttgaactggtaccttgcattgtatatttcatttctttcaagtcatgaaactttgtattagcccttgctgctacaactaaaaaaatgtcatgctgcagctgctacactttgatttctattttaatgcaaacatacacatatttggcgtattcacaaaaaaaaaaacggcatcttcctaatgtttgtttatgatgttagaattgtatcctgccacactttgcctaatatttattatgtaattgctatacttgatgtggaccatgcaaatattgttccctagacacttaattatctactctctgtaggttccgcttgaatggcttcatgtatctgatcctttacgagtacagagctatctaaacaagaactggtaaatcttctcagtttcatgtttttctgtctaccgcctccagtgtaaagtttcttgtgttattttcttgttacatgtatttatcttttataattttttttgtgttcgtcaatgttgctaaattttttcttggatatactagttgcacataatctcgtacctgagtaatcgttgttcatatcattagcaaattaataatatgagcccctactaattttctaccttttttttcattaatcattactgagctattctggttgaacaccatgttgatgtttgccatttttaaaacaatcttgtttgtttataatcttaccagctgtgttctctagtgcaccatagtgcttatttttgttcttgtttgtgaacattgcaacagcttgcctaaggaagtttattcagaggatcaaaggaagcttgagtggtttgaagtagatcatgccattgcatgtcggaggaagttccatcatgaaggtttatgtgatgtcttggctactttccaggataaccaagatttcgacgggtatgagttccttgtgaaatggaagggccttgattactgtgaagctacatgggagccatgttgtaccgatggtgtgcaacaggctgtttctatgcttgtcaggaggcataaaaatgcttcaaaaagagttaacatcagccaaacatgtctagatggatcaaaaatagaagaggtgcactgtggtgctctatatgactatcaacttcaaggtttacaatggttaatagataacttcaaaactaggagaagcgttattcttgctggtatgtacataaactctaaatacataatccatgatgcacttgtacagttgtaccttaccaaattataatgcaccaataatacacatgtaaagaattatgctgatcagtttttattttgttgttttgagataatctgatttatcatgatgcttgtgaactgtataattatgtagcgtctctttgatgttttctttatttgtttggcattgtcttgatggaaaaatagcttgtacaactcttatttcatgacaaaactatgataatggggtatgttctgctctattggcagatgaaatgggtcttgggaaaaccgttcaagttgtttgctttctgtaccacattattaaggaaagtttgactgcatccccagcattgatccttgctccaaagagcatcctcctgcaatgggaaaaggtttgtatatagttatgtgatattctgccatattatactgtatattatataaatgaatttaaaattttaccctgaatcctttttttgatattgcatttcagtttacatcaaatatgttgcattaatcctattttttggatgcatgttttgtgctctaggaattttgccagtgggctagtgatcttaatgttattgtttatcaaggagacagagactctcgaaagtgtatccaagtccatgaaatgtactcttctgatgggaaacctttatttgatgctctagtgacgagttatgagtttgtccaaattgacaaggcagttctacagaaattcaagtggtctacaattgtcagtaagttttttcttagatgaagtcccccattatttggtgttcacttgccggcattagtgtattgtctctgttcttttcttgtaacacttgagcatttccccactttcacttcagttgacgaggctcacagaatgaagaagcttgactgcaaccttgcagcttgcctaaaacgatactgctctgaatttcggttgctccttacggtatgtactgcctacttgacctgtaatttcttgtccttaattatttcttggaattttagaattggtttgttccttgtcactagtttgattattagtagtcatctgggcatgaggttttgaaagtgagatgcctggtatagccagcattcaaccatagtgagtgcccataatactttaaaaggggtgtgcattactgtagctgaggcatggctcgctcctactgctccatgcatcgtatgatttggggactaggattttaaatccattatctgaaaatggttcgcttctgtggtctttctgaagcaacttaatcctgtgctagagcctaatcaagtgctatatagccgctagagcctatataacatagagagatctggttagccctttttacagatatcatatatagccgattctttctccttggctgtcagcgtagtaattcttacgaagtgctttacaattgccctttctttaaaagaactatgttctgatcctggttcctcttcctttcactgtacagggaacaccgttacaaaataacatcatggaactgttttctttgcttcattatattgatccggatgagttctctgatccaaaggctgatggattgttctcaccaattgaatctggaagggatttgacaatggatgaaaaagttgctaggattcacaatattttaaagcccaggtgaatactctgaaataagtactatatatgtttaatatcttggacacggatatttttttgccgggttggccggaaggtttggtcgaccaatttcattattaaagaagggtattaaaaacaattgaacacggatcttaagtttcttgtttttgctaggatgttgcggagaatgaaatctgatgttctaacagattctatgccagtaaagaagtgggttgaagttccatgtgcacttgcagattcccagagagaactttacattaatattttagagaggaattactcaaagcttaacagtgccattcggaatggtgagttaagcgttctgctcttttttcatgctctggtaaaattttaagtcagattcactttgtaaaagcatatttgtccctatgaattacgtatgggaatatgaggtttttcaaatccctttaattacgtatggaaataacactgttagtcttgtttgtacttttgcaggcagaaaactttctctgaacaacatacttatggaactcagaaaatgctgcaatcatccagtaggttttactttctgttttgttgatcagatgcagaacttggtctcttttctcttagatgtaggaattgggtgtttttgcttttccgagtctctcattttgacagtgatttgtgtgcagtggttacagaaaatttgtagcaaacgagaagcttaaaattggctttaatgtatcagtttgttaaactccattcttacaatcctgccttctatacaaggaccactagaccaggccttgctccctccgatcacccacaagctcacaacaaagagccctttttaagtagatgtgctgtttgttgtgcatgttaaatttttctgctgtcctaagatgctaagattttgcctttcagtatctatttccaggacttgaagttggacagcaagcaactgaagatgtgtttttatcacttattgcttcatcaggcaaacttcaacttcttcataaggttctttcgagacttcatattggaccttatattgctatcatatcttagcactgcacctgaagtttaaactgctagaaataacactgctcaattgctaaattgcagttgctcccaagattgaaagaaaggggaaatcgtgtactgattttctcgcagatgaccaggatgcttgacattcttgaggattttctttgttccctgggatacaaatatgcacggtatgcttcattcgtctaccttctatcaattctctaaattatatgcttcagactttcgctgctcttttccttgtatatctagtaattgaatgacacttcttttggccatttcatggctgtgttaacacttggcagcatcgatgggcagacatcactctctgctaggcaggagagcatagaagagtacaaaaacattgatagtgaaacatttattttcttgatgtcaactcgtgctggtggcatgggagttgacctggtaatgtattatcatatcaacttagttctttcagttgaaactgttagcctgtagggcaagctcttaaccagcaactgcaatagtatgattatgcctctggactgacaaacatcattataatttgcagcctggtgcagatagggtaattatatacggtaagtggttttaaatgttttcattcactgctaattatataatttgcaagtggatacttgcactgatttggccttcctatttccagatcctgacttcaatccatttatggacttgcaagcacaatctcgggctcatcggatcgggcagacaagaccagtggttgtttaccaactcattacaaagtgttctgtcgaggaaaagatactgcagaagtcaaagcagaagttggccatcgaaaatatgttgatgaactcttccaagaagccaagtgctgatgagttgcagtctatattactccatggagcaaagacaattgtggacaggaagatcagtgcaacatccatccattatgacaatgaagccattgagaatctcctcaagttagacccttccactggtgagaaatgctcgtcggatgataacggttatcttggcagcattgtgagctttgctcatggcgtcgaggatgaagcaccttcttccccaaaggttgaggatctgaaagttctcaagcctgctactcccaaggttgatctcggccgtgggaagaggcaaaggaaagtcgtgaactacgctgacgaggttgagaatgaagacagtgatgatatgtatgccccggaaggttcgtcgacttccgaattcagcagttcgtcctccgatgatgaaactgacagcgctctgcagctgcaaatagttacagtaccggacattgatgcagattaggtgtacaactctgtttcttactttctgtttgcgtctttgccttttgggacccttgcctttttagtgaagggatggaaatagaaggaagcttttggataggagcagtatatatttaaaggttgaagttacaagtgaggaggtcgatgtagctattttgggtgttgaactgtaccaccttatgcagaaacctgatgatgcttgatggaaatccattagacagcgtccttgctgcactggtcttggaatggctagcgtataatctgtcttggaatcactttgctgcttgtgatttgtgggattagtatctctgtcggtgtcatatcgtccatttgcaacagagtaatattgtttcctacgaaaccgtaagtttcactgccagaatagcagaaatatttttgtttgacaccccgacgttatataagcccgcgagccgccgccgccgccgccgctgctagggcggacgagcgctcgccatggcggctagccgagcgaggcaactccacgctctctacctgacgagaggatgccgtgacccagacatgtgggccaacctcgccaaggtctacgcctccaactccttcctccgggaggccgctatcatctactcgaaactactgccccatcgtactcaccacctgccccttgtcatcgtcctcctcaaggcaaccgcctcccgcgcggatcccgtcctcggcagggccctccacgcggaggccgtgaaatccgccaacgcccacgaccgcctcgtggggacgacgctggtgtccgtgtactgcaagtgcggcctcctggccgacgcgcgcagggtgttcgacggaatgctggaccggaacgccgtgacgtgcaacgccatgctcgccgggtacgcggcggcgggagacatggtgagcgcggaggcgctgttcgccggcatgggctcacggactcccgtcacgtgggcaacgctgatccgggggttcgcggggaagggcgacatggcggaaacgcggcggtggtttgaggccatgccgctgggcatgcagaacgtcgtcacgtggaccgtggccgtgcaggcctacgttgccgcgggggacatggagaccgcgagggagctgttcaacaagatgcctgcgcggaacgcgtttgtgtggtcgtcgatggtcaccgggaacttcaaggctggcaatgccgacgaagcgcaagcggtgttcgacaaaatccccgtgcgcaacttggtgaactggaacgcactaatagcagggtatgccaaaatgggatgctgcgagaaggcactggaagcatttcactccatgctaaaggacaagatcaagccggacgagttcaccatggcaggtgttctctctgcctgcgcacagctcggttcgctagagcaagcgagaaaggttcacaatttcatcatccagcaccgtatccggaagaaccagttcgttatgaatggcctggttgacatgttcgccaagtgcggtgacctcgctttcgcacgaaatatcttcgacaacatgcaatggaggaacaccgaatgctggaactcgatgatctctgcactttccagccatggacagagcattgaggctattcggttgttctccaagatggagtgttcggagcagaagcctaatgagatcacacttcttgccgtactcggagcttgcacacacggaggatttgtagatgaaggactaagaatcttcagcaaattcgatatttacggggttgctgctgcagtagagcattacggctgcctggttgatctcttgggccgttctggaagattgagggaagcttatgagattgtcaagaacatgcttgttgaacccaatgaggtgatctggggctccctgctcggagcttgcagggtgcatggcgatgcagagatgtctgaactcgtatcaagtgagatccaccaattgcactcccgtcgtgtgtcaaccaacgatgcagagtacatcttgctgtcaaatatcatggcctcgtcggagaggtgggagcaggctgaacgcatgaggagaaagatggcgctccatggagttgggaagaccccagggtgcagttcagtggagctcgagattactgaacaccaagtatgtgcaggcagtggtacgttatcccagctacactgactgcattttttgcatgtcccaaatgttcttccgaaagtgttttcacaagttgcccagaaaagaaaagcccctcatgtgctggatattctattaactgtacttcttatacatagatgattagacaaggacattagattattagacaagggaattatctgttctgttgcatccctttatcaactggtgctggcatagaaataactacacacttcgtgtcaattttatatgctaatatcagtcaacaggcacaattgaattatgtatttgaacatcaatttttgtggttgaaatgttaaaagaaaaatcttcactaacgatatcagaaaatacatttctgccaaatttccaagatcaaaggcaccaaaacgacttcagggtgcagttcggttgagcttgacatttctgaacaccaagtacacgcaggcagtggtacgttatcccaactacattaactgcaattttgcttgtctcaaatgttctggcgaagcggtttcacaattggcttgaaaagaaaagggattttctatcaactagtatgcttcttgtacatagatgactgtacaagggaaatttataatctgctgcatccgtttatcaactggacacgatgctggcaactgtgcaattccctcaataaaaaaacggtcatgtcaattttatatgcgaataatgtcagtgtgcaggcacaactgaaatgtgaaatgtgaaattctgtatttcaacattaatatttgagggttcaaatcatcaaatgtgaaaagaaaccaaactatcttcactaatgataccagaaaatacatcaacgccaaatttccaagatcaaagcaccattaactattaccaatttactgcattgcaaagagaacacaagaacagagatgataacgaaatggcatgatcatctaggactgggaattcagaattcaaccaagacaagttaaactagacaatcacttccctatcatagatccagctgaacttgaccttcctctgctcatccttcttagccctgtcctcagcccgctccgcggcccgccgcatcctcttcgcgagcccgcacacgaagtcccgggccctccggccctcgccggagagcccagtctccagggtctccagcttccaccgcttgacgaggaactcgacgatgtcggcgtagtcgcgcgcggtgtagacgttgaggcgctgcgccacggcggcgaagtggtcgaacaggttcatgtcgcggccgtcgtgcatgaggtgcgcgggcatggtgatccgcttgtgcatcatgtcggcgatggcgagcatggcgccgtccgggtcgagccgcagcagctgctccacgatgcgcccgtacgccgtctcgtgccgcttctcgtcggcggcgatggtgccgcaggtgcgcgccaggacgtcgtccccgtgcgccctggcgaggcgcgccgtgttcccgtgcgacacggccgtcgcgcgctcctggaagctggtgtacacgaaccccaggtacgggttgttctccgtccccggatcctgccatggattcagcaacaatgctaagcaaaaaaaagattgaaaccaagcagagaaatggcatcaacatttcgagagattcgtaccatgccggagccgatgaggtactggacggtcttctcgaccatgcgcatgtcgacgcggccggagaggtacatgtacttgccgaggatgtcgccgtggcggttctcctcggcggtccaggtgcgcgtccagacggcccaggggcaggcgctggcgccggtctcgtcgcggacgccgtcgagcgtgttgatcatggtctggtacgtcggcagcgcctcctcggtaatcatgtccccgaccagcacgacgaagtactcgtcggggagccccgcggcgcgcgcgcggagctcgtggacctggtgctcgaacatctccgacgacgagtccggcaggaagtccgtcggctgccagcactcctccacgggcttgagcagcggcagcagcgacgacctcgcccacccttccagcgaccggaacacctccgccttctccggcggcatcgagtgcgtcacgcggcgccgcgtcgccgtcgccgtctccgcggccgtcagcaccgccgcggacacgcggcactgccggcgcgagggcgccaccaccgcgccgcagccactgacacgcacggttcccacgacctgcatgactgccactatcactgtcagtcaactacagtagctagttggtggttggtttcttgatttcttctgcctttctgggatcgccgagctgccgcggcgtggtatatgaagggaggggattcgcctccaatggtgggcgaaaccgaaaccggtgggtggtgcagtggttttgtgcgaacgagccgatggtgtgggagagcgaatcctgtgggtgctcgcggccgttttagccacgctcacagctgggtgcacggctagcctccacggtgtctgaggctcatggcttgtctccatttttggccagtgtatcgggtccacagatcgtagtgaacacgtccgttgctttccagtttccaattttccataccggagatctggctgtccctctcgatacgatgtcgccatcacaaaagggaccggggtcaaacggtactttgtccagctgcatgggacaagtaatctggccggcagtgacgtggccatgttgggaaaaacgagctacggcgagaatttttactgtcaactgtggagaacaaggtgaccaactttgttgaaatgggtggttcgtttttgttctgttgtgtgagataagcaggctggttatggtaaacaccgtggtccgcccctggatttcactaccaagcggaacggcacgtgcggcttgtgcatgtgcagcgctggtccatatacaagtggcatgcatttcgcggacgcgctggctgcagagggattccccgagcccaccaggcgccgccaccgcgcgctgctcgcgaggaaacaatcgagaccaggctggcctgcccctggccgtctggcgccgcgacctgcgacagattcaaaccaaaaccgtatgtaaacccactcgctcaccaagcggtttcgtatggccaagcatttaaccggagatccgcctccacgtcccgtgcaagttagcgtccgtgctcagcacgaactcgccattccttggaattaaatttaaaaatatactattgattcgtttttttttcataaatactcgggatgtaaatttgttagcagaaatatactgtcgatctcgcgcaaccgtttcgcataagtgacgtggacgtgacgacgcaaatagcatctataacaggtgtcggccccgtacaatgaaaccgtgacaccaaacgacgaaatcgaggacgtgcgtgcagacggcgtcagaccacacggtctcgcgcggccaaaccgcgagaccgagcagtctctctcaatcagtgagcgattacgacggttgaaaattgttaattagtgattgattaattgttaattaatcactaattaggataattaatcactagttattattcgataattaggataattgatcactaattaagtagaaccgctggacaagacgttcggtctcgcgatactgcgcggtgtgcgtcgtcacgcttctttgcacaacggttgtgcgagattgatggtatatttctgctaaaaattttatgccacgaatatttctaaattttacgccacgaatatttctaaggaaaaacaaatcaacagtatatttttaaatttaattccattctttgtcattgggttgacgagacgttctggaagccgttcttcttcgttatcacgccgactcggtgactccctggttcgcttcaccgaagcgacgaagatactatgttcggaacgagggttgggaaccgtcactccctagcacgtaaaataaaacgtatgattaattaagtattagctaaaataaatataaatatattaatatgatttttttaaaaaataacttttatataaaaaatttttcataaaaaatacaccgtttagcagtatgaaaaacgtacgcgtggaaaacgaaagaggtgagttgggtaagtagagataagaaaggagtgatcgcatcacaactcacaagcacatcaccggaagttttgcacttccaccatgttgtaaggaaaaagtttatattgcctttcctcaactatagtttaagtccgattcattttctcaccgtaacattaagactccttgaactagggttggacgtttggtcaaaccaaaaaatccggtctcgatctttgatcttctacaagtttcggttatctaaaaatagaaaccaattaatttaggaaaataatgaagatcaagaaaatcagtctcgatctcgatcatgactgaaatatcaaaagttctaaaataatcagggcaagtctaagttccagattaaaaaaaccatacacataaacacacacccacaaaacacaaattgactctcttcgctatcacgggccatatatcgaagcatgctagaggccaaaattcgatttaattgggttgctggaccttaatagtcttattgagccaaaatttgatttgtgcagtttatttagttaatcgaaggtactaactgaattgaccgaatgaaattcggtcctttaacacctgatactgatcaaatttctcagctttttcagtcctagttccggtctttttggttcggtttttttctgtctaccctggcttaacaaataaaatgaggagtgaactcctttgatggtttgctcagcggtttcaaccgacgtggcgtattcacctggtccacacgtgatgagtcagtatacacataagcgtcgatattgacgtagttaataataataataataataataataataataataataataataataataataataataataataataataataataataataataataataataataaagcaattagtccatatgtcatcctctctctcctccccactccccactcccctatcttctcacacatcggccatccttcatcttcgtcaagtgcactgatagcctaatccctccttttgccattgagtgtgtcagcggttggatccgctggggcacatgcaattcaaggttgtcagtaccccaaactgtataatattttacgatactaggatagtatgctacgaattcaaaacgatatcgatctcatctaatatcgtaattttcatagttactcgatcttactatttatttccacacgatcctacgaaatcttggatagtatcccgatattacgatctctacgatcctaccaaatattatttaataaggtggattgaaaataatgtgaataaatatgctcaagtttacataaaaaccaattaaatttatcaaaatcaatattatatattttaatttatacaacatattatatatcttatataaaattatgtaatttctaaaatctgatagtcttacgatcctacggtagtatctagatacttattaccttggatcatggttgcaccgatccaacgacgaggccaccacctccaagcactagtgccggagtgctccttcaatcctctcaccaccaccaccatcgttgatactctctgccactactgttgatgatagcacgttattatacgccttgcctctagctggtctctcctcatgcttcaaatccgcaccagtggcggggtggacaagctcgggctcctacttctcaatcgaatgggccacctacacgtgggtcctgatttttttttcttcgttaattgtaatttataaggtgagggtggaaaaattacacgtgatttctacagtatttttttaaaaaaattcatgtaggtgtcatattggtaaaatgaattgatagttgagataggcttaatgtttggtttaacgattgagatagagaaatcagactatgaggtagaatagacctttttcccggtgcgaacagagttggaaaaagtacaccgaaggtccctcaacttgtcatcgagttataaaatcatcccccaaccgcaaaaccagatatccaacgtcccttaactaaccaaaaccagtcacaaatggttctctggtggttttgaccccggttttgtcctacgtagcggctgagtgggccccatatgtcagactgccacatcagcctcctctctctcttttccttcccctcttctctcccttccttatctctctctctctcccttctctgacccccatggctgccaccgccgcctcctcaagctctttgcccgtctcgctgtccttagctcccccactaagcgctgcaccgccgccgctgacttccgtctcctcccacgccgaagcccaataaggtggtggttgtctcgccgccacttccactctcactcggcgccgacatcgtctcggccgtcatcgtcatcgtgggcgccgcgtccatcccggacacgcctaacagcttcacgctgcgtgggaggctcaacgaggcccgcgacttgctgtggcgcatccgcagggccggggcggccaccgccgacgtcgacgccgagctcaaggatatcggcgcgttgccgaggaggaccggaggtacgagtcgggcgcgttgtggcggcttcttcgttgcaagtaccggccacacctggtgatggccgtgctaatcatggtgttcaacgttgatgtggcagcctgatatatggagtccacatgggtcccacgctgactcagccgccacataggacaaaaccggggtgaaaaccacggaaggaccatttgtgaccggttttggttagttaagggacgttggatatctggttttgcggttaggggacgattttgtaactcgttgacaagttgagggaccttcggtgtactttttccaacatagtttcctacaggaataagttcacttcatgacccttaaagagtgatcgaaatctaatccgtaaccctaaaccacaaaaccggatatctcgaccccccaaactcttaaaaccggtgcaatttgactcccttggtggttttggagagcggttttgctgacgtggcgccacgtggcacctacgtggcaatattgaccaagcctttgatccacgtggcgtttgacgtggcacttacgtggcattaaagttaaaaaatttacgtgggacccgtttgtcattcacacacagaaaaaatgtggggcccactaactgtgggacccacatgtcagtcctccttcctcctccctctctcccttctctctctttttctctccccttcttccccttcggccggcggcagggcatgggctgcggtgtggcgccacccggcgggagctgaagcggtccccgcagtggaggagtcgacgatggcgaggccagctctcggcgagatggggtcgtcgtctgttctccgcactagccggcgacaagggtgctgatcggtgccagcgtcaccgtggccttcttgctcctgctcgccttcttcttcatcatcttgccgcgcggcggcacaccgccggaggtggtatcgtcgtccaaggagggcgggatccgggggcgtcgcgatggcggcggcgtattccaggttgagagctatggggagaggtgcgagcacgtcgccgaggaggatggccatgatcgccggcgattcccgcgtggctacgtcgactacctgtacctgttcgactgcgtgttcggtgtggagcggcgggttcttggctacggcgtgatggcggcttggctcgccgtgctgttctacctgctcggtgacacggcggcggtgtacttctgctccagcctcaagggcctctcgtggctgctccgcctctcccgacgatcgccggcgtgacgctcctgtcgctcgggaacggcgcgctggatgcgctctccaccatcgcgtcgtcgcctacggcgggggagagggggagaccaccaccgtcgtcaggaaacttgcaattcgctcacaactcacacgctcaacctcactgaatctctgaaactctgaagattgtaagactgtgaacagtaaactgaaaaaccgaagaacagagttctgaacagagtggtttttgtgctgcttaagtctcaccagtcaccgcagcttctctgttttcttctctatttattcatctccatcagcagttcgttacatgcataactggaaagaacaagccagacttcagccccagccactatatgcatgcaaaacagaaattaaaaagctcaagattgcacatcagcgcacacggcatcatcgccgacgaaccaccaagatcccgacgcgagccagcttcctcttctctcgtcgccatcgtcccgctcccgttcccactccctccccgccgccgactgcctccagtcgggactatccaagaagagccgcggctgagcggggacgaggagcctcgccctcctcatcggtgctgaacgggcgcgagtggacggagcggcagccggacatgtcccccgacgccgatgcagttgatggagatgtggtccagcgactcgcgagccgtcggagaccgcgccggtaaccgcaagggcgaggatgacgagcagcatattgggccgccgccgccgccgttcccctcgtcctcccactatcgcgagcctccgcggccgagccgccgccgtcctagccgccgactgcgctgcgccccgatgccgccagccgccgccgctcaccccgtcctcccgccgctgctggcaatgaagaaagagagaacgtaggagaggactcactgacaggtgggccccactttatttttttaatttatttgatgactagaatgccacgtaggcaccacgtcagcgaaaccgtcctccaaaaccaccgaattgcacttgttttaagagttgaggggtcgaggtatccggttttgtggtttagggttacggattagatttcgatcacttttgagggtcacaaagtaaacttattcctttcctacgtgcaacagatgtgcccaggccggactttgagaacgtgcggtccgtagctgttgggtcggaaacggcctaacgggatccccacggacgtgtgggctgttgtagttgggcctataaaggattgcccgaaggtttcggcctcttagatcaggccatggaacactaacgcgccgcacatgaaagctggcctagatccggcgttgtgttcgtttagaaggcctcccaatccatcagcccatctccggttctcctcacatttaactctgagctgagaatggcagaaaagttgcagacctcccctaaccttcgtgatgtggacagatcatgggcgagtacggtcgtaccgatgaacacttgaccctccgtatggccgttgatgttaccggtagggtgatactccctcggtcccacgatataacaaattttaaattttttcttagaccactcgtttcacctcacctcaccaccgcgcacgaccagagaaccaccaccctcctctcgacaccgccaaagtcaaaaagcaaagcgtcacgtcacgtagcgcagagcggctgcaactcaatgccaggtgggccaggtcatatactggccccacaggtcagtgagcctagaaacctccttcctcctggtatctggaagctctggtatttaaatcgcacgcgttcctcagccaccgccctcctcctctgcgcggagccgtcgtcttcctcctctactcctcggacttggccctcctcctcctcctcgcgccgcgccagcgctgacgtagccgtaggtcgccgggcgacgcgcccactaagatatcgagcagttccggagcctgctcagggggctgggtgcggccgctccggcgatcgccggagaagaagggtggttggaatctggtgagtagccggccctgatcccggtcgtcgtggaaatccttccttcctcttccgtggtgggcagcaagagattttggtgctccgtgatctggagagctgtgcgcgggactggggttaggtggcccccccaaggttcgatccggcccgatttggcggagggattcgaacgcggcgtattgggataggaagccgcgccggtggatttgttcgagcagatttggctgctgggggtttgtgtgatgggagatcaggcggcggcggatgcggcggcgagatggtgaccgggagctttagcaggagcacgtcggcgcggctcacagcgaggggcggcgtcgggagcccgcgggtgtcggcggcggcggccgcgcaccgcaagtggtggtggtgggcgccctcggggccgtcgttcgagtgcgctgccttggccttcttcctttcctccgtcgcgctcgtgctcgcctgcgcgctgtatctgtatctcttccggtaccagggccgcggccatgcggtcgccgagttcgccggcgacaacctagagtcctgcgacgtgttcgacggaagctgggtgccggacaggaggtaccctttgtacaatagctccgattgcccgtttgtggagaggggattcaattgcctggcaaatgggaggaaggacaccggctacctgaaatggcggtggaagccaaggggatgcgacttgccgcggttcagtgccagggatgtgttggaacggctgagggggaagagggttgtgtttgtgggggactccatgagccggacacagtgggaatctttcatctgcatgctcatggcaggggtggagaatcccaagactgtttatgaggttaatggcaatcagatctcaaagactatccggtttttaggagtgagatttgcgtcattcaacctgaatgtagagttcttccggtcggtgtttcttgtacaacagagccctgcacctcgcagtagcccaaaaagggtccgagcaattctcaagcttgataagatggataatatcagccggaaatgggagaatgctgatgtgcttattttcaactcagggcattggtggactcccagcaaattatttgatatgtgagttttcttattgtacttgtacttagcaacaccaatttgttcttagaattgttgtcatatctactgcagttaacttaaaaatcatgaacctaatatatgtttgctccaatacatttgtttttgcgaaaaatccttggatagatgttctgtgcatgccaatggtttggcatataggtagcacagtgtcgctttgaaagatatctgttatttagtatgtgacttctaagcaacccctagatcaaaggggtgctagacagtattttttttaagagctcaacacaatttatcctgttcaggaatcatgaagtggactgatcaaaagtattgatagtaacaaattgacaaaaacaagtgatgggttgccttgcaatcttagtgaagttacttgaggtcaaagcaacacaagtaccagtgtttttgtttctcctgtcaaaattgcctgatggctgatgttggtgcattccgtccttcaccagaatagtcgtagttaggaaatatacactgtcgataattgcattgtgtttcaattatgctattaagttatgtttgtgcatattcctcagaagtgtttctactaatgtggattcctattattgcaaattgttacaatttacgaacaatctactaaattgtcatttccctgtttcactaatgggtaattattgttttgtgtttttaacaggggctgctattttgaggctggaggtttgcttaaactaggtacatccattaattctgctttcaaaatggcacttgaaacatgggcttcatgggtgaaggaaaaggtggatttaaaacgaacacatgtctttttccgcacgtatgagccatctcattggaggtgtgttttctcacatacatcggatcttttccagtgtattgttcttcttgtattgtgttataaaggcacctaatgaaaacaagactgctactgttgtggtttgaagaaagtgtaaatgatttgcgaaagacatacactcatttgtatttttttccctttttgcatacttacagtggttcaaatcaaaaggtatgtgaagtaacagaatttcctacagctgaggccaaaggagatgacagaagtgaatttggagatatactcgctggggttgtggtgaacatgagcgttcctgcaactatcttgaatgtgactttgatgggggccttcagaagtgatgctcatatcggtatatggagtcatccttcaaccatacttgattgcagtcattggtgccttcctggagtcccagatgcttggaatgaactagtaatttcccaccttttgacaaatggtgagatcctttacattatcattcttttaacatattatttagagtaaagtgtactgatggcccttaaacttataggggtgtgtcatctaggtctctaaactctcaaaatgcatattcaagtcctagaacttgtcatagtgtgtcatctaggtcccaaatcgccataaccccttcagcatcctacgtggcgttgatgtggcatgccacatggacatgatgtggcatcattttgactgacaaatggaacccatttaatttttttccttttccttttttcttctctttttttcccgtttcgtctcctttctatgtgacccgagcagaaaaaaaaaagaagaatgagaagaaaatgaaaaagaaaaataaaagaagaaaaaaagaaaatgacacgtcacgtctatgtggcatgccacatcagcgccacgtaggatcctagaggggatgtgtcgatttgggacttaaatgatacactttgacaagttctaggacctggatatgcgttttgatagtttacggacctatatgacacaaccctacaagtttaaggatcgccaatgcactttactctattatttataacactattcctgtaaagtattgtgtagtaataatcccacaaaaattttcttctcttaagttattttttgttgcaagctaacctggaaccctccagtttttttatatatagtgcaaaatatgccatgtattacttggtacctattgtccccccttgttattttttctttgacatcaaaacctggtaagattgttcggttcataattaaaaaactgaactttgtactagctttgtgtaaaaccaaggactaaacatgatgattgctcaatgttgaaattgggtgggagagaacttacctgaacacaggaatacttccaacttacctatactccacttgtcaaataatttatggtaatcttatcccgaatatactttgaatgtgatagaaaaaatagtatctatactcctttaaaagacctcaatggtggtggtggtgaatctgccaccatacctatgcacttatgtgggttcatgctgtcagtgtaaccacggttgtgcttgaaattcaaatcagtgaatccatcatctaccactctacatcaaaaggtgagccatatgaaccagcataatccattcacatcgaatttcaaagaaaatatgatttttttttcaattaacattgggaaaagtaatgacataatttatttttaatttcgttgcaacgcatgggcatttagctagtatatgcagaattcaatctgttgacgatgatttccactgcatgcgctgctgtctttgaattgatggagataaatggtgatatattgatctgatctttcctcacgtgcaattttgcaggttggcgaaatttggctggctgactgactgctgacattatactttgtttttctttttctttttcttttttgtttttctgctgcttctgcttcgtctgctatcaagtagcggaccatgatttttttttcttagacagcactacagcagcatgtcttcatcttggtttttccttttcctcaagtgctccttatacacgcctccggggttacagattttgtatcattgtctattttgcgttttagacagaacatcacaatcggcaacctgtatgtaaacaccaattcatttgcaagttttggaaagtcatttctcatgcatgaaatctgtttggtctatttttttcttttgtgctagtcgtacatagaatgcaatcaacagttttccataagataatctgtttgctctatttatttttgtgctgcagtggtattgaattcatgctaaatctattgtgaaggatatcgcagcatttccggatttgcatctatgcggctgtgcctaactggcgagtactgtacactctacagtctaagtggacactgatccgccagatgccgacctgtcacctgtgtgcactgtgattcccgtgatcatgtccagggaaccagtaggctacgtggaagaggatgtgaaaaaaccacccatctctattcgacggccgcgacatcatcctgtggggagcgagctgtggtgacaaaatcacagaacgacaatgtcacatggctacattgtgaatatgtgacaaactgacaacaggttgtttagttttccatgattaacgtatgctgatgtacaaaaactgtgcatgtttgcccggcatcgtgatggactgatggcttcgtgttcgctgggaccggcagatggcatggctaaacgaactctttagattcacccggacggggatgcaacccaagagggaagtgtctgccgtgcacggttgggcaatttcaagtatccttagcgtagcttcaaaagatgtctatcatgtcggcttcacgaggcaaaccagggcagagcatgtagaggtgaggaatgctatcaaactccaaatcgtgcgatgatcatgacagtgtttcgtggggaagggaatgcagtggaatgaaattatctgcattatattactttctgccagtaaaaacgaagactgtggtttgcggagagacattgtatcaccggtcttgcactagcggaacttccgcaggtgagatctgattccgttccatcttgggggtgcaatgcttagaaatggaacacacaatccaacaacataaatggttagcaaaaccaacagcagaatttcaactgttaccagcaaatttacacacatcaatgccttatctgcaatggggagtactttccattactgctgcacccatcaaaatccatcctcttcatttctttcctcccttgcccatttgcccaaccaagcctcagctgcccccgcctaataccgtcgccgatataaccaaccagtctaaccaccactacacactccactccatttcccactcgactccatccagacattgtctccaatgtcgccgccgccgcttcgcctcctcctcttcctcctcctgctccacctcccctcctccctctcctcgcgccaccaccaccacgccccgtcgccgtccaagccggcgccggcctcctacgcggcgccgctcgccgtcctcctcgcttgcaacgccacgcggttccagcccgcctgcgtctccacgctctccaacgcctccgccgacgcgtccactccggacctcctcgccgccacgctctccgcgctcagggcccgcatcccgccggccgtctccacggcgcggtccgtcctcgccgcctcctccaacgtcaacctcaccaacgccgccaccaactgcctcacgttcctctccttctccacccaccgcctctcgccgccgccctcgacgtcgtcgccgtcgctcctctccgcctccaccgcgctcctccacctctacgactgctggtccgcctacaagtacgtcaacttctcccgcaccatctccgacgccatggcctacctcgacgacaccatcgccgtcaacagcaactacatctccatgctcgccgcgctgcagcgctacggcgacgacaccttccggtgggccccgccgcagaccgagcgcgacggctactggccgcccgcggcggcggggtccgccgccgacgaggacgcgctcggcgtgcccaaggggctcccccccaacgtgacggtgtgcggcgcggggtgccactacaagacggtgggggaggcggtggcggcggcgccggactacggcgacgagatgttcgtggtgcacgtgaaggagggggtgtacaaggagacggtgaacgtgccgttggagaagacgaacgtggtggtcgtcggggacggcatggggaagacggtcatcaccggcgacctcaacgccgacacgccgggcgtctccacgttcaacacggccaccgtaggtgcgtatacccgtaattttttccccttctttcaacgctatcttgtctttgtacgtatacggtagctggcacagcgtacgttttttctctacggtggtacacgtggtacgtgcatgaatcaatgcggtgtcattagctgctgctcgtgaccagccaatttagcactttgtctgcacctaaaatgcctttctgtgaatttgtgacgtcggccattaattgttggcttttgtgaacattgcgttcggcatgcgtgaggatcctctgacatactaccattacagttattgagagcatccacgatgtgagacactcctagatgtgagacactcatagagtatcttcactaactaaagacactcataaggaaacttagcttgtgagacactcatagagtatcttcactaactaaaaacactcataaggaaacttagcttgcaatagaggacacccctggatgtgctcctcaaaatctgaagaaacttaatagagacactccaacccacaatgggtatcccagcccacaaagtcccatgtttatttttactaccctacccctaatctctctcccgccccctctttttttcgccgccctctctctctcgccagtgtcgccaccgccccctcctcttttttcgccgccgccgccgctcccctctcccttcgctggcggccacgaggacgatgaggagggccgcctctcctgtcgccggcatccaccgccgcccctctctctccctctctcccgtcgccgctcgtcgttgtcttccccggcatcctccgcctcgcgccgtcgccggttgggggcgccagatccggcgccgtagtgggcggatctgggccccccgcggccagatttgggaggcgccggcggtggcaggcacggcgccggtggtggcgagtggcgcgtggatccctcgtcgccgccggaggtcgcgtgctgcgccgtcggatccatttctctctctctctctctctctctctctctcgcgcgtcacggggtcggccggaggccgtgtgccgcgccgccaccccttttcctccgcccgtcgccttcgcggggtcgtcgccggtcgtcacctactcccaacgacgagggcgaggggtggaacggtaaaatgtggggtggtagcggtgtccatgggacactcacctagccacgccctctgcaatgcgtctcccggctcggtgtctcagctaaaagttgctaaggaatgcgacccctagcgaggagccgcgcgcctggcagtggagaaggtccgactgaaaagctaacggagggcagacggccgttcctagggagacgacccagggacacccattgtggatggcctgatatatggatctcacccttctatcgttctacgtgtcaatgtctgtaacaagaatgtcattataatagatgatgtgaaccctacttgactacgtctatattaggaagttatttaaccatgagaatgtgaaaattgtacccccaatatctcttttccactgtccatgataattagtcagacactaccctaccctagtcttacatggagatcaacgcaatccctgatgcattttttatcgctatttatctaactatgtatatttgtaaaaaaaataccatatattaaaatataagtttcttgcagtgtttttcatgaaaatctatcaatatggttttgtgtgaaatctaaatattttttaattaattaagcatgtaaggtttcaaggtttgacttcacgcttttaggacatctgtttagtaggggaacgccatttgtgtgatggtgagtcgtgtatatatgactctacctacgttagttcaaattttgatgtacaaatatatttgtgtgcatgtctggttatgttcagggtttacattaccgtcggtaaccacgcggttaccgcagggtacggtaatagaaaaaccgcggtaacctccttaaattcaaataaatttaaaaaataatttaaatttttgataaattttgcatggtttcgtacgggttttttcacggttactgcgtggtaaccgtgcttaccgccgaggcgcggtagtcccggccccaacggtttggaaaccctggttatgctgtgtttagttggtgttgatattttttttataaaaaaaaaaacttgtggtagtaccgcatgcagttaatggctgctaattgccattgaagtgctagagtaattcattggacaattggacagatatgaaatttctatacactacaaagatgattccaaatctttaggtacatggcccaccaatttcctggtagccctaaattttaggtaagttttggccctaccaatattttgatagagaattctattgatgtagcaagtattacatttaaccccaaacaccacacaggtagtactatttagactacaaaatttagaagggcaagatttggcactgaactaaaacaatctttttcttcagaattaggctctgtctccagacctttggaggagaaagagagtacaaaccatctgggatagtgggatgtgataaatacttgttgtgttttcccccttgcaaatgattaatcaatcggcttatcgcgcaatgaaacattcgttcttttttattcgttcttaggccatccaattagtgtggccggaagcgacaatgcgtcccagcatcacgagcctctctactcataggcaaagtaaaagattgtaccttttcgtgcctttcccttttgttggtccctgccaaacagatagccaaactaggcgtggactgccgactagacctggcatggttcgttcggctagtcacaactctcagttttaactttaccctgagatgtactatctgtcacgagacgtgatcgtactcgtgctcacagtaatcctaatccggctgtaatgtgtttggtgatcttaatctcttatctgtttccaggcgtgctcgcggacggcttcatggcgcgcgacctgacgatctccaacacggccgggcccgacgcgcaccaggcggtggcgttccggtcgacgggcgaccgcacggtgctggacacggtggagctcctgggccaccaggacacgctgtacgcgcacgccatgcggcagttctacacccggtgccgcgtctctggcaccgtcgacttcgtcttcggcaactcggccaccgtcctccgcgacaccgccctcatcgtcctcccgaggcagctccgcccggagaagggcgagaacgacgccgtcaccgcgcaggggcgcaccgacccggcgcagcccacggggatcgtgctccgcggctgcgtcgtcaacggcagcgacgactacatggcgctgtacagggagaagcccgacgtgcaccacgtctacctgggccggccctggaaggagtactcgcgcacggtgtacgtcggctgcacgctctccgagatcgtgcagccgcgcgggtggatggcgtggaacggcgacttcgcgctcaagacgctctactacggcgagtacgagagcgccggccccggcggcgacggcgccagcgggagcaggatcgggtggagcagccaggtgcccagggaccacgtcgacgtgtacagcgtcgccagcttcatacagggtgacaagtggatacccaaaatacattagttagagcagcataaaaagaagtaaatggtggtccattgtgtgatcccctcgaatgagatggtgccaaactgccaacggcgtatagccatttaactgtgcaaacgcattgtgccgtgcataatgtttaatgaaagggtggccaaagccttttccttgatcaatgaggatgtatgatctagtgctagccgaccgtgaacgtgaaggctaaatctatgaaaagaaacagctgaaatttccaattttgagtcggccgagtgcggatgcagacaagcagataggttcggcgtgccgcgtgcgctatccgcaattagcatgactgaggcgtcgccagaacattatcatctcgcctcactcgtagtggtggtccatcaggccatcactcgcagcaaccttttttccgccgtagcgtccaccgaccaccgccctcttcaccgccccatatgcagatgtgcgcaaccggccctacgacccaacgagcagaagtactgaaccaagaccaaccaacttcggagttgtgctctgcgcctccgcctacccacttcggaagtgcactggacaacgaatgcgccgtgacgcaccagtcaatgtcaagtaaacagaagcgccaagatgtttgtggatcgtcgatgctaatccacttcgaacctggcaaacgaccatctattcgactgtaggattgtagtaaggaacatggacaaagggtgttgactgccttttgaatgagattatcaaatgcgacacagaatttacgggcccagcccaacttgttcagagaggccttctttggacccttgagttcgaccttcaagcccaacttaaccaacttatcattttagatagaagcagattagaattttgaaaaggtccccaatataggtccgatcttatttagcaaccactaaacccgtgcaaaaaaactccttgacaatgttgatggtcgtttttactaatgtgacattcatgtgatagcccaatcatcaaagaaatttaaaacatatatatatatatatatatatatatatatatatatatatatatatatatatatatatatatatcccacatgtaaatgattaaaaaataataagtcaatcaactcgtagggagctgctggaaccaccaccgccttccacgcccttcctgcttctgacgaccatggcaccccaatcctaggagagaggacgaaaggaagaggggaatagtcaccggtgccctcctggctccggttcatcgccacctccacccctctcgggctctctgtctctactgtttgttggaagtgtgatgggaggaagagtgaagagaaggaagaggaaagagagagagggagacgtgatgaagaatatgagacatggacttacatgtgggtccactatttaaaaaaaactagtatggtggcctgcgcagcttgcgcggctagtatcattatattttctctcatataataataatatatatgttttctcaatatattattcaaatatattaaaatgatataattttaaattttgcaataactttacgaaactactaatgggtaatattcatattgtattttatatacgtgttagttattaattatttttaatatcaaattttaattatttgtaaattatatatatatatatattcgtatatgggctctagactcgtcttttaatatttatttttttaattccgaattttctgtaaattgtatttctatatagactctatgctcttattataatattatttttttatttctgcatttttattatttttaattgtatttctatgtgtactctaaactcatctttcagtattctttaatttttaatttcgaatttcagttacttctaaattgcattcctatattgactttaaactcttcttcccatatttttcttaatctcaaattttagttatttgtaaattgtatttttatacggactctaaacactacttttaattttattatgtttgttctgaattttagttagttttaaattcactctatactcttcttctaatattccttattattttaattccgaatttctatttttttcttaattgtatttctatatagactctgtactctacttctaatattccttattttttaattccgaatttctatttttttcttaaattgtatttctatatagactctatactctacttctaatatttcttatttttaatttcgaatttctattattttctaattgtatttctatatggactttatactttacttctaatattccttatttttaatttcgaatttcagttattttctaattgtatttctatatggactctagtctcctattctaatattccttttttttaattccgaatttcagctatttctaaattgtatttctatatgaactctgttttttctttttctccgattaatgtgaaaatttctagaccatgagagcaaacgtaaagactcatttttctattcctttaataatatatataatagatagatgtgccacgtaggataaagactaggttagtgtgccggcacataagacaaaaaccattgtccaaatcacatgtggaggtaaatttgaacctgtattaatagtagagggagtcgttcttaactggttttatggttgtacgaataatatccgatctatattttttaggaactctgattgaactttttcctttgagttcggttcatcctttgtacacgttctccttgtgggcttctttccttctgtaccggatgaccacatgcccactactgagccctcacgaggcccaccatatccactactcgaacacgaacacgagaacctttacgagggccaccatatccactacgcaaaacacgagcaagaaaccaaccgaatagtccaatacgtccggcccgtggcatccgtgccaacccatcgaccatccggctaccgagcagcacgccaaccccaccgggtgcaccggccgggagctgccccgatccgctatttctgagcgaaaacttctccgattcgaagcccccgcagccgaactcggcgaagtccccatgccaatctgactagccgcccccgatccgctgccgctgccaccggcatggcagatggcatccccgcacacgccgtcacgtacgcggtacgtcccagcgtgaggaccggccggccctcctccgcgtcgacggcgacggcttgcacaagactgtagtagggtaatcccttcgccctcccgttttctttagccggtcaaagcacgaaagctggcgtctggcctggcaccaggtacgacgagaggacgcgtgtcgcgggaagggtccctccctgcctagggcagtgggcactggagtggagtcggtccatgccctaccatgcgcgacgaccgctcgctttgcctgacaacgctggtgggtgctgcctgtggcgcagggccgcggaagatgacatactacactcggtggccgcgccacactctcgtgctcgcccggacaagggacacccggactccaacaccaccacgtgtgtactcctaccccgtacgcctctctctctctctctctctctctctctctctctctctggacggctgggttggtaggatttccacgatattcgcgtgaaatgtctcgcagcccactgggaatttgtttatgttcgtgctaagtcgtaacaagtccagcaacctcataaacaacagcttgatgaaaccttagtagctgacccgtttcgtttactacgactcctgtagatttagctagggatgctcacgcaattcacattttcctcatgtttcagcttctggctcactgcatttgcaagttacttctctcacaaaatttgctcatgtactccgttagctgtgtactgcccccaatgccaagctcgtggatgaacagtaccagtatgtagtaaagtaccagtagatgcataaatgcattataccactactagttcttgagaagtaaactagtcaatcacttgtgatgcaatcctccaactactcccatcttgaaggacaagggaagtactactagaaagagagattaggagtatctttggcgaacgacgctgctagaaattgtacagcctaacacttctgctttagtcggtgcgttgccgttggaaaagggcagcagcatgagctacccccgaaaggctgcatctcgaaggaacggaagcatggctaaataattgatactgggaaattatgatgttgttcttctttggcagcatggcattgccaccagatctcttcagaaatctggttgtgcccatgttccacacctgcagtgagcagcagtgcgtttcaatgctgcattgttaggttggcactgcctctctgcctgtgcagctgtgcatcagtgccccacgaatggggctcatcacttgagttttgaatgcatgtttgattgcaagtcccgcaattaattgctatgagaaaaacaaagattcccatctcttaagccttaactaagtatgccaaatataagcaaagcatacatacaacctcgtgtgcttcagggacttccagtgcaaaatggccccagctgctccaacgtccaaccatctgtggatgtcagccgtgaccgtattaatccaactcaattttaaaacaatactgtatttcatgtcaaaatgaggcagtgtttgctggtcagcaatctcatgttgcgtcactccagattttatcaccgaaacagttcaaccaccatacatcgaactaggctattgcagccgagcaacaaccaaccccagactgaccaaacaattcatgaacagaaaatttacctatactgatgaattattggccaaaaaaccaaaaaaattgtgagctatcaaagcagccagagtggagccgaagccatgatagcaaacacaaggtatagttttgtcgagaaacctaagcatagctacctttacaagctgttgctatgtatgtatggagcttagaagtttgtatctggtatagggctatctacacatctcatgaacttgtgaggctcgcggtaggtgtggccggcacagggttttccttcgttgagttcttggattcaccccagtgccataacatgctctcccagaagcagaacttctcaaagcaagttttcagcctaggatcagttatgttcctccgccaatgtccatcggtgaagtttgctttctcagcctgcctccgatcccactccaacccagccttttgccttgatctcaaaagacaatagtgctgaagtttctttggcatcttgtcatgtaccttccaccaacgggcatgtgcaacatcactggcaaactcccgcagtatcgggttattccagttacagtcgtaatcccggaagcacagccatggtttgagacccaaatagtgaaggacatagaggattggtgggtcagcaccaaacaaccgagtcttcttcactttcacttcctcttcatccccctcccagaaatgttttaagaagttcatgtgcttcggaattcgatgccaccatgtgaatatctcattcaggtatccttggtcaccaccattgtaggatgttatctcattgatgtggtccatcaacaactggaatgtgcagtttgaaggctcaataaccattactccagagttgaacagtgtcgcattgttgccggttgcagtgatttctggcattgcgaacagaaaatcgacatttctcagaatgaggagatcagcatcaataaatataatcttgtcgtaatctgtgagctgccatagacggaatttgctgtagttccactcattatatgcatcacgctcagctttcggattccggatcctttggattattctaaccttccacccagcagcttccaagcccttccggtggtggttacttatggtctcgtcaacaagaataacaaaatccctagttgatccggcttggcgaatgctttgggcagctgtgattgcaccacagacatattcacttgctgaatgcagaatagtagcatatgcttccctccgtctgtctaccgagtaaagtcgtgctgtaaaggagatgaaagatgttatctagtggaaatttcaatgccacgcaggaaaataaaactagaaggtgcaaaagtatgttctaacatttccggacaaaatcaccaaaacattactgatacatctgcgataaagcaaccactcttgctcattcccgaaaaagaaatgcaatggtagattctaaaagcttacttacagcaacatcgatattttaactacttcatatttggctctcttgttatatatcatagggattaagtggcatgaaatgggaagccatttaaaaatgaaggcagtaagacataccttttgctttgagtggaacagcaagttcacaggatccaactggaagtctgagcttctcccttagtgccttcaagtcaggcttgtacatccaagcattgccttcatgtttcacaaggttcttgcaagagaagagatttggaatagggaagcaatccgtcacaaacagcacatggataccacgattgcctcttgaagcagtcactgccacttttgcagcagatagttgcaaatgcagacgtgcaacgtctcttgaccatccaccagctcgggtacagggaagtttcacagcaacaacatcaaagtgtgtccctcttggaaaaataggatctggaagcgatggacacgatggtatctctgtttcttcctcctcatcaatccattcagggtaaagagtctgccaggtgatgctttccttggcatgctctagcctaatgatcgaaaaatcactatccgggagcaattgtgtccatgagccaatttcagtgctgttaaaatttaatagtccaactttgagcttccgttcaccatcattcagattttcgacggttttatatacatcctcccactgaacaccaagcgaagatacatatcgtggatcaggaatggtcttgtcccatatccacccactgacaaacctgtaaagcatatgaaaggtatggtcaaaaagggtaatgcgcaatttcttattatatataactccaacataaccactgtgatgcgagcaggaattggtgttctagtttccactggatattctactgctgacagaatattgtaataagtttccttttgataggtctactcaccgagaactagactgcatttgatggtcgtacacagatggagtgtacaatagtgtcagaaatgcagcagacatgatcgcgaagagcagaagttgtaaggaccggaacttgcaaccagagcttttctctaggacaaagacatcaaatttttcgacctctttgaaacttttgcttttctgggtccttctcttagctgtgtcatccctgaaagaaggtatagaagaaacagtcagacagcgacttcttacagtaattatttgggcatcaaataataattggtaaagaacaattcagaaagcaacccctgaatgtaggatagtcagcaagatgaaacaaaactttggaatttgcaccaggtatgaagacacaagggggaattctgtctgaagaagaaattgtatatgaaagaactactgaataaataagtatgatatattttccccaaaaaacagcttacattgttgtactgttttatcgaaagcacatggaagtaataaaaattgctagccaaggtccatatcaattgtaaggccccattgttcccattagttaatcccaaaaagatagcttagaaaacatttttcttggtgatcatgttttgttttcctagaagtttgcactagtcttgtgtgtatttgatctggctggcctatatggacaaacagccctagtaacactaaatctataaaaaaaatatagcacatcttttcaaaggagtacttaatctctcatacggtagtatggaaaagcgatcatagtaaagttgattagctatcaaagaaaaaaggctaaagagaacaaaatagcaaggttctccgcactgagaattaaagaaaaagattagcaaaaagaagtggtgccaattcattttcctccattcttcctttattagtcacaccacatcttttaggaaagaaaagcatcactaatcacaaagatactccagtacctaaccccatgttattggtctcaaatttaaaagtgcgcttagcgatttaaataacgttaaacatgaaacgaaaagctgcactcatgggtaatcccagctgtgaacaccaaagctttgtcaagaagtttgattcaaaacaacggagccggcccctgactactgaacccactagactagcgtgcatcgaagcatccaactagccaaaacccagcattctatacacacgctaagctcgcccatttggcgctgatgggccacacaggcacaaaacaactgtagcttacgcttcaacgtgcctaaagactggtgaccactgaggactgcacatggaactaatgtgtgtagcaattttaatggcaccggcgatgcaaggtgcagtcattggggtcaaattggcagtgaaaacacatgaccaccgacgcctggctccacatcacagcacatccaatttaaccaaattgcagccgctaaaaaggggatcagatggccacaaaagtaaaaccaactttccgtctggagataaaggaaaatccgcaaaaacagacatccattttctccacacatcagcatcaaaccaactcgcatcaggagcagcagcacactagaaaagagagagtaaaacatgcagagatagcacgtttctgctgttctctgattctctcttagctgtaatcagcagcagcatcaacaagggggaggatggaaaaaaatggaaggatggatgccataaaagctgcacaactaccacccaccacaccacctacaatatgagggaagttaaggaggagagcatgatgaacggagaccaaaaggagaacaacggcatcttgtacagcgtactaaaaaccagtacaccatcaccactaccacctcctgcaagaataccacgacgatatggccggcgccgggcgccacgcatcgaccaagaagtagaagtaattagtttttgagtcaatcgaactcgacatgcaacacatgatagcacatggcaaagcaacgcaccacagtagccgggttagcaagcgagcacatacatcaaagcatgtaaaccagctaaagagagagagagagagagagagagagagagagagagagagagagaagaacagtggaagagaggcacgcaaaggtggagcctttcttcagatcgggacagcgtggtggtagggagatcttacgctgctccggccggccggtaccgcgtgttcgtcgtctccaaagaacccatggggactctctttcgttctctgcgagcccacctgaatcttcccccgagccgtcagctatggctctccggtctcaggcggtggccgaccacactgtcgccgccgcggtggagcagcttctcatctgaaatcggagcaagaaacaagggaggattcgtgtgagcatggagttcaccgaggcaaaagaaaacaatccaatgcggccacagaggacgaaggaagagagagagagagtagcaggcaaagaactgaaattttcccgagaagaacagcatcatagtgagagcaaagcccaggagaacaactacacacacacaccaaaaaaaagagtaaataattgataaaaatgcgaagtagaagggagctgcaaaatccaacatcgccactggctaggagcaaggcaacagaaaaataaatctgctagctgctgccgcgcaaaaaaagagagaacccggacaccgaatcgagcaaatggtggcgccacatcgccatcggaaaaaaaaaacccagaagcaccaagcccggatcgagcaactcccaccggcaacgcatcaaacgcaaaccagatcaagaagagcccaggagcaacacaagaacaggaggcacgcagatgccacacggtgaggaagaaggggaggaggatgctggatgcagcagcacacgcacccgcagagaaggcggacttgggagcaccgacgggcgcgccccggcgtcggcgtcgtcggaaatggccgcagttggtggcggccgagtgggttagctgggtgccaccggctctctcactcctctctctctactctctctctctctctctcgctgtgcagagctcgcggccaagggggtgtgaggcagcaggagcgcgttatatacaggaaacaaacggggagagacgggggagaccggagtggaagcgaagttcttcaccgatttttgcccatttttgccgccccgcggggccaatctcgtgtacgtcaagggcccagatttggggatgggctcacggtgattagcgtagtcggtgagaattgttaggcatatatcaatggtggcaaagaagataatggactggaatagaagaagttaatggagaattatgcatgccaaaattggcgtatattcgtcctagtttgtaaccaaatcaaactgggctttattaaaataaagggacaattgtttttttaccctaattttaagactaactctgttttttcgactttactcatttaaccttcttttttttaaacgaagatgaggtttggccctattccgtgaaggcaacgtgacggtgttaactcaagacaaaaattccaattatacccttgtcaatttaacccagtttctcgtgcaaatttgtgtccaccgaaaaagaaaaacatgtcacatggtgcgctgccaccgtcggtgctccctcctctccgcaccaccaccgccggcggtcccttcccctgtgcactaccgctaatcgcccgtcgccgccgtcctccctgttctagtcaaggaggagcagcgccaccgctcgtcctgttcagatcgaggaggagcaacgccacagtcgtcgtcctctaggcccttgtccgacgccgctcttcgtcgcaccgccgcggccctccacccgcaaccgccaccacggcaaatcccttcacgcctcgacgcagccgtcctccctccctcccttcgtggcccgccgccgccgcccctcgtcgagccacggcagcggcccctcctcgacgcgccgctgcggcccacccaccgccgctacctccacccgcagctggtgtcgccatcctccctccgcgagctggcgccagcgcggattccctccctcggaggcccgccgccgccctccatgagccgccgctcctcgtcgagccgtcgcagcggcccctcctcctcaacgcatcgccgcggcccacccacagacgctacctccacccgcagccggcgtcgccgtcctccctccgcgagccggcgccggcgcggattccctccctcagaggcccgccgccgctacccctccgtgcgtcgctgcccaagcacacaggatagggttagatgtgcataggcttggagggcattttggtcattatggaaaataaatttatttcttttatttttttaaatgaaatcttaacggtgctaaagaaacagggtcaaacggagtattcgtttttaaaaagtaggatcaaataagcaaactaaaaaaaagtagggtcatattgataattaggcttcgaaagagggtcaaataagcaactttccctaaaataaaccggtgcaaatttaatggcttccaatatgatagtataacagactatacagtagaataaatctcctacttttgccagagtgtttgtagcacttcgaagtacgaactgagcttagctcggctagttatgtccgtggtagtaaaacatggccacactcgagtttaaattataaacttaacatgggacttgtatttacattaattatttttcactattagcaatatacccgtcaatagtgaaatggttctgatatgcttaatcaaccttcaaatactcgtagaggtaagatgtacttcctccgtcccaaaatataacaactttagccatcaggatttattctaaatataataatttctccaccaacattctcttcctcaccaatcataaccctccatcattcactttttccacctacctctccactaatcatccaatcacaaccctccaccattcacttctagtaacgtgtttaactctaaaattttttatattttgagacggaggaattgcattgcaaaaaacattcgtagcacaaaaatcgttgataaatcttaaaaaaaatcattggctcacaatctaaggtgtgcttggaaattcccgttagagtactttctttacagtttatttcactaaaatattcgtagattatttgttatacgcttctaaaaatgtgtttcctagaaccttaattttgataacttattctaagttatttctgaaagtttattttagaaattatgtagataattcattacattaattcaacgaataatcttcaaaagttgcatgcaagttttcaatgagttgaaaagaaaagcgaaccatgtctctatcaatatcaaactgcatgtgtaccttaggccttgtttgtgattgtgaaacttctaactgttgtattatctttcaaaatctattgcttccaaacaatttcctcgggcaaattcttagaactcatagtggattttttttatttttaaaaagttttattaatttccaaaaaatatttggcgtggcagcgttgttttgccacgcctgccacggtggtgtggcaagacaacactgccacgccagctacgcgtggcgtgacaaagtgatttggccacgccatgacaaaaggttcagatttagaaataattttcagaaatgtctattaataaaattttaaaaaaataaaattctaaaaaataattaaaaaaatcctcatattgatagaattaaaataaataaattagaaactggaaattgggttcttaataacttttcttaaacactcacggcagggtttacgattccgacatgcacttccattttgggcactggcggaattcagaatttcgtgaaatccggtggaaaaccggtaaattccgaataaatttcacaaaccaaaatttgaatacaaattctctgagtttgccgataaattcttgaaaaccggtcggtttaggcgaaattccgatcgaaatcatcgaaatttcgatcggtaatccggcccatgtaagtgttttcctttttttatttttttattcttttcttctctgatgtaagtttaaatacacataatatatcatttttttcgaaaatttatatcccaataggttctatgaatatcatagtatttataagattttatttgattttttcttttttttatcaattcaaatttaaatttggatgaaacttctcgaaatcttagatgatttctactttcgagactcgtcgaaacgtcgaaattttgcgaaatccgaccggatttcgtcggaatggtaaaccctgctcaccggctagcttggcattagctgccttctcaaatactagtgcctaaagtccacagagagcttcctgtacgagtttccatgagtttataacaaggttatgttctaaaacgagtaaaaaaaccctgcagttacggatctgtcctcaagtcttttggtatttggtttcctagccaaggccatcatgctaatcagcttatatgtagtcaagtttacatgaagcatgccagcatggtgctactgctacggagtagaatctgggcgttcacataaccttgtgtaaaatggcatccaagtcgtctggtttgacccacgttgacgggtagatgagatcagcttgacgcgcttaggcattagattggggcaaagcgtctctctgcgtgaatccacgcctaaagacagagctaaacaacactctactctctctaggttggaaaagcttaacccagtggtcattaggaaacttccccgccatagagttctcatcctacccaagattactttacataagcttttgtcactattaacttctaatcagttcagccgtctttgatcgctatgtagttgaaccatcctctctttttgtcctttgctactctacctatatatgcaaagttgtgaccaatgcgtgttctctcaaacctaattcaacgccatgcgtgcatgaacccattcagagatcaaacaatctgcagaaaattccatggtaaacggttaaaaagaaatttccatgtcacaggtatagggtcaaattaaacatttgaaaaaccaaaatttccatgttgaaattaatggatcgatgttacggtaggattaggaaactgcattattcctgaacttttacgtccgtttttttcttcccttctcgtcagacaaacgctagtgatgctgttccaggccgaatccatgacaccatcaaaggaaacggctgtcaagcctggattgacgggggccaacgggcgctttcacatgtcggagacgcaaaaaagccactttgccggccggcgccaacacattgattggctgcttgagacctgttcacaagctagctcatctcgtctcatgagtcatggaggccattacaggttttcctctccaagacgatgctgctaagcgtcgccatgacaccatggaaaggaagaaaaggaggggaataaaaacggaaggtagctagcttgtgccgctcaggccatgaatgcattacacctcgaaactaactaaattctatcacatcgtcttaactcgattgtgggcttaattaggaaactgtcctcttctggcgtcctcccattcataggcgataggtcgttaatcacctgtttcatgtaaacactattgggtattatcactagggatggcaatttcccccgcggggccgggtcctctgcggggacccgcccctacggaggcaggggcgggtgggatttttcacccgcgggtgcgctggggtcggggccccgcatttggccggggaggggacggggggaacatttcactcgccggccacatctcggcgtcgccactcgccagccaccatctcccctcccctcctctccaatctcccctccggcgtccggcctcacgtctcccatcccctccacggctccagctcagggcggcggcgacacacagggcgcggcggcagcgcatagggcggcagggcgcagtggggaggcgagacaggcaagggcacgcggcgaggttgcggcggccggcgagacatgcaagggcgtggcgaggcgacgggcgcagccggcgaggttgcagcgcacaggcgtggcggcggccggcgattcacgtctccaatactcccaaatactctaggcgattcacatgcgaggtattgctccatctccaatactccaagtctccaactgtgccttgtgaatgaaagtgtgcccaaatgcatgggttggtgagttggtctcttaggagataatccatgtgatgcactgagttgataattgtcttgaattttctatgttgattggatgaagatgctacttgctgcgggtccccggtcgggttgcggggccccgcaggggtcggaggcgggtgggatttttcacccgcatccatggtcggggccggggccgggtggtgaagtcggggggtcgggggcggggccgttccagcccaacccggccccgcaacgcttaccatccttaattatcactcaaaaaagagggcgttggtttaagtagggatgggcagaaaaagaccgaaccgacaagaccgagaccgagaccgagaaaactggtcatcaatttggtcctgggcagtgaaagaccaaattttgttcagtcaattctgttagtctcctcggttaaacgaataaaccgaaaagaccaaattaaaaaaaaaaggtctaaatgcaacctacaacccactaagttcaataggattaaactctaattttcacatccctactcttataggcatgcaacctaataagagtctttattcatacttgcttatgaattttttttgtgatttttgtgttgaaaatttctattatttctttacatatatgaaaatgttgctgaatttcggtcaggactgagaccgagactgaatttatcggtcctgatatttttgtgttggaattcggtcttcactcttcaaatactgaaatgaccgaaagaccgaaggccaagacagaaatttttggtcagaccgaatgtccacctttaaggtttgagagactcttttggcatcacacgcttcgttacgaaaccgttgttttctgtcaaaatttgcaatgctacctaccgactattttgatctcaccttttatgttctccccttttcttaccatggacacctgtgatctccaaaacgggtggaaaggagatcgtggaagaaataacattagattactcatgttagtagcaccgttgctctctttgccctccaatttccagaagtgaaaaaccaggcgagtgtaatgattggttatgtgggcaccacaagtagcctacaacatcattacacgaaaatacacgaagcctgttgcttgtgattaactcgcaaatatacttgtggtgctgagcaaataaagggtggtataattgtcctccattgtgggcagtggttggcagagaaggctggcttttgttaaactatcgcacaagaccagtggatgtgagctttagataaggcaaaaaaaaaaggcatcgtggattgctaggctcctcttataccatcacaatttaataacatagcctgataagctcatgtggaattaacaaacacagttgcaaagctactgtaaaaaaagtcccggtgttagtaccaactacatgctttcggttaagaccagtagtcatcagtcatcactgggcgctagaaaaacaattcagttgctcgcagagcccacggattaaactagtgacaccccccatatgatctctagctcaaatccatcatgccaccatatgcgtgatgcatctcaagatacccttgcctcagcagccgtggctggacgatgccttgagatcatttagtttaaagtctccggcaacagtaatcacattcagatggtaacactccccattggcccattgaattcttctagattcgtgccccgtgcccactaaccgtacgtcctttatacactgcgagatgtacaaagcgtactactcctactgtagtaccatgctctgttttcccctgccccacgtggagtgaagaagctgggccagtgcgtgtagcagcagtagcagtagtttagtttaactgccatctcaatatctcatctcatctggtatttattcgtggcgtgtatcgcgtccatcacgagctgcctggtcagtttggcactttgaatggaggcatgtgtgcgtctgaccccgaacgggatatggctgtgtggcctcaccatccatccatccatccatctgtgcaaaagtgcgatgggctgggctcatgcactgcactgggtgggacgtggcggtggtggtcacaggaacgcagctctgactatcgcgattcgaccacatttacaccgggcgctgggtggggtggttggctgcctccgccaccgcgcgcgccggctcgcgtctcacgctcgccttcaatgcgtccgcaccggcgcgcggagaaaccactcatcatcatcatcaacccaaccccgtccacgcccacccgttgcggagaaaaagccgcccgtgccgcacgtcgcagcggccgcggcccctctccacacgagagacgcaccggcgcgcaggcgcgcgcagcaacggccggctattacgaggaggaggacgacgtggtgggacgcctttttggcaggtggtgcgcggcgtgacggtgacggggcgcgcgcgcgctaggaggcaagcaaccaagcaacggagaaccgtagccaggtcgtgtgcgaagggacgccgaacgatcggacgcggtcggggttgggggaccatgcgtccatgcggtgcgtgtccatgtggcctcatgggacaaaactcgcagggataagtactggaaggaagggaaaaaacgggactgggtgtctgggtgggaaagaaaaagggaaaccggagagagccagtcacagctcacggttctgagacacatggaagcgtgtagcctaccaaaagggccaaagaaaaaaaaaagaacttaacgcagggatcccctgaaagcgaagtggtcggggtgctgtccttgtccagcctattggttcgaaccagatctcattaattggtgtgtaccgtgattgaaagggccgtaacaaaattcttcccgtgatgttgatgcggcaatgccctttcctctacgtatttcgttttgtattctgcatttctgcgtgggcgtcgctttacagactagccctctcctcccactgtactgtactgttattgtacaggtatatgcaaatcatgcaccaccaacagtatccttgtatatatcatgaaccttatctcgtttcttccttttcttctgctttttggatggaccagtattttctcctagttgtttacaagcaacggagtgcactgatacgtacactcttggcaacacgccattttgacaaacgaagtccacatgtgacgagcatggacgtgcctatctctgtgttggcatttgtcgagctgaaatggattgctcgctgcatgaattaattgttggccaaatgccaaaacattggagcagagagctccgctcactgattggattgtacaccaaacttaattagattctcgccagtaaccgccaactaatcagtggagctgaaagttggcaggatgctgcgatgtccccagaacgttaattttaacatccatttactatattctactgttgaatctggtcatgaaacaaccattagcgattaatgttagcccaccatctctgtaacagttactcctcagcaaattataggcagatggatgccctcctttagtaagagagagatgatgttctgttacagcttctttgtgtcggcagaaatcgcatggctaaaatggaacggcagaatatcaagcactattctctagtccttgcgaaagcatcaccacactgatggaatatcgcaccaactgcttcaacacattgattcttttttaaaaaaaacacatgttttgtgcgctcgtctatgaaatatgaattaaatgcttagcaaagctacatttctgatttgctttgcaacgttaccacgccttcttttttttttgtaagaatctaatccctggcaaagatgtggaaattatggagtagaatcaagttcgagatgacttctctatgaagtttggctaacaccatttgaaaatacacatatccacagaattcaaattctctaaacagaaaaaaagaacccgagaaaattcattgcatgccctgaattttacctcaatcctttccaggccctgaattttacctcacccctacatgccctgaggttttgttttggtcttatctatatgcttatatccatcttgtatacatatttcgtcagttaactggcaatatttattctaaaatgaccgtattatctatttctcatactaatgatccaacgtaaatcttagtgtgagaaaaatataataaaatcaaatgtgatagaattatttaataccaaatttcttgcgattaaacacaagacaaaattaggctggaaactcatctcccgcgcaagtaaaacagagcgacacattttcttatgattaatatgattttttaaagcaattttcgtatataaatcttttgaaaagtttaatagtttgaaaaacgcgtgtgccgaatacgagggatgtgacttgaaaaaggtgtgggaagaacacagccttagcatacccatgagtacccaaatggtgctgctacattgttttttctcatgacaacgcctctctcaaaagatatgtcattttcagattataagttgttttatccttttcttttaaatttttttaagttcgaccaagtttacataaaaaaattaacaacatctaaaataccaaatttattttattaaatcaaacatttaatatatattttgataatatatttgttttgtgttaaaaaatattattatgtttttctattaacttgatcaaacttttaaaaagtaactagagaaaaattaaaatgacttataatataaaacggagagaatatatcccttattattttggactatttattacaaatacggggcaatatttcggggccatcccttcttcagataaacgtacacgttgagtcaaactgatgtgcagaactgcagatgatgttaataccgatagctttcatgcctcgaaattgaggggaagaaaaacaatactcaagcttgcatgcctcaattggtctttatgatgatcccctaacagccaccaaactgaattgaaaccatgtaagtcattctatcattttctatatttatattgatgttaatgaatttagatagatatatatatatctagattcatatgaatctagatagatatatcaatatgaatatgggaaatgttgcattgtctcgtgtattctacttcattcgtttcacaatgtaagtcattctagcattttctacatttatattgatgttaatgaatctagatagatattcattagagattcattaacatcaatataaatatggaaaatgttagaatgatttacatcgtgaaacggagggagtattatatacgcgccttacatcttttctccgtttcagtcatttgcgtgcatagctgtgtaggtgtgtagaagatatgtttgcatcttcgaaagcagaaaatggcgtgggcacgatgtgataaggcataactagcttcatcttcgtaggtagaatctagctatatatgtaccaactcataataatgtactctaattttgtagaaggaaacaatcatttttaataagaaaataaagtgtgtctagtagtatcctaaaaagtgaaaagggcggccctagaaaaacatattatctgcgatctgaaatactaccaactaacaataatacaatgttgttaaattattcatgcactgattatttcgtgtgtaagcatgaaatctgaacaattcaaaactacaaccttctttagaactaagcgattctatataatctctacaaaggagtggctaaggataactggtgatgacacgctaaaatacgtccactatgctctcagctacgctccacaaataattggagtagaaatctttctccaaacagaagcgcacgacacggcgaattttatccccttttattttttttaaataatttattttaaaaataaacaccagtaaaacttattttcacaattcaaagttccaaaatttctggtcacacgagccccacctaatatggtaaaataacattgttaccccacccacagcggacgtgataattttgttatgctacagtggcatgacagtactacgctgttacaacgttgttacagtcagatcgatgtgatcaaataatgttatcacgttatttagacgggcgtgaccttgttattttactacgacggtctatttagactagccaaaagtttcatatcttaaaaattaaatagtcgaaatgtttatttttaaaattaaaaaggtaaaaagagaaagagaaacgtctctatcttgcattgcatgcccctagtggccttcgctccaaccatccgccgcgagccgagccaacaagccgcccgctcgcgcaaggttacctttcgcgagcttggacactgtgctatacgtaattgaaatgaaatgaaacgcttgccgctgatacgtttttagggcctgtttggttgatgccctcactaacatgcctgaaaaatttaggtgcctgagagctatctgataggatgataaattttacctgctcaggcagcctgaacacttgtctgtttggttgttcttccgcgcctgtgaaaactaaacgtgattaagcttttaattattacggttgttataaagtgttagcaaaaaaaataaaatatttggataggctatatccctccttgaaagtacaaataaaatatatttatatggtcggctgcttttacaatctacagtacctatactacattattataagcggtaattaggattaatgagcgtagctgcgccgtcctggagaaaacggtcgcctgacttaggctaatgaggctccaaaagagctcagggcagggaaggagaaactaaggtcagggcaccaaccaaacaaggtcccggctaatctcaggcttacatctggtcaggcaaatatccttgagagcaccaaccaaacagtcccttacttcacaggagttagcgagtagctgcaacgtgcgcgcagattaatgaatgcaatgcgagacagacaaggatgcgaatcggaacggaaagcaatggcggagcgactctccggccgtgtgatgctattttttaatccattctatagcatgcaaaatgattcttcctagcaggctagcaaaccggattgctgcgagttgtcatcagatcatcgagcactggctgaagtttccatcacattccacgagttggaatcggtcactgtgacagttcttcagatctgtcgtctcgctttgttgctgctctcgtagttttgcagtgctcatgctgagcagtagatcagcaggggttggtgcatcttgtttgcatatgtagctgctcgtagccacgtacaacgagccgaaccacccgcccatctatcgatcgacggcgatggcgaccgcgagacggaggaagagaattccaactgatcaaccgaccttaattacttagctatagcctatagggcggcattgcggcaactttgtcgagtcgcatcgctcaccgaccgtaccacgtacgtccgtaacatgacgacgattcactaggaaacaacaaaaagacagtaaatgttcatatcacacaattggcacgttggcatttaattacccaggaaccaggacgcaagcacgcctaaagtttggcgccctacaagaaaggacacccaatctgacgaactctgtggacttttgttttggagcaagcgatcaagctgtgtttaggctcggtaagatcaatgccaatgcttagctaccttgtcaatgatccaaccatatgctgacgaaaccgttgaggtcagcctgatcaagacgagcgtttggcggccacttggattaaggaatgagtttagttcagtttaggtaagatatgtactcagaggattacataattttacttaacaactaagcgtaagactcttctcaagataactgaaaaatcttgaatatgtatatcctagttgatcgtactaaagtttcctcggaaagaaaagtgtcaactactggtcaaactaataatatgtttttttgagaaatacagtacaaacgcttaaataagctaacatggacatgttatcatcggtttattcgtgccacatttttaaaaatacgatttgtcggggaaaaaaggcatagatagatagctttttttaaaaaaaactttttgttaatttcataataattaatatttaattcatatccatgaatggttgcatcatcttcgattctacaaagagctgcccttcactaccattaaagagcttatgctattgcaagagggaagtagatgaaccggtcaacctatcttctgattactggagaaaattaggggggaacattatcgtaagagatggtttggcttgcataaacgtagcacatgtctttgaagcaaatggattttctctctttttttcagcacggataaaaagcattttctatacggattttcagtcaacctgttaggctgtcacgacgcagggtagcagagacaacagcgtgtgtgtgttgctggacgggcaggcagtcccagcaggtaggagtgtacgcatgttcacaaatcaaacacggggcagcaggttggaactatcgtaattaggcgcgttgttgaagtttgaacttctaagttctggttcaagtcgcttacagttaggttgatctgagctatccgcgcagaaaaataaatatggcctctggctgagaaccatatgcgacaggcatatcacatttgttacacacacgtaaccaaaaacgtacggcaagctcaaaagaaaatccggagtcgtagttccttcggttcacccaacaaattaggttgaaagaccgaattcaaaattctggtaaaataaaaaaaaataggacttgtttactttgctaccattttcaaaaatactttttttttcaaagttttaaaaaagtggctatatggtttgttgctaaattttagtaagcacatataaaatctccaaaatttaataaccttactaaaattttaacaaccttatcaaaatttgacaatgtcaaaacttattaagattgaaaatagtagcaaaatgaacaagtccttcagtgactaacggctaacgcagcacaatcaccgtcgttgttcgtcattttcggcaagcaggagcgcacggcagcgccacctggcaatgcacgagcccgacggctgaccaacacggcggcaacttgccgcactcttccgagctcgatctgatccgttggctcgcttttcggcgtaatgtgcaaccccgttccattcggacaagacgtggcattctcaatttctccaaacacgacaccgcctccgctgtgccaccgtacggcagtaacatctaccgccgccacacgacgaaagcctgacatcgatcgatttcaccggactcacataggatcggccgtactgtaccccatcggccgtcggaggcaaccggaaaccggtcgaccacacgattcaccgacggacgggccagcggcacagcgccgacggcaacgccgcaccaaacgcgcgcgaggagcgagagaccattccgtcctcatcatgccgcgtgccgtcggtgtgagatggcgatctgatcgcgtcctgccggctgccgcccatcgtcgcgcgggggcggggggggggcacacgaagacgggcacacgcggggcggtgcatccgtacgtgcgtggcgcgcggcggcatgggaatcggggataaaaaaatgaccctccaaaacgcgctcggctcccggacttccggctccgcagcgccgcgtgcgttgcctttcgcggaagggtgatcgtgaaccgcgcggcctgaatcggaacgcgatcccagattgacccagcaccaacagtccgggtgcatgcgtgtactcttagcacgcaagtaaccagaggctgatcaacgtagtcacgttcgttcagacaataaaattatcggaacgaatcgagcaggtgaaaattaatccgcgtcgtcaggagtccgggcccgtcaagaccttgcgtggcacagcaagtctagtctagaattcggcacggaacaaggaaattaggaaagcgatagggtctccactgtctctgtcctaagttgacacgggatttatttttgttcgttttgtgattgtaaggcaaacacaatcgtatgaagcacctctgctgccacacagaagtgctcctccaagaatacaagttcatacttgaacccggactcctagtgtaagttaagatctagccagctgccagttcttttctctataccttttgagcatgttctgttcgccccgaatacccatgtttctctacggaacttttgccaaaccatgtacttgctgctcctgcgatcacgtgttgagtcagccaaaaaaaaaaacgcagctgaataaatacgataaggatgtattaaacttggtccctatgacttgcgacaagtactttaaaaccgtattgttaattttgatactgcagatcgcagtgagttttaaatgaagaaaaccagggtggtgccaaatcactttcccaggtacgaatcaggctccatgtgtttccgataagagcgatttgagcgcttggctcgtccctcccccttcaattcgttgtcacattgcacgcaacttgccaggaatctgatccggtttaaacttctctcataggcctagattctagccatgtatgtgtttgctgtccaggcataattgcctgtgagggctccccacgtatcagatattcagatctgcctgtctcgttatctgacaagattaatcattttgcacaaaaatgtacaggttcgtatatagtgctaagctatgattggttttgttctgtttagcctaatagtatcatttgctcgcaccggtcaggaccatgcatccatcttattccatctgcacagaacatgctggggcagatgctgtttgatcgaacggtttcagtacaaaaaccctattctctttaatagaagttaatgatcaatccatcatccggattactaacagatatttgaccgagaatcaaaagattgacggctcggatggcgatgccatgtgataactgacaatactttactcctactactggagtatcagtctctcctgtgttcaggtcacaatatttcgaggtacgagattgatgctgaacaaaaaccatttgggggagtttgtgtacggtggcatcagtatcgtgtcgaccgagaggccatatggttgatcacgagaggtgatagtacactgtgccgatcgatcgtaatattcgtatctctgctccccccgatcaatgaataagcagaccggagcgtcgttttgcggtttgattaaactagtgtggctgtggtggggggcatgaagagcagcatcccgatctgatttactcccatccatgggcttcccatcccgtagattccatctgtgacgcacagacaaacaatgctaggtcaccaccgcgaccgccagcctgtgtgattttgctcatcagtacgatcgacatgtactactgatactacaactagtattaccctctggatacacttggatgctctcccgggcagctggccgtatgccccgtatcgctctctgcgtttcacgcgtccagccagcccgccagctaagccggctgcccatttggcccgtagtgtgcaggccgagatttgttgggaaaacacttagtgcaaatcacattttagataataaaaatatattacatcttcaacttctatcatagacacactgtcataagtttaataaaaaaaagtaaagataaaattaaattaaaatgaagaataaagtgatggaacaaatccacaactcccctttattattgactagcgttaaaccatatagatttttagctaacagtagaggaacaagagacccttggcttccgattctggtagtgtagcactattgcacatagtatcttgctcctcctgtggtaatatcgtaaactaaaattgaagccaataagagacataaaaataacttacatatggttagataattgtttaccattaaaaactttaacattataacaacgccaaattgaccaatatacaacactagctgcaattagagtcatctttttaatggatctagtagagttaaaataaacgtatgagagttgatcatgttacaaaaaatatattactcttggatttaaccacaaataaaaattttacttgctgacatggttaaatatcatgcgtttatggttagacctaacaataattttaatgttttactacatgtatagtttgcaatatatgttgatttattgatttgtttagcctggccgtttgcacgcgaacatgtgcacgcaagacggtggccacgccgccgccgccgagcggtgcgcggtggcgccgattagctggctaaagcccccgagacaaacgcgtcgccgtcgtctcgttgggccggggaagacgtctcgggcctttcaatcaccggtacttggaagagtgtggtctcttcccgcaaagtgatagtcactagccaccgatcatgtggaccgcgccggccacctggctagtagcaaatttggaatgttctgtcctgcgaacgtttacgctgctaatggtggacgtttgtgagttggagaacgccccagtactcctaatacgtggaaaatttgcatgtacaaagatctaaaatcgtgcgcattgtttataagccatcccgttctttgtttatagcggcagagctcacacgaggtgtggggctgtgggctaaaagtcttataggagtatattactacttgaaaattgaggtttaaactgaacacatcaattcgagattcggtacgtgtaaacctaaagttagttgaatgccagtactcttgtcaaacaagtgaaagcccgagatttgcggaatgtgaaacaagaccgttaaatttagctttccttttgaacttttgatttagtcgtgcaggctgtattatgcatagcattctccgcacggcaggggaccgaacttttgaaccctgccatacgttatggaaggtatacaatcataccactagtcaatggcaaattgatgccgagctatatgaagtacgaatattacgcaacgtacactcgtgcgtgcttatggtcaggccagcctaacattgcaaaccaaaaataaggaccgaaactttaattagagctgggcatcgtgacaaaaattagttagtttaggtactagtgacatctgagagacctaacggaatagaatacaatagccgtgaccgtttcaaacttcaaaccctcgtggattgggttctggagtcgggacgcatgcagattcgtataggtcaaaagtttgtcatcgtacagtagtataactcaactaggaacatgaagacatgagcttaatactaattaagtacgagtagctataaccctccatctggtcttcaactaaaagttctgggcaacttgaaggccttggagtatgagacttggcgagtttatcctatccgctactaggggctactagtactctgtctgactcggcttacgtagtaatttcgatcatcaccatgctaggtgcactttattctagctgaacatgcgtgtatacggcatagtactgtggtaggtttctatcggtgatcagccaatctgctgttgacctagcaaaggtcaagttaatatactccgtacagaagattagtacattgtgcaatggaacatggaggttttacacttttactccgtgaaacagaagtacagaagaggcgtcctgtagccgtttacactttaataaagcctattggtattgctgctcttccctgcatgcaggggcgatggaccaaaacgttgtccaagtgtaacagtacatgcttggttatatcgagaagttgtacgcagcaatacgtttcgacggtcgaataaattcccacataatgtttggagtaccacgtttggcagaatagggttattcactgttgaacataaagtgctgtacacttcattacttttacagtgtgtgtggctcttcacgtctcatcaccacgtcggtgctatgtacagtgcctctcccgttcctagccagcttttggttgggactctggtgtacggatacacaattgacaggccattccaggtaggtcgcttttcgttcttttttctttttcgctccgccgagggggcctcgctgccgcgaaagcgacggacatcgcggcgaattaacaagtccccgagagccggaaaaggattgttcttcgaggccgccacatgcgagcagccgatggttccttctcgtagaccaactccaactcaccgccggcgtctcgcgttggtttacaaccaatgagatactactagtaaaatcgcagaatccccactttcgtgcgaaaggcagaggcgagcgcggacttttgtgggggcgaagaacgagaaggctgcgacgcgagggtggggggaaatggtttgaagctttggacttgtcaccccggcgcgcgtgctgcatgcggccgctcgactagagagtagagaacatatgaacgctttgtgtttgtggcctggctcgcttgttgttacgtggaacgcgacagcggttgtagtgatttggacctggggacatacgactagcttgggccggtaagacgacttttaacttgggccgatgtactgtacaagttttctgaaatctgatgtgcgggattatacggtgtacgtctacgtgggaagcagtataagttttctcaatcactcgtagtacgcgtgaaacgtagtgtaacctcagacaacctggtgactctgtgccgcagcccgcaggcctgcatggtgaagagattccggtgatgaactgatgatgcaatgctctggaggcaagtacttctcgggggcctaccacgcaagagactgttactgacatcaacagggaggtgacgcacaggtgcaacacactggtggtcgtcgtcggtggagctcatttaaagttaggggctgtgctgacacgttgcgctggttggcacgcaggcaggcctcccacacggaacacgcgccagccgcctgccgaccgcgagtccgcgacgcacgacggcgtttgacgccatatcctactccgatcctctccgcaccgcgcgggccagcgcaggtaatcactccggggccatcctacgatggcacgaagctctccggattggcgatagcccacgcattagcaggccgcacggcctgcacgtaatccgcgcccaatctactcgctccacggcccacacagatgggccgcaccgcacgttactcgcgataacgttccaactggatttggatggtcgcgtgggcttgagccaaacgggaaaaagttcatcatttgtccctcaaactagtagtaacttttaggaataagttccccttgtgatcctcaaaagtgattgactccctcagtggttttggagggcgttttcactgacgtgcctacgtggcgatattaatgggtctttgttccacgtggcgttgacgtggcacttacatagcattagaattaaaaaatatatgtgggactcgtttgtcattcacacacataaaaatttgtggggcccactgactcctccctctttcttcttccccctcttccacgcggcgagggctggagcggcgggactcagattctgtgacattgccatggtatggcacggtgtgacattagagcaatctggggcgttgaaaataaatccaagggtcctctgcgccggcccacctgcaggcctcagtttttcaccccgcattgctccgtttcctgcccgagcgtgctgctcgcgaatcccccagaaccaccaccgccgccgcttggaagggggccggtgccgccgctcggaagggggctgtcgtcgcgggactccagtggggccgccgccgtgggccgccgcgcgcgcgtgtcgagatggccgcagtggccctgccggcacgagtagaggcgagcagcggccggccaccaggcctaccctcgtgcggtggcggctgcggatggaggctgccgagccagtccaggcagtcgtggtgatctgcagccgtggcggaccggcctcatttttcttctgtgatctgcagctcagcgcgtggaggaggggacgtcctggaggccgcactgcccttgccggccgcactgcccctgcacaagcatcagcctatggacatcaaacagcttctgtttgttgcatcctgactggagtttgcttttgatttgttcttcagaacaactcgctggctcgcggcgacggccggacccgggcgaggcgaaacgggatgggttggatcggcgggcgccgactcccgcgggacggatggatcggcggctaaatttccgacctgcagacgggcccaaccaaacgagctgttggatgtgtttttgatggcagagatcctcacaatgtcacgttgtgacatgccaacacaaagtcacccaagctgaatccggagcggcggcggcggcggcgaacaaggtcagcattggcgcctctgtgtcggccgacgagcgaggccagtgtgtgggccgccgccttcgacctcagcctccatcgtcggccgtcgatgacgctaaggacaacccccgccggtcgacttcctccacgatgccgaccccatcttgccaagcgctggcctcgccatcgtcgactcctcactccggggaccgtctggccccatccctgcacaagatgctcctcatgtggaacgcggcgaggcccgtgtccacgcctttcttgagtagcatggtggtgacgcacaggatgcgctcacacttgcctgacatgtcccagccatggaacctcagaatggcgatgtcctcctcggcgtccagtgaccttatgtactccaccatctcctcgctgaatggctgcctacactgcggccagcagagccactcgaatgtgcaatcctcaaactgcacatgcgtgatcgatgcatgatcaccaacgaacaaaatggaaatcaattagctagaagaaaatctatcagcgtcagtgcttacactctcaggaagacagtatccattgtcgattgtaaccagggagaggccatggccttgttcgtctctgcaggtgaggatgttgccagcgtgcatgtcggcgttggccagcctgatgtccagcacgcaggtcccatctcgccgagcgctggcctcactatcgtcgactcctccactccggggactgccgccaccgccggaggaggggtggcgaccacctcttcatcacgccgaggtccacggccatcgcctcgaaggacgagctccccccgcagcctcagcctcagccccgtcgcagcaccgactgcccagcctcatccgctcccttgtctccatcatcaccgtcgccatcgaccgggtggacgagctccctgcaccaactccgtccaccacaccggcggtgctgccgctccagaacccatatcacctccagcccaccgccgccgccgccgctccagctagcttgttagcaataatcttgtctttagagtgtatgcatttggtttgtataggttttgcacaaggtagtagtgtgtggcagcaaaggatccgagccagtacgtgtgaaacgtgcttgctgtgagctgtgcgatgcggccggacgaacgtgccgatatctacgatgtgtaaaggctgttgcattagcatgtagaactagtgattagcggctgcatgcaagcatttagttggatgtgttaagatgcatgcagagctgcagctcaagctggaaggccacgaagtgattttgtggcggaagaataggtctagctagttaccttgttgcatggcatctgcatgttggagtaaggcgtgagtcaaggccaaattagttggctgatccttatcttttgcatgtacttaagtctatgtaatgaagaaaatggtgtgagttgtgattagccacatcaaccaaaagcctgtgtgttttgttcagttcttgtgtgtttgtgtccaccgagtaaatacaagtgtttatgttagtgctagtgattagtacttaaacattcagagaggagagattctaacaattggtatcagagccaatttatgcccaagatcctgcgcttcaacaagatggccatcgtcgagcactccgcatcgcgatcgatgagggagggcatcgtgtcgctcccatatccagtgctcacctccaccaactactccacctgggcgatcaagatggaggctaacatggaggcgcaaggcatctgggatgccatcgagcccgcggccgatgaggccgtggacattaagaaggacaagcaggcacgtgcgtgtctcttcggggccgtccccgaagacgtgttgcagcagatcgcgaagaagaagactgccaaggaggtctgggaaagcctcaagacgaggttccttggcgttgagcgtgtgaagaaggcgcgagtgcaaaccttgaagagcgatttcaaggcattgcacatgaaggacaccgagtcaatcgacgagtttgccggcaaaatcagtggcctggcaaacaagttgagcgatcttggtgtaaccatggacgatgatgagcaagtcaagaaactactcgattctgtgccagataagtttctgcatgtcatcgctgcaattgagcagttctctgacttggacagcatgccatttgatgaggcaattggtcgcctcaaggcatacgaggaaaggatacgcaagcgtgatgacaagaatggcgagcatctacttttcacgtccggcgacacaagcggtggccgcagccgcgtcaagaagccggacaggtccaagacaatgtgctactactgtcaagaacttggacactttgcgtatgagtgccctgagaaaaagaagaagaaggagatagcgctccttgccgcagcgtcaagtgatgaggagccaactcttctctgaatgaagcatgccaagattaggggggtaaatgttagcaataatcttgtctttagagtgtatgcatttggtttgtataggttttgcacaaggtagtagtgtgtggcagcaaaggatccgagccagtacgtgtgaaacgtgcttgctgtgagctgtgcgatgcggccggacgaacgtgccgatatctacgatgtgtaaaggctgttgcattagcatgtagaactagtgattagcggctgcatgcaagcatttagttggatgtgttaagatgcatgcagagctgcagctcaagctggaaggccacgaagtgattttgtggcggaagaataggtctagctagttaccttgttgcatggcatctgcatgttggagtaaggcgtgagtcaaggccaaattagttggctgatccttatcttttgcatgtacttaagtctatgtaatgaagaaaatggtgtgagttgtgattagccacatcaaccaaaagcctgtgtgttttgttcagttcttgtgtgtttgtgtccaccgagtaaatacaagtgtttatgttagtgctagtgattagtacttaaacattcagagaggagagattctaacatagctcccgcgtcagctcccgctgccgccgccggttcagctcccgccagccgccaccacaccgcggcccatgccccgccgccggccgaaggggaagaaggggagagaacgaaagagaagggagagacggaggaggaagaaggaaggaaaaagtccactttgactcccttaattatcgacagaatctaattcgtgatcctcaaatcgcgaaaccggataagacgactccccgaactattgaaaccggtgcaatttgactcactcagtggttttggagggcggttttgctgacgtgtcgatgttgacctagtcttcatctcacgtggcgcttacgtggcattcgaattaaaaaaatatatgtgggacccactgacatttggggcccacgtgtcatcctctcttatctaccttcttcaacctccccctctctttctctctctttctgttcgcgagcgtaggatgggggctagcggcggcgggagggcgggcgggcgaaggccagagcaagggccagatcgtcatcgtcggcggcggcggacgggggctagatcgtcggcgacggcggcggacgggggccggagtggcggtggctggcgcctcctccaaccccatcccggccagagttcacccaacctggagcggagtccccctcgccgcctctctttctctccccccgcgagtcgtcgacgtcctcgcccatccctccccacggcgtcgttgacgccctgcctcgtcgctccagatgcatggagctcgccgcgctctgcaccgaccccgtcgtgctctccgccgccttcctttgcctcctcctcaacctctccctctgctcctaccgcccgccctcccctggcggcggccgccgcctccccttgggacccccgggcgtccccgtcctcggcgcgctcccgctcgtcggcccagccccgcacgccgacctggcgtcgctagcgcgcaagtacgggcccatcatgtacctcaagatgggcacctgcggcgtcgtcgatgtgcgtggcgagggctttctttccggtgcgccgcgacgaggctggtcggctgctgtgcggcagggtggaggcgtcagcctgtagcatccgtatttatgtgcttttatttaaaaagtttgtcatttaaaaattggag

SEQ ID NO: 61236 - DNA, 2688 bp, Oryza sativa
  unsure (1)..(2688): unsure at all n locations
cacttctagatatagattatgagaggtgaaaataggaaagggaaatgaatgaatgaatggctatgattaaatgagatatgaaaaatggatggctatgataggtactctgttttcccaactctctcttctacggttttccgcgcgcacgcttttcaaactactaaacgatgcttttttttaaaaaagtttctatacgaaacttgcttaaaaaatcatattgatctatttttaaaaaaagctaatacttaattaatcacgcgctaatagaccgctccgttttccgtgcatgggagatgggttcccaacacccacctccgaacacagccttagagggtgggatataatttccctatcccatttgccaaacaaagccttaggtcgtaaaaggttggaacccttcctctccaacatgtaaaacaaaacacacattagcgtatgattaactaaaataaactttaaaaataaattaatatgatttttaaagcaatttttttagaaaatatatataaaaaacacatcgttgaatagtttggaaaacgtacgcaccgaaaacgagagaggttgaatagtttggaaaacatacgcaccgaaaacgagagaggtgagttaggaaaagaggggaagaacacatccttatatttggaagtaagtttatttttattttattttatgaacggaaggagtatctcgctgatccattcatatgcgcatgaaggcgtggtccaggacaacagtacacagacgttactatagtgatccaaatgcatggaggatcgatgtagccaaggtttttctttgatctgtggatttcagcggagaccttgctttcgatccgttgatcttgtctccgatcgcgcgagactctacagcgtgttttcgtcctatccgttttctgggcgatcccaagcaagcagggggtaagttcctttcaatattgttttataatgatttctactaaaggagaaatcaatttacagtatgcttttttatcttttctaatttaatacgtcatatctatttatactacttagtaaaataaattttctactagcggtaaaacttactatacatcatcgattgtgatcatttaatagtgataattaatatatgagatgtgcttctatacttcttaaaaaaagttgcacgaaaatcgaagcacatcagtggctgtgattaaaagtgggttaacagtttaatcctcattagtgaggggtattttcgtccatagaaatttcagcccacaacgatatcgttctctcctcgtcaggcagcgccactgcccgctggtttcctctgcaacgtaagcgccacccgcttcccctccctgccctgctagaccaccctaactagatcccatcgatggatcgatggatttgcggtgatttgagtcggtagttcactcgcaacatgatgagcgggagctccagtgaataatatgctgccccacaatgaagatcgtcgccgccatgctcaacatgatcagcctcgagcacgaggactatatatagcaacgtcgacgtcctcatcaagggccaccacctcgcgccgccgccactgccacattgagcacgccgccgtgccggcagtagtcaggccaccccagcgacagctgcagcagcttctccggtgccatgatctacacctcatttaaggccaagtcgcaattcgattgaaccaaagtttaaacagaagaaataacacaaaataagcttgtgcccttcgtgctttggcttgtttgatatttgtctgtctgcaatctgcaacggcaagttcgatgtgacttgtgatggtggtgagctgtaaatgaacggggtagacataatggcatgcagatacttgttttatgactactggctgtgagatggacaaaatggagcgtcgtgctgcaccgcgcgtcgagaggaagaagagggcggagcggcggcgctgtttgcaagaggaagccgggcaacgaggggaggaagagagaggggaggtggcgaggcaaggaaagcgcgggcggtgcttgcgaggctgaggagcggcgctacccaaggagagagcatcccggactagcggtcgtagtcgtggaggaatncgcgttcccattggtaatttggtatcgctccaaagtggaccggggctcaaaatttcatggatgaaaatacccctcgctaataagattagagtgtttatctctcttttaatctcagccacctatgtggtttgattttcgtgcaacctttttttagaagtatagaagcacatctcttaatatatttgttaaagaatattacaagtaaaaagaccaccgtaaattatactattttttaaaaatatatggtcactgcgtactcgtatgtaagaagccatgatcacttaattactagtacaagttttccaagggaaaccataaaatggacctgaaaaaatgcgtattcccgtgaagtccctttttcgagtaatggataaactggccgatgcatccgatctacgaagaaaaaccgagtaaaacccatcttaattgaacggtagtttctcggagaaatcattttagcagaattgtgagatcggaggaatcatgttagcagaattacgagatggatggattgtttatcgcattttttttactaggacttcaacactactacagaaatgatatttgcaaatggctaaaagccattttcacaagggtaccaagctagcata

SEQ ID NO: 61237 - DNA, 6234 bp, Oryza sativa
  unsure (1)..(6234): unsure at all n locations
atggctggtagtacactgctgcaagccngcangncgactntagaggatcccctctccaaagacttgaagaactaaggaagactattctaattctaactctactagcactttagcaaaatatgtaaactaaagagcttcttcacttgattccttcttgggggggctaaaagtaaagtagataagggccttttatagctgtttatgacagttgggagcgccaataccagtagtaaccgttattggaaggcggttaccacctaccttagcttgggcttgggccaaccgagctggtgctgggtcgaccgacccctggcaggcctccctggcccagtgattcctccagaatatctttagatggatcctcggcccagtggcatagtggttaggtccatttgcaggtgtttcaatgaatttgtgggcctatccatccatatgtccccacatgttgacctctgattggttgaacgattatgtttcatcatttctactccatttatatagtgatctcctataaacaaatggctttgccaagtacaagtggaactagattatttctaaataaatatgcatgcaagcattactggttctccattatttttgaaagtatccacggtcgaaattggtctataacgactgtcaacaaaaacagaggattgcaaagcacaagaaaaacacaagaatggccatttgattggaccgtaggaaaaccacaggaattagagaagagataaagacttaaaaggaaagttttcatgaggtagaacctcatgttagttttcctccaaaacttgtatggcattaggcattccatagtattcatttctttaattcaaagggctatataggaaaaaatcctacaggaatgaatcctctaaaatttctatgaatttcctttgaatcaaatggtgtcttagcaagagctcaaaactcttggaatttttttttgagactatctctcttatccgattcatgtgtttttactaagatccaatcaaacggtcattcttgtgttttgcaatactctattttacacttctattcttattagtattctgtgtttttcttattccttcgttttttttttcattcttgcgatccgaaggggcccaggatgttgcatgaacttccaatcaaattttagggctcctttgatttggaggaaaaacataggaattttggaggattccaatcctataggaaaatttcctatgaaaccctttaaaaatcatatcctatccttttaaattcttatggaatggataatcgtatagagattttggaggaaatatagcaagagctccaacctcttggaaacttttctttgagtctatctctctcatccgattcctacatttttcctgcggttcaatcaaacggtcattcctatgttttccttgcgttttgcaatcctctattttgtacttgcattactattagaattctccagtaggtggtgtttgaatctcttgaagatgaagatgaagattaaatgattcacgcaaaatgatatagtaataacatgtgattagttttaattattacaaactttaaaaatggattaatctgatattttaaaacaactttcatatagaaagttttcacacgaaacacatcgtttagcagtttgaaaagcgtgccacgataatccaaaattttatcctctcctagtaggagaaacgaacagggcctacgttttttctatttctctgtttttttcattcctatgattgaaaaggccctaagggtgatatagacattttccttattatattaattatagtacagtaatgcttagttgcacacgctatctgaatgaagcgtacaatactgtgtacgagtttaaagtcggtcggtagcagcgaaaacaccatgcgaataccacttgagtattcaacgcattgcctcacaagtcacgagggtgtagtatttaaaaggagagacagaattttcaaggaaggcatggcatccttttccttgccctttattcgctccctttgtttgtcccaactaactccattctaacacgatataattaagcaagctggatatatctttttttttccggggaaaacaagctggagttgatgtgcatgtgtccaagaaacgttagggaaatttgcaagtcaagatcaatggtactcttttataaaacgaccttgcggtaacctagcaaatggtcgtatcttatcttattttataattagggattgttttatctgtcaattgtgtagttttgggctaatttctcactcacctttgaactaaaacaagctggggttgtggtggtaaatatatggtggaaatcttaatttgggttaaatttgatgtaaaccctgataaaaagccgtctaaattcactaaaataatcacacgtacgcaagatgatgttacgctaccatgtaatttttttcaaactcaacttcatttgcaagctataaaaccaaaaaaaattgaacgaatcatcatgacaaattgttattttaatatctcataaacggaatcgagagtttgtacatgatttttttacatggtagtttaacatcatcttatctacatgcgtaatctttttaatttagatgacttcttaattatggtttacacgagttttcacatgagttaagtttccaacacatatttgtacagatgttagaataagaataataatatagccaacttattactattagcccatcttaaaaccaacatatataattgattagctataaggttggctacaattttcttctcctgtctctatctctcacttatacatttaatgtatttgtcttggagcttgtgataagttagctcttgcatgagagtcaacacccttaatttttcactacctctctcctccacttaagcttatagtaagcttatagctcactattatacttgctcttaggcaccggaagactgcagcttttacattcaggcaacacctaaaactggtagaggtgggcattcggtctgatcgaaaatttcggtctcggtcttcggtgtatgtcatttcggtctttgaaaagtgaagaccaaatttcaacaaaaaatgtcaagaccgacaaattcggtctcggtctcggtcctgactgaaattcagcaacattttcatatatgcaaagaaataatggaaattttcaataaaaaatcacaaaaaaattcgtaagcacgtataaaactcttattaggttgcatgtctagaagaagtagggatgtgaaaaattagagtttagtcctattgaacttagtggatcgtaggttgcatttagacttttttttaattcggtctattcggttaaccgagaagactaaccgaattgaccgaacaaaattcggtctttcacggtctaggaccgaatttttcggtctcggtcttttcggttcgacccacccctaaaacctggttccaaatagctacaaaattatttgcctttcaatccacagttggtcaatcggtagtgatggataggcataatcctaagaaatccatgcaagtgacagtgtgtgacaccagcaccaaagttgtggatagcagcatctttgatctttattctgataggttcatgtgggggccaaagggcatggacatacaattgccattgccatgcaacacagtcatggacaaaaggagagagataaataaagatgcatttatataattagacgacgcatataataaatagtttcagggtagattgaagggaggcgtcagtctgtcagatatgccttttcctttgttgttaaaaaaagcatagagaaatttaaggctgccccatggaggaggcaatgaaattatgcagcagcctgacacagctagtagattcctgtaccagtttttcatgcataggattgtttttatatgtattactagtagtattttattgtatactaggagtattctttgttgctgcaaaggcttgcatcagaagaaatgagcccttagtttcattgttgatgctcactgcatggtcccccaagggcccagcatgatatgatatgctcagcagtgggtgtatttagtttacgccaaaattggaagtttggttgaaattggaacgatgtgacagaaaagttagaattttatgtgtgtagtaaagttttgatgtgatgaaaaagttagaagtttgaaaaaaaagttgggaactaaactaggcccaagttcatagttcttcttctctcttttttccctctctcttgctgacaaaaaggttccatgctttttttttttacaatccagggtaagggtgtgtttagttctttgggtgtaaaagttttgaaatatatggacacacatttgaagtattaaacatagattaataacaaaacaaattacagattccgcccgtaaactgcgagacgaatttattaagtctaatttatccgtcattagcaaatatttattgaagcatcacattgtcaaatcatggcgtaattaggctcaaaagattcatctcgcaatttacatgcaaactgtgcgattggtttttccccacatttaatgctacatgcatttgtctaaacatttaatgtgatgtttttggccaaaattttttaggatccaaataaggcctaagaagtattcctactacagtagaatctagttttacaatttttcttttattatctttcacttgtccattcaaagtattcgacgccaaagatgtgcttggtttttgagatgttgtcatgataaccacttggggtgtgtttagttcaagtgtgtttagttctttgggcataaagtttttaaagtatacggacgcacatttgaagtattaaacgtagactaataacaaaacaaattacagaatccgcctgtaaaccgtgagatgaatttattaagcctaattaatccgttattagcaaatgtttaatgtagcaccacattgttaaatcatggtgcaattaggcttaaaagattcgtctcgcaatttacacgcaatctgtgtaattagttatttttttatatttaatactccatacatgtgtccaaatattcgatgtgatagggtgtaaaattttgccaggggatctaaacaggccctaggactctatgaggggtcacatccccttgtagattgagttttttttatgaacggatggagtatatatcatctgcctcttctctcctaaaataattttattttatatccatcttgtacataccaataaaaaataaaaagactaaattgttatggaagattactcacttgatgtaatggttgtattaaatttatttagtactagggtaattagactagtggaatatcagggcctgcttggaataattttaatcgcctgaaattgttgcatattgctaatccttgaaattgtaagtttagttcatttttgctgtagtttttctaatgtatatggatctactttatttttaaccaagtttcaatatttgtatctttagtttttacaaatgtttatcaagtataatttattttatgtcattgttcgacctttaattaagaaagaatttaaggttagttcaagtatagtttaagtgcctaacatatgtctagtctaggttagtgcaattcatttttcaacccttttatgtaagaaaaaatggatagtatttaagtagaaaatgaagggagtgtaagggtggttattttttcattcgaggaaagagaaaactcattaaaatttgatataattccaataacataaagcctagagtccataataaacaaatggtagagatgaactaactcggtcactccaaattacccttgaaatgttcaatatggaactagtgaattgtgatccatccaatcatctctatatctttttctataggcacatgtgcatctcctattggcattagattacattgaggggctatgagggagaagaccaataggagataggcatgtggcgattaggattaggtcccacaaggggtagggactctgttcggcttcgataatggttttgtagggccctagtgcacaaagaaaattcgctcattcaatgaaattgatgaggcatgttaaaaaggatggctagataatttgtggaggcgaactcctattgatattccccatggatttttgctagcatcttcatgttacttgcattgaggtattgataatgattaggcatgtaggacaactgcccttaataagccaccccctcctccaaggctggcccatgggtgacatgaaacaattttttacatcaaaagtgcctaagtttggtccacatgtcaacaactataca

SEQ ID NO: 61238 - DNA, 1095 bp, Oryza sativa
tcagaaccccagagtccgcacatcctcaaatacaaagcacttccctagttagatgtaggttacacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcacatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacggggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccacctggcgggcactttcagtgtctatcagaatgccacgggcaagatctgcggtgtctggcgacgagttccacgtgattacaagcgcatcctgcgcgacgatcgtctccatgttgtcctcctttggggcaacaaacagcaggccgagttggctctggc

SEQ ID NO: 61239 - DNA, 922 bp, Oryza sativa
tcatcattgcaactgaactcccccatgtcgcactttagatccgcccctgcgtgattgtatagtcacatggtgcttgggctccggttttaatatctgctatatgttgatgctcatgcaacctataggattctataattgcattattttgattctttgaagttatatagaattgtatgtagatacgacgagtcagttctaagattactggctagacttggctgaactggttctttgtgaactttagtggttgcatatatgcttgttgatattgtctatgctgctatgagtgacaaggcctatccaatcatgtcttacctcatcctctaatctgattacccctaaatttgggtctatactgtatgtgtgcgttgtacttaccaagaacttttgttttgtaagtttttcctgcatgaaaaaaatattccctaactgtacaatgcatttctgcgcaagtattcatgctcttttcagtcattcatattcattagattttgaaaagtactgatgtttctttgcttttgttttcaggagatgcctcgctatgatgatcattatggaagcacacgcttgtatgttggtagactgtcttcgcgcactcgttctcgtgacctaaaatatcttttcggcagatatggaaggtaagaacagaacaatgggcattaagagagcttatttctctgaagtataatggatttttctggtaaaattatgataagtcactttcatttggtgtaagtgtaaaacactagtgctgcgctaacgcttgcttaacagttgacattacaacttgttggtacgttcaaatttcaccaaacaaatcaagctgtttcctattaaaattgtgacctttccaaaatgtggtgcaaatcttcggttgtgctcagcataggccagtaaagcaccatatccttcctaccctttc

SEQ ID NO: 61240 - DNA, 2778 bp, Oryza sativa
  unsure (1)..(2778): unsure at all n locations
atcttacaatcttaatatattactccatcgcacttgaggtatcgtggcaatagtccttacaaaatgtgataggagaagacaataatagaaatacacctgcctaggtcatataaactcacgcttggggattgacttggcttaggtttctaggctgtccgcttagaattttttctccttatccttcctttgtcgctattccaaaaaaaagtttggatgatattacatttatagatggatgaagtgggtaccattttgtcttaaggtccaaacattttccatgtctcacatcgacttggatttagcaaacacacaggccatgaaaaaataatgcacatgctgactaacttatctgaactataatggtaccagatacttttgacatcaacaatggttgaatttattattttttggtagtatgaaatcaaaggtggcaaataaaggaacagtgggttgtgctctccctccccctctccaacctaaaggcatggatataaatgagtagagttgggatgttatacttcttttggttctcacaaaagttggatcttgtaggcgcgtggtgtggtttgtagttttttttttcctagtcatggactcctatagctatgattttgtttttttttttgctatatcaatatgaaatctcgcaccgtcttgtacagttcagttcgaaaaaaaaaataaaggaatagagaactaacatgcatggctttggtggtgaccaatgtggccatggtgctgcatgaacttggaagcatatgcattacagtttttagaaagttggtagaaatcactggtaagcagctcttttactatacttcatgctcattttggaataccttgcagaagtcacaaaacttgtgcaccaagaagtagtagctagtatcagtaatttgtatttgaggtgatcaatgctgcacatatctatctttagctatgactttgacaaaacgtgctccaccaaacatatgttgtctgcctaaaaataaactactagaatttataggactatttccgattaaaatttgtaacttgagcaatttgagggaaataggccagcctacgcattgtttgtataacaatattgttaatgtttgctgcttataatcgcataaaaggctatttttctcattatctaaaattgatcgttttctcgtcgaaccgcctaatgtaatcaatgtgttgaaactgagcaaaagtgaaatcagtatctaagaaaagggcatgatgggcatctatctcaatcggacaaaggcggaggccgaggagggaaagaagaaaggttgtatctccacattcactaaaccaaatacggaactcatgtttgtaattccatacgagatgaaagtctcatgcacaattttgcatgagagaaagaagcgaagaatcctcttttcgacaggagccatgctttcactaaaaacacgaatatttctataaccgttacattaccaacatattagagctagttaacaaaagaagcaggtgcgactacgaactaaacccacatctaactcggttaaacttatgtaactcaaaactcatagtagtgcgcaaaagcataaccatgagccactagctaagggcgtgtttagttcacgccaaaattggaagcttgattgaaattggaacgatgtgacggaaaagttggaagtttatgtatgtaggaaagttttgatgtgattgaaaagttagaagtatgaagaaaaagtttgcaactaaacaagagctaaaagacacaccatatggtcaaatacatcgttctcagaacgtaattttatcatggtcaaatacaccgttttcagtaatttaatctctgctatagttagcaacataatttattacggcccatcaagaagaaaaaggaaaaaggagagagaaagaagcaacgtttgcatctttttcttagtttgagctgtcggtagtacaaaatccaaggccagcgatcaatcttaaacacaaacataaaaaaaatggtgtactcgccttaattaaacttattttgaaatcaacttgcaaaccccatccaatgaaaacgaattgacaaggcttagtttagattaaccagtaggagtactaccccaaaagtacttaaggatatgggtcaagactagagaaaatcacaaccaatcggagcaaacaagaaattgaaaaggaccttccctgcttactgtcagatggactactttgagaaaaaaagggggcaaaataactatatcaataaattaacctctgtcaaaacaggcaacaattaaaattaagagcagcttagaccattctttctaattttctagttataagatgcacattctacttcagttttcgttagcgcgtttttcaaactgctaaacgatatgttccgtgcgaaaactttctatataagtagcttaaaaatatcaaataaatccattattcaattttgtaataatcaaaaactcaattaatcatacgctaatgactttatattcccttactcaatcttcatctatcttaaattgggccatgtctctttttttaattaagatgcagattttacttcggttttcattagcacgatttttaaatcgctaaatggtgtgtttcatacggaggatctacttttgaaaatttttaatgatttaaactcaattatttatatattaatagctctctcattctgcgtgcccttacttaatcctcatcctcattacttacaaacactgcataacggagtaatagtattattattaatgttatgttaatcctgatgggtaccgangtctatctacttncacatcg

SEQ ID NO: 61241 - DNA, 1930 bp, Oryza sativa
  unsure (1)..(1930): unsure at all n locations
agcgaaggacggcgcttggccccgctcaaggacaaactgtggtttagcttccaggcgaaggcacgggtcgagttcaatcaagatagggtgggtccccaccgaaaaaaagagtaggtagaggcggtgcatgtggtatccccttgaggtataaaaagaggactttgcccaccgagagagaggacgactctcaaaaaacctgagcttgtggaggagggaagtaagagtgttctgccgagtttaggaacccttgtaactctcagtctaaatcccatacacaggagtagggtattacgcttgatagcggcccgatcctgtataatttggttgtgtgcgagctagctaggagccttggggatggatacgcgatttctagaggcgagcttcttccctcggccgaactcacgaaagggggggtctcacgatctcccgctagagaggatcacccctcgacaagcggaaataaaagttacccggttagaccgccgaaacacggtgaaacacaaatcgaagaactctaaaagtggatgacgactttattgattctctctgtgtttacaaagtgcaccaacagcactccttacataaatttcgactaaactcgaaaccctaactcaaaactcaactcaattgctctccaaagcgataccgggaagcctcacgctccccctctatttatacatgaggcagacagcctaaagccacgaaccaaactcatactaggagtcctaaacaccttatgaaaccctctagtacaagaaagaaactttacataaccaatcgtaccaaatttggactccttccaaattcaactccgtatcccatacgcacacaatacctncattgtatgccatatggaatctncatcaaccacgtgcatcaactctagtctaagtattccgcatgatctctgaccaccacggacgtcgtcttatccccaagccgattctcgatccatcaccgcaaatactctcccgaagcattgagtcatctacacatgaaataaacaaagaaaccatattccaagaccaagctatctccaacttgactcattagtagcaaacagtagtattacatacgtatagtatccatctagaagtcataatcatgaaataatcacggatatccaaacaaacaacccgaaaccgaaactgacacagcgtcggccggtcagaccgcgggctgcgccggtctgaccgcgcattacacgccggtctgaccggttaccaaagcccggtctgaccggtcacataaaatgacgaatcctgcgatcacctgtgaaatccaatcatatctaaaaccacttcatgaataaattctaaataacaaaaccaataatctccaatgtcaattgttcatcacagaataataaacaaaaacacctttgattttaaaaaatgtacacatggcgagtggcgctgtgtgaccattgtacgtatacgtaaggatgacgctcttgttgatgcaacgaccgcacgtatacgtaacgctaatgcatgaagcatgtcatcagagtagctaattaaaaaattgccacgtatcctcttaattaatcgcacctcttgaccactatacaattaattaactcagctaaatatactgcttaatgtcatccactactgttgctgctggaggcatatatatccatatgcatctatacttgtatgttactgtatcaattgctaaattaatgacgcatcatgatcaatattgtaacatagtgattaaccaccacgtgttagtccattcacaattagatcttgtttggaagattgccggagattcttaaaaacatctagaagagatgtgtttttcagcttttacttatctattggttaaataaatttggaccatttagagaacctcaggagattttggaaaaggggatcatctagagtcgacgtgcaggcatacaggatagttattcaaccgt

SEQ ID NO: 61242 - DNA, 3600 bp, Oryza sativa
  unsure (1)..(3600): unsure at all n locations
agcaaatgcaacatccncggggncagnnnanngcacgncttcacttcggcaacggcaagcacttcaatcgggatcgagccatgaggggtgaagtagaaaagaaganagattgcgcgnntggccactttcgcgggccactccggcngtcggccacttgcgccgccttcttgngcgctncctcngcccttttgcgccgcccgcaccgccgcccatgccactcctccgantgcgccgcccctccgcccggctgctcctccgactgtgccaccctgccggtcagctctcgtcctccccatcctctcggcggtagaagagagagaaaggtggggagattattttttagagttgtgaagggtgagtataaatatgtggtagttgtaaaatattagtaaaatataggatgttggtatatggaggatgtaatatagatgatctgttgaaatgaaaagtaatatggagtatgaatctttttagatgactatctaaatgggagtatggaggatgaaatttagatgagctactagggatgctctaaggattggaaggtggcatggaagaatagagggttaaggatgtagaaggctctgccatatcatcctcccagtaggcatggaagagtgtggtacatggaattggaatctatgtaagtgttgatttcttttatattcattctatctcaagcatattttattttttttaaaaaaataatcatatttatagttttcatgcatccaagacttaaataaatatattatctttttgttttagtgttagattaaattgttgatggaacctgagaagttgttgtaatactcgatggtctcatgcatgatacaatttcttggtgtttatttacatgtgagattattttttccttagtcttgataataaaagaaatatatcttacactttcggatggagagatggagagagtacattgtaggcccctgtcatgctacatgtattgacatggtaatattttactcattgccaaattaaggactcattttttgcaaatagctaagtatcggtttgttcttaaccagaaaaaatgcccgtgcattgcaacgggtgaagtctattttaagataaaattcactgtgggagtttgcttaaatatatatatttttagaaaatcatgacctacagttaggagtccgattgtctcaagttagcatgcgagtttttttaaatatatttcttatatgattccttctgtattaccaaaagtgaatgatcttaaacgatcttagaaaccgactcaaatatggatatgtatttctaaaagcaaacaagcttaaaaaccgactaaaatacggacggcgtaccaaaaaaccagcaaaaacattttcaatttttaataattgtagagaaatattggtggagagaaaaaataaccttcttatgttttacgtggtactgtctccaacataagagataacatgtttttcttttatcatttctcgcctctagctaaattttttatgatgataccatgctaaatggcgacaaagatgtcatcaccaacataccctcaccctttactttgtagaccagagatcaggttcttctaaccttaaagtcactgtgattttattattaacatgcagatttaggtttttttggactcgtatgttagcgacaaaatcacgtaactttaaaattaggagatcctggtccctaaagtgatcataagtgatatactccgttaaaaccatgttgttataatatgtttaatttaaataaatatttttaatatccacatcagacagataaaatcagctgcgaattggggtttggggggggggggggtagtgtatgcagcacacatcaatatcatacttcctccgtttcacaattatctagattcattaacatcaatatgaacgtgaaaaatgctagaatgacttacattatgaaacggatggagtagatctagattcattaactgtaacaccccaggtaaccatgtacctagagtggcacaccaaaactacactcaaaaccactaactcccaaaattattacaaatttcggcaaagtctcccctaaaaaatacggacatccacgacaggcaattataagataacacaataacgatataaaccacacaatccaaaccatcctagctccataagttccacgcgaaaataaggaccagaactttaaataacctctacaagttctatgcaaaactttgctaagcagaatcatagtctaaaactaaattccaataatgtgcaataataatgtgtagtccagggtgctactcccgtcccatgccaatcaatgtcattaggtacctaaaaaccaaattaaacacaagagtgagtaaagaatactcagcaagtacaatattgaactagtaaaacatacacaggtttatgcaataagaaaaccaatatgaaacatttgacttcctttaatttaaaacgaaggaggcaaaagtagtagttccctcccgggcaggtgtgaatatcctcttagcattaccggtaagccgagcaaacgtaatcagcgcttctcaaggatcatgaataaagatccaaattgcactcccatgactacgcatggtacttgaataatgtaaacaaaaacttccggaagaatgaaacatgaataacgtcgtgaacttgaacatgaagtgaaatatgaatacgtagcataataccaacaccacacaattgataataggaagcttcgaataataattgggtaaatgaaaccaaacaaaataacatagtttatccatcacacaagtccgtcttgtacttgccttaactccttcgataatccgactcaactcctccaacgttggaaccctccacacccgtggagccaaaactacgtataaactactatatccaactaatgatagttacaaggatatttactaaaatcgaaacccagttcatacaaatttttaccgatttgtgttaaataacctatagctattccattactgttttgttttatatgtaactcacaaaccgtctaacggaacctagcaaataatacaacttcggacatccagacaaaattttctaccactttcatgttgagcacaaaatcagattatgcctatgaaatcccagattaaggaaaacgaattgctatcatgattttcggacccggtcagcagtactatttttttgttgtttctcccaaaccgtttatcggaatcgagcgaaaccagcgctattagaaagatatcaacgatggctacaaactttatttaggacaaataacctgaatcctaacggtttaataccagatttgaaaatacggtttcagcctataatcaataacctcaaaaattgcacaaacggctatctaataaatttctatttaaatattatacttctagggagtaaacaaaagtaccgttgcagcgaagatactagaatttgagaacaaacgcactagttacgaagtcactgaaatccccaaaattgcttggcctttctctcccccttcttcctcctgttctcctgttctcctgcacccttctcctctgaccacgcagcagcaggcagcaagaaatcatcagtagcagcagcagccaancaaaacaacggtcgacaagcagcaagccaggtt

SEQ ID NO: 61243 - DNA, 1115 bp, Oryza sativa
  unsure (1)..(1115): unsure at all n locations
ccgtgtagaagtacaacatcttgnacccgccaccacccacgggtacgccgcatctcagcagagtatcaaaagcgcgcggcggagacggcaaggaggtcgacgagcggcgaccggaagtcgtacacccgcgcgggcgggcctgggtgacgacacattcacgaacgacgcgtccccggcgcggaggtgcccacggagaggaatgtggacgggagcggattgctgggccgcgtcgaggccgacgggtgagggggacgaccgccgtggccattcgcgcgacagtagccatcggcggcggcgcccgtcacatcggccctccttttcggagcgctcctccctgccagccgccagccacgccagccctcttccccgtcgcgtggaagacgctgccgccatccacatcaaggcgaaaaatgagagaggaaggagagaggggaaagagagagagagagaggggtgacgtggacaccctgtcacatggggcccacgtgggtctcacgctgactcggctgccacgtcagacaaaaccagggtgaaaaccacctagggaactaaagtgaacggttttataagttgagggatgtgatatatctggttgtgtggttgagggacgaatgacaagttgagggaccttcggcgtactttttccttatcttaattaaagccataataagccgggccgagctcaccagcaggtttgatattcagccctaacaatggcgaccgcaggcttgatcggttggaggttttggttggctgggctaggccagttccgagtagaagctacaaggaataagttcaccggacgttcctcaacttaacagagagatttcctgagattcctcagccacaaaatcagaaacgttcacctctaaactcatttaaaccgtgcaaagaaggtattatggcagtatttacatccagttttgctcacgtgatatcctagtcagtaaaaaataaaaaaatgaatatctaaggcatacatgtaagtgagataaaatggagagagacggctggcgcgattgcgagctcnacngccgaaagtancggcgcgccgtgcggcaacgggggagaagaacngtaaaagagggggaacaccggccgtccttcatcgtgat

SEQ ID NO: 61244 - DNA, 1733 bp, Oryza sativa
  unsure (1)..(1733): unsure at all n locations
ctgtcatgatgatacgtcancttgtaccccaactcaattcaaacctaccctatcgaatcattcttttacattacttactttcagtcatgtcttttactttatcctagtttcatctatttttctcgattttcatcataaatcgcctgccttcgctacgagagtacgataacctttgtaggtttgtctcgtaaaccttccgattcacccatgagatgggtgattaactccatattgacctaaatcaacctagagaccggtttacatctctaaatcggctccggtagcaggtttaatcttcaaaacccatcttgctttagagttttctatcaagatggttggcgactccattaatgcctcaaatatttagatgagtccgtgttgatcagaaaaagcacctgcagtactatcgtataattatttctagagtgaattgtacattggaccacctattttgacctaagttgcatatctttctgttcaagcaagtacacatacattatctttatctttgattaatctacaatatacatataaattatcattttcaatgaaattcgatgcatataggaaatacatgataaaaacagtatgataacatgacatcatacttcatccacacaccacactgcagattaatttactgaaaaaagtggataaacttttggataaaagtggcacgcttttcaaactgctaaacggtgcatttcgtgcgaaaactttctatatgaaagttgttctaaaatatcatattaatccatttttcaagtttgtaataattaaaactcaattaatcacacgttattacctccttattttgcgtgaaatatttaatctttatattcatctttatgttaaggagatttaaacaccacctaaatgtaccatggtccctctaattttaatgctctgaaaagtataactcaaatttgtgcattcctatgtgatatacattccctaggtccatactccatccacgccacactgctgtgtgtactgtccactgcctacctaccctgtaccagtacatggaccatagctaggacagtatcacagacggtacaactgttttttcatggtgtccgtatgcccttgtccgtttacatacatgcttgtattcatcagggagaaaaaaaagatagaaatacggctaaaagaattgaaacaagaaatccatagacgagaggaatttgaaagagagaatctctgccagggcccacacatggacaacccttcaaagcccctggtctgacatgtacaaatccctggacggccttggggggccacagagagagagagagagagagtgcatatgactgatctgtggagctggagttgcttccaactttgagaattgagattgaaccaatgtgtgtgagagagaggaagaactagtaagtacagattttaatgcggactcttgaaaatatactggctttaactttatctcactggtaaataaaaggatccacacactaacactaactatctataaggtggagttttcacacttggttaattatgtaaaaaaaagctaatattatgatagcaacaaccagtagtccaccaccgtaataataaaaatgctatccattaagcggagtcgtcctccttccctccccttctctcacacacgtggcacgtcatacgctccgtgcacgtgagtaactaccgtatccaatattatattcttaatcatcttctaagctaattctaaatatataaccttgacctat

SEQ ID NO: 61245 - DNA, 2612 bp, Oryza sativa
  unsure (1)..(2612): unsure at all n locations
aggattgattgtgatttacttggaccatcctatagtgaccccatcgtcattttgggctggttccgcccctgtctccaagtttctctcaattggtcctattttctggtttcatgtcggttggctaacgaatatcaacctatagcaaaggaaacgtatgtcagttttggtgcgagaaactgataaatcagttctgcacttctgctaaaatcaatcataagatgtgctcagatgcaaactccataaacacacacctgccaactgtatatcgtttggcaaggtaagtaaggtgtgccagctccgctctactgcatgacatgcatatcacttgccttttatactggtagaaagcagtgttgtagcacaagagccctcaaagcaagattagctgccaaatgcgacgtctaatgccttatcagtgtggctatggataactcctagaacactgatgtatgggacaaatacattaaagtgtaattttaatgttcggtttgatagtatgtagtatcaatatgatcaataattcaagatgtgcatgtaaaatatatagagtaaaatgttatgcggaaggttgagtatgtccattcaaaccatagatcaggagggaaaacaaaaacatcccaaaaaggaaacacttcttggtgatcattttgtttaacattgtcaatatttcataagcaaatagacattaagggcctctttaaatcgcatgaatagaaaaactgagtaatagggaaaaaaaacaagattctaataggaatgcaagtgcaaaacagatgattatgaaacacatgaatgaccgtttgattgaatcgtaggaaaatcgcaggaatcagatgagatagattcaaagaaaaatttccaagaagttaaaactcttgctaaaattcctccaaaatctctataggattgtccatttcatagaaatttctaaaaatatgatatgatttaatcctttgtttcaaaggtattcatataggccatcttctgttgtcctgtgaggagaaggaacattaacattgatccttcctgattttgttctctttttgacgcaaaagattttgttctcttaagtagctcgatcgatctttgacatggctttgccccctacagggttttgatgtgtagataaatgtgatgagatgaatccacgttattgcagttctcatttctggttgattgctatgtgcggagttgatttctgtgcatcttttcccttgaagtgtgattttttccctgccggcttgagtgccttatgagttaattttgaacttaattattgcactctatatgggttttgattattggcattggcagatagtataggaagtggtaaggtttttactgttttccgtgataagaatcttgcttacccatagtgttgctgttgtcagttggccatcagctggcttaattgtggcttgtgagagttgggaattgtcttgcacggcaccccatctggctggattttgcattttgcaatataaaataggagataaaacttgcaggggtttcttgtgcttcaccgcagtgttatcatgttgtcacctgattcagatagcaaatgttatcctcacttgtcacaatgagaagagcttaagctcttttttaccattgtaacaacatatatatattgggctgcgtgcaaaggataaacaggctggttacactaaactgggaaggatgtttagtggcttgggattctgtctgcatgcctaagaacgtaagcgggctgggggtcaaaaacatcgaaaagcaaaatacagctctcctagtaagagattacaccacctccacgctgatcactcttcctgggcttcctggatatggggggaacatctaaactcgaacttagctgctcataattaacatgcttggaacgcattgggactccatgatgtccctgctgccaattcttcagaaacacacctcagtacgttcaggttggagatgatcaacgaacctcattttggcatgaccactggtgtggcgatgtgctggctgacaagttcaggcctctgtatactcactcgcttgaaaaaaatgcctcagtggcgcaggtccttgctgacgacctcagaacccactttgcccccaggctctccacagcggcggaagatcaatccaaccatctcagcagcctcttgatgcagtgcctagtgactcatcatcaagatgggaaaatatatagtgcaaaccccntatgttgggggaactctgaaactacccgttggatctataaataaactttcctaatgagggacctattaaactcaattaaaatcacctgccatttacattttaacatttgattgtgttctggatttagactttgtttaagggggttcctttttagtccgacctgtatgcattgcaactttagattttctttatgggcacctaaaatatctttgccgtaatcaatggttatacctgtttccttggtgaaaagtgttttccgctttaaaattcctacaatttaccgggctcggaggtattaaatttataagccgtggctcctaatttgggggcgcccactacatatatatgcgttgggcttaatggcccgctttctacatgggaaacctcttgggcgccatttttttattaatact

SEQ ID NO: 61246 - DNA, 2792 bp, Oryza sativa
  unsure (1)..(2792): unsure at all n locations
cgacgaaaaagataaaaaagaaggtgagactaatttgttaaaaacgggaaggagagaggtagaagtattttaattatagtaaaaaaagaagataggaactgcaggtggacaacctaggaggacaagagggggaccaagagaggtgggaaagaggagaggaagaggggcggcatcaacacagcggccacgtcgagagagcaacgatgaataagatttaaatgaactggatagaggggtaagaggagtaagatagggacgagttgggatataaggtaatggaggtgaattcntgnaagttgatgtaggaacggtggaggtatgaagtaggagagacgatangggggggcacttacatattttcccccataggatcctaaaaactagggatctttatcttgcagaatacgacgagatggagaagtgccccaactggaaatttgtgtgggagaataaagctcctatgaaagttcagttctttgcctggctcttgactaaagatcgtttcccaataaaacgcaacttgcacaagaaaaccatagtaccggctccgacctgtgaactttgcaactctgctgatgaaacagccctccacctatgcttccagtgccccttcgctgtgaccctctggagcgcgatgaatataccggtcaatgttgcgatgcttgttgagattgcctcaagttcccttgaagcactttagggtgttctacttgctatgcttttggaacatgtggaatcaccgccacggggttgtcttctgacacgaggcttcttctttgcgccgtttactagagcagtgtatcgaggatgccttcctctggggggaaagaatcaaagtagaggagacatgtaatttcgacctggaaagatctcttttcttcctccctccactctctcaatatgtaatgctctagactttgtaaaactgccctttgctccctttttaatgaattcaggtggggaagctctccccccagcgaattttctaaaaaaaaaatgggaaggatgggacatgcctgagtttatttccataaagctggacacaccctgatccaagagtgtcaggaaactcattttagccttggatgctctgcatcaccttcttcaactcgggagttctcaagaaaaattaaagttaggttgtgtttagttcagcgcaaagtttggattttggttgaaattggagatgatgtgactgaaaagttgtgtgtgtatgacacgttgatgtgatggaaaaggactgaagtttggatccaaactttggatctaaacacagccttattgtaattcatcagcgatgttccttaatccgacgtgtcgacaccattgtcaacaaatcttgaaagagaaaattgacatttagccatcctcgggttggggtttcgctagaatgccatccccgaatgtggcttcgttataatgccatcttcaaacgtcaccatcttgccatattgccattcatccaatttcagttatttgcaaatgttaatccgctttgatctgacttttttgcccctattgctatttcgttgacttgctgggagggacagatcgatctccatccagtcgtcttcttcctctagtagtcgcagccggacggcaagcatagctcggacgtgctcccggtcccagcgctatcgcagcagagctatagcagtcggctgcgcatcttctccggcacggcgaacccgacgctggcgcaggaggtggcgttctatctgggcatgaagctgggtagggtgaagatcaagcggttcacggacgggggaagcgtgcgtggttgtgacatgttcctaaggcaggccacctgcccaccacccaacgagaacctgatggagctcctcatcatgattgatggacggcccccgcgcatcttgcggtttggggggcagcagcagcactagtatggctatcgatctcgccagccatggcggagctcgccattgaagagggacttcaaaatccacaacagaattaagccgatttgagtgggatttgtggggggaattgttgaggaggacgagaggaactgatttttgcattcaatttggggcgagagcaaccgaggagggagatcaagagagggcattgttgcatgagttcaccggagggagaaggatggtggcgggcggaggtggaaaacgctcctggcgagtgggccccacggcggaaggatcttggccggtgcgtggagtggctaaagcaagggcattttggtcaaaccaaataagcaaaacaatgaaaaatatttgcaaataactgaaattggctaaaatggcagtgtggcagaatgggggcgtttgaagatggcattataacgaaaccacatccggggatggcattctggcgaaaccctaatccgagaatggctaaatgtcaattttctcatcttgaaatggtttggtgatatgacatacaagcagttgagattataggcatataatgatttaatctatttcataaataaatcatgacattacagatgaaaactagcatgaacgcatcattagatctacacatgtaaactacacagtataacatgaacagatcaaacatgcgcaacatattgaacacgtaccgaggtggcggaaagaccggctgctcggtcgaaacttttcgcaggcgtctatgaaggcacgcagcacgcgagcgaagaggaagacgagccgtcccggacgaacagggaccagtcgtgcaaagcgcttcccaaaattcttattaccgccttctcccggtgcaggggggatcctctagagtcgccctgcnggcagcaggcatagaatctcaacgcg

SEQ ID NO: 61247 - DNA, 2537 bp, Oryza sativa
  unsure (1)..(2537): unsure at all n locations
cccctctacggcgtcgggggggttggtcctccttgccggcggcgttcgtcgtcgtcgtcgtcgcattgaggggggagaggtgatccgcccgtagtccattccagctcggggaagggggggggcatgggggcaactggtccgcgtggtggtgccgccgctctcgaattcgtgcggggattttggttttgaagagggaggtgacccgcacgcgccgatctggtgaggccttgctcgttttgtgctgttttttgtgcctagctttggtcggaggtgtttgaattgttggggaattttgagcttttgctgtgatctgagcttcaaatttcggtgggggttaacttggcctgggcacctcggaatttctgtttaatttttggtggggtttctttgatcacaagatacttgcttgcttggagctttgggagcccgaggcgcattaaattccacatcttctgcgctgttttatcgggaaattaaacatttcgtgctcaagtctgtgggggggtttttccctcggatttgtcaaatctggcggctcttgttcgaaaattttcatcttgggagcttacgaacgcaaaattcttcacatttcttttgcttcctggcttggaagctgtggaatccaaatttttatgtgctgaattgacatggttagccatgttttttttccacagaaccacatgattttagcaaaatttcgccatttctactttgatccggtggaatctagttgccagatgtgtcgactggtaccttgtctaactagctccatggctatgcgcttgcaggatgccatctcaggtcatggatcagaggcatcacatgtcccagtacagccaccccaccttggctgcatcctccttctcggaggagcttcgtctccccacagaggtactccataattgcgataattttggtccaaatcttccttctggaagtcttttctatgtgatggctaatggtgatctgtctggaaattttatttgtttagcctttcctggtgacctggttatgattcatatctacaaatctttaccaattattctcaccatgtttatatattcattatgatgaatatctataatttgtactaatttttctctcaccatgttcatctcttcttctatctttgcagaggcaagttggattttggaagcaggagtcattacctcatcacatgggttagtgctgagtttgatttaacttatactgggttttgttctacatttgtctattagtatgccttgcggttgcagctttaaattttcacgctgttgggggcatgtacttagtcgtttctttatgcatggatagcaaaactttggggacatctattggctcttttttctgcatgaattacaaaccatctataggagggctttctttgaaaggtttacctggccttgacagccatctagcctgcctaaattgagttaacactaggtgctggccttgccacctgattagtgccttggtgaacattggttttaagtattttcccctctatttatgttagattaatttgcaataaataaataaataaataaataaataaataaacatgcatgttcttcttatatatgcaattggttgttgtgttttttcttgttatggttactttctttgttctattgtactactctttgagtctttgataatgtgatggttcataaatatgtgggtttcccatgatattttctcataactaggtgggtttccaatattgacaggaagcaagtctgttgcatcttcaccaattgaaaaacctcaacctattgggacaaggatggctggtcgactagaacttctacaaccatataaactaagagaccagggagctgcatttagccttgagcacaagctattcggtcaagagaggcatgctaacttgccaccatctccttggagacctgatcaagaaactggccgccaaactgattcatctttgaagtcggcagctttattttctgatgggaggattaatccgaatggtgcctataacgagaatgggcttttctcaagctctgtatcagatatttttgacaagaaatgtgagtggtttttctttatcatttgcatttgcttcatcaaaatgcttgattctatgaaacacagactcgagaaatttccattccattgatagtaaatgtgctgaaatataccatcacatgacatatgtattggcaactacaacgcttccttacgatcttacattctatacttaatgcttctcatgaatgaatagaaatgtacaaaagtaaacaaaaaatacagctgaaatgaaagggtagtaaaatgaaatgactttcattcccttcccctttttccataagaatcttgcctcctttatctcctgtcttacatccctacatgctctgaagatatctatctcattatgctcttagtaccttgtaattattattcgctggagctcccgctcatcatgttgcgagtgaactaccgactcaaatcaccgcaaatccatcgatccatcgatgggntctggttagggaacagagtgtctatcaaaggacgcg

SEQ ID NO: 61248 - DNA, 44640 bp, Oryza sativa
taccagctgttggtccagatggacaggtcaaaactgaacctgtgctgtgctgcaaaggagaatggtgcctagaggggagtagcagtaacttagtggctgattttgtggcagaatttgagtcctgctgatgcaacttgggaggatgcaacagtgaaccaaagtatgtttccaactttccatccttgaggacaagaatgctgctaagggggaagcaatgtcaggactcagcctagaaatgagatgcagcgaactgaaactctgaatactccgaactttctgaatgtttgagttatctgaagatttgaggaggagatgtagactttcgggaggattatgaagatccaacgacagacaaaccaagcaaagcgatatcacgaaatcctagccattaatcgatgtcggggaccactgttctggtcattcttttgcctttttcctacttttgagctgtctgatgcttgagagctaagactacctcactttgtataaaaacgaattgcatatgagaatgaaagagatatcaaaactcgcaattatcttatcttaggaagtaatctagatttaggaatcctagtttaggtccttgcggcgcaaaccaaatacgttttattctctgaaattgggttccatttctagtaaaatctttctctgatcttgacatgagggggatgggaagtagcttcctcgcgccgtgcaccactctgaatcgccgccgtgcgttgccgctgtgtgccggcgtcctcttctgcagcaagatctgctggaggtcaagaacccatggacaagagagagaacagacatgaggggagaagagaaaggagaggaaaggagaggggaaggaacctgcactgccgccgccaccagtgcgccacctctaccgatgcgccgctttttttcacccgcacggtccgctctcttcacggatgcgcgagtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgagtgaacacggtagggctcacctaaccgcatttattgcggtctggtcaagcgtgtcacgctgcatgcagcgcaatgcagcgcgctcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgccgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaacctccgtccataaagagaagaaaagtgcagtttggaagggagaggggacatgtggtatccccttaagatataaaaggaggaccatgcccacaaagaggggggattttttttccagattgagagcctagaacaagggataagtcggctcacactttgtagctcctccacagacaaatccaccaaaacacaggagtagggtattacgcttcccagcggcccgaacctgtatacatcgccggtgtctcgcgtttcttcctggcacgcaatctgtccacacacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcactcgagagagtcgaaaaatccgcagcatcgccagtcgcgggtggtgcaggagaacggcgagatggggagcgtcgcctcctcgtctacggtgacggcagcacgcctcagggcgcgcttcaggctgttggcgcgctcctacgtcacccgcctgtcgtccctgacccggagtctccagcccagcgatggctggacgacgtggccaacttggtcatgacggcacagcagcgcctgggtgctggtggacggtccgccaccaccaagacctccggcgccgccactaccggttccgcgtcgtcaagacggagggcgcggcgagcggcggctgttgcacgccattcggctgccactccctcgtcggcacctccgactcgggaggatcagcatggagagctggatgcccgcctcgacatcgagcgtcggcgtaatagccggcgtactccccgcgcaacggagggcgcctcttcgtccagagtgtcacctcgacagggacgtgaggaccagccctccatgcccccggctggtggtgtcggctgtagagcctttgtggcgagtcttcggaatgtccgttggcccccaaggttccggcccaccatcaccgagaagtatgacgggagtgtcaaccccaccgagtttctccaggtctatacgaccgggattgaggccgctgggggtgacgacagagtcatggcgaatttctttcccatggccctgaagggacaggcacggggttggctaatgaacctgccacccgcgtcggtccactcctgggaggatctgtgccagcagttcaccatgaactttcaaggcacttatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgttccgcgggccacccgaaaggggaggcctgcgagcgacaaaaagaaagaggctggtgctcccagcaaggagcgcccagccagcaagtggtgctccgtccacaacacctccctccacgatctcgcggattgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgctgcggcccctactcatgaggcgacacgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccaaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgtatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttccttgggtagccaaataggacataatgttgaggcttatgtcgatgacttggttgtaaaaacgcgcaaccaagaaactttactttcagatctagcggaaactttcgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgtgcccctgctactttacttagcggcgaccccccaagtagttagtgcagcgttggttgtggagcgcgatgaaaacaatcctcatttcgtgcacccccattctgtgctaacttggcccgggagcgagcggggaggagaggcccccgagtcggacggtggcctacggcccctgacgaccggagtcggccctctgcccgcttgtcagacggtgctaggtgcccccaaccctcaggagggccccaaggccactgcgggaaggccgcacttaacgccctttgaccccgaggctaaccctgtgctgactcgacccgggaaagagcagggagaagaggcccccgagccgaatggaggccagaggcccctgacgaccggagttggccctttgcctgcttgtccgacgatgccaggagcccccgacccccaggacggccccgaggccactgagggaaggccgcccctttcatcctccgaccccgaggtcatcggcacagaagacaagtgcgccccgaaaggccacttgaatgaagaacgccccggggatacggcccctagcaaagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttatcccctcggacaaatcttgcataatcgagagggtacaggacgggtggtaaaatgggcaatcgagctttctgagttcgatctgcactttgaaccacgccacgctatcaagagccagaccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcactttgacctccccgaccggagacgtccttagatatctggtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgcccttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgtacggctggccacgggcgacggcactgagctgccaaacccgtggaacatcgaacaccttcgtcgcttctacccctgaggggggggggtcgggtgtcaggtttcgtgctcgggctaaccccgcacccccctcgggtgtgcagggttagccgggggctaccacacatgcacagccttacttttcttatttcagcatttcaataaaagcagtttcaatttcctaagggttgtgtctgtgccgtttttccttctgaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaaagttaacatagaaattttttatcatttttgattgcagattaagttgatctatacaaaaagaagaaagaaaattggagattggcgggggcctgggggctcattccaatgcgcccgggtcgccggcctcgtcgccactgtcgtcctcaccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttcttggacagcccaggccatcctcctaaggtgcggggcgaggccttccagattggtagagcgcgaaattgtctggcctttccagaggcccgcttcccgaccggcgcgatccagccgggagactgcatcccaaagcatgccgggccctatctcacccgacaagcggagggcctcggcctccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggatgcattccagattgcggcgcgcctgctcctcctgcgctgccttgcggagggacaggctgtccgccagccgttgtgtcgcggtctcggactcctcaagagctcgctcccgctcagcaagcgcgtcctcgcggagccggagcgcggactcctcttcggcgcaggcggcctcatgcgccgccaacgtcgcctcccggatagcggcggcggcctcgcggtccgccaagctaatctccacggcgccggcatgatcttccagcgccatggcacgggcttcaagggcctcttcgcgccgtcgggatgccgcttcagcctccgttgctcgctgctctcgggcagcggcggcgtcaaggacccgctgggcggcgtcgagctttttctttagctccgcctcccagctcccgtgttgaaggcggagggagtcctgcgcctcaatcatcgcggtggtggcgatgagggcggcctctcgctcctcctccacctctcgggcgatctccgccagcgccgccttgcgggcttcaagctccgagatatggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaggacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcgagccgccccggaggttgtcgcctgagcgtcacccgagggagtgggcccgagcgacgcgccggcggtcttgtcgtgaaccgcctcggaagacgccatcgcctcagcctggcgagcccgggcggtttcctcccgaatggcttcttcagcctgacgagcccgggcggcctcctcccgagcagcttcttcggcttggcgagcccgggcggcctcctcccgagcggtatcctccgcctgccaaacccgagcggcctcccgggcggcctcttcagcttcccgaaggcgatctgcggcctctcgccggtcagattctcgcctccgttcctctgcggccgccggatcttcggcctcggattggtcggacttgggatggcgggaggaacgcgacgggacatcgctgaagcagaaaaaaaaaaaaaaaaaaaaaaaaaaaaaaaaaaaaaaaaaacggaagacaaacaaggtggataagagaaaacttgctgattgggataaagggaagatggttgtgaaaggcgtgaaacgaacctgcgagggggtcggttgaacgaccaccttggaggggaaatcaggtttccccgggatggttccgtctcccccgtcttgcggagccgcttcttcttgcgctccgtctcgggctgtgatgtcggcgcggccccctccgggcgcctgcggctggcacgcaccgccccgtcccctcggggaggagatgggggaggtgttcctccctgtttcctcttcccccgggcgtcggcagggcggttgctccccgagcccccgtcgcggggcccagaagcacggccccctcctggggttgattcttcctggcggctcccgccggcgccgtcgtggcccttaggagccacctcctctgaggccccgacccccatcatgatggtcagaatggaggcgcggtctggatcgcagcagagggggaggagtccttgaggaataagagacgcctccacggagctaagattcagcaccctttggaccacgatcttgaagtcatcgggagcccaatcccatctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatctactggcgcccgccagctggagaccggcgccgggggctggcttgggagtcggaggcgcgcttcgttggcaaggggggtgtagaaccagtcgctcttccaatcgtcccacttcttgcggagggcgcaggggatgtagcggttcaacactggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccagccattgcgaaggggaggaagaagatggaccgccccgggtaatctggtgctgggcgcgcctcgcccagcatcactatctcccggccggtggcggattccggcatgaagcggcgcggcagcccagcctgcctctcgcccacaatgcgggaaggcggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcttttcctcgatggctttatacccttcccatcgctgagcccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgatcgccgaccgaagcgacgttaccatatctccagacgaaacgaatctgcacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgggtgaacacggtagggctcacctaaccgcatttattgcggtctggtcaagcgtgtcacgctgcatgcagcgcaatgcagcgcgctcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgccgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaacctccgtccataaagagaagaaaagtgcagtttggaagggagaggggacatgtggtatccccttaagatataaaaggaggaccatgcccacaaagaggggggattttttttccagattgagagcctagaacaagggataagtcggctcacactttgtagctcctccacagacaaatccaccaaaacacaggagtagggtattacgcttcccagcggcccgaacctgtatacatcgccagtgtctcgcgtttcttcctggcacgcaatctgtccacacacagagagagcttgagatctcaccctaagcccccggccgaactggcaaaggggggcctgcgcggtctcccggtgaggagccacgagctccgtcagcgagacaggagagggagagggagagggggagggaagcggtatgggctgggggtgggggagagatggaggggtagttggtggcatttgctggtaattttggttcaactttcggggtacttttgaaatttggttggagttggagttgtggagcgacgggaatgccgctccacgccgctagtacaattttgtggatcgatccggcctactccgctccatttttttgtggagctggactgtttggttgtgcaccagtcagatctgaggcgaatctaggagtgggagctgcaccaaacaggccctaggtaagagaatacctgggtgttacaccctccaggatggcctcaagtatagcagctataccattttgtgtattagcttcagataaccagactttgtagaccatgaccatccatgcttctaccaattacatcaacaatagatcaatgtccttggctgaatcgaattcaagtgaacaaactatagtgaattttgaaagtttgcaccgattgtattcaactccaccatcagtacagccttgtgcacctcctctaataaatgtagcaacattatccttctgaaagaaatcgtagcatcattatacacttcagtaaccatttgccccactaatgtagttctctttgttgatcatagagggcatgtgtagtgctcaataatgtgatccaccaatcttgatattgccgtggcataagcttggattgtatttccattggtaggaagcgagcaacctgcaagagtgacactcaagatgggtatgttttctttactatgaaatttcagcaattcatgcaaccatgtcatctctggaagatctagtgcaaacattgccgtgtcaattttacaggtttgcgatggggatcgatttactgcaagaggcctagtggctggtttgaaccgtaccaagtcgggttgaagtaagttcgaccaagggcaaacttaactttaatggttatttctttctcctattacttcgaaaataataaaataataccgcaagtgtccaacacctaattaccggttttttgccatgccctaaagcagatacgcgtttttatggtgtccccaactaattacacttttttggatgtcctgtagcaaattttgtctatttttttttacttcttggttggttcttttccttattcacattttcttattgacatgtactttatccgtcccacaaaatataaatctggctatgcttctgtctaaattatactctcttcatctatttttgatagtcatatttcatcttggcacactgactaaggataagtaattctacttatcatccatttaaatatgctactccctccatttcaagttataagatgtcttgactttggtcaaagccaaagtgctttgagtttgacttattttgtagaaaaaatagtaatatttttaactcaagacaaatatattatgaaaatttattcaattatatatttaagaaaactatgctggtgttgtaaatattactacttatttctacaaagttagttaaatttagagtagtttgactttaactaaagttaaacgtcttataacctgaaaacagagggagtactagttatttctcgtaaacaagcgattcattaatatttacatttttcgatgtccatgtagccaattttgtgtggaagaatggagagacacgtattaaatccgagaaagttgttaagaggatatgattgaaatatgccaattaaaactaaatttttcagatttgaaaatagatggagggagtagggttttttttcctgacggagtgcgaagaaaatggttgacattgtctacgaaaaaattattgttcaattaatatccaactataaagctgcccataacaccatattgattcctcgtctaaaaaaagcattaagaaaataataaagaaataaaaaccaaatatactccctccatacttttgatagtcatatttcgaaatctgaaaaacaatttgtttttgataggcatatttcaattcaacaacctatcatcttacatcttaatgattttctcgaatttaatgcatgaccttctattcttccacacgagattgactacatgggcatcgagaaatgtaaacattaatgaatcgcttgtttacgaggaatgactttaaatagatgataagtagaattacttatcgttgatctatgtgtcaaaataaaatattattatcaaaagtagatggaaggagtacctcggaagcctagcctatatatatccgccgtcttttctgttctccatccgcatccccttccccaccgtatccgcgattatccaacccccgccgctgccccccacccccccccccccacccccacaggaatgccctcagcgctcaccgcctctccgtggcgctccgtcaagcttcgcggccgcaagatttggcctcagcactgctgcgcggcctccctcctcctcagctagtagtagccgcctcatcacgcgccgctcttcctcgcggtctgggcgtttcgtcgaacacctggtgggctccccccttccgccgccgcaagaactcgatcgatcggtcggtatgaccgtcgcttcctccgacgaggcgtcccggtcggtgctgcggccggcaccgcccttgaagtgggaggacgaggaggctcacggttcgtcgccgggagaaggaggcgctgctggttgggccgtggatagcggggaccaagaaaatggtgcggatttggggccggtgatcgctgtggaaggacttggtgggctcgtcccacaacccgaggtggccgtcgtggccgtcgagttgctgcctcagttggttcaagaaccgggcaaagtttccccaagaatccatgaaaaggcgaattctggggagggtgagaatggcgatggcaagtatcgtgtcgtctacacagctggccgccgcaagaggtgtctcatctcgccgggaggcagcgacggcgacaggatcacacctcgcgacctcgccgtcgcctttcacggccaagaggcaggccaggtggctccagaagctgccaccgccgcaatcgccgacggtgctggtgtcgccgtcgattccgtgctcaccaaaatgcaagaactggtgaatcatggttcatgtggcaatggcaagaacaatgtccgaaaatccaggagaatccacatgaagcaagctactgccgtgcctgtttccgatgagctcaagaatctccatagccaagaagcagaggctgcccatggcaagatcaccgatcaatctgattgcgagattaagaaggagcctcgtgagagttgcatgtcctctattgttggttctgatgacagccacatcagtggcctgtccatcaggttgcaaagcttggggatcaacatcaccagtgtgacaccgatcctttcaaagaatgtatctagtactgactgccatcccaaccaggcccggctgttgctttcgcgccacgcggtggagggctcgccgcttctggggatgctcacaccgttggaggatgcccttgtgcacagttcagggctaccaatcgaggtcgttgacagatatggctgttcctatgacatgttcctgaggtatctcgactccaccacttcctacagacttattgtacagtggaggaatttcttggaaatgagccacatgatcccaggtgatttggtgaagctgggtgcgtttcgcttcgaggggcagcttgcgctgacattgttgcattatgggaatgccggtaaggcgaagaaggtccttgacagaaaacttaaggagaagaaggtggagtcaaactccactgtgacagagaaaagcaaagagttgacttccagggagacagaggaaagcaaggaggagttgacttccaggaagacagatgcaaatgatgcggagagtgcttcaagtgtggcagaggcaatcaagaagaagtggccatccgagatgcttgaggcagcggaaaccttactaatgctgtcgtgttctggggataaaccaaaaccatcagagtgattctcaatttgtccggagcaatgtgcaagcagttcctaagcagttctattgtcagaatttattctgaaggtttcgtagttctcagctcatttttgtgacttggtgccctgatcactggtttgtgtcctgggctgtccatagaatatagatacttaagtagtgattcttagtattaggtatactgtcaatatacctcaaattagacagagtttttgcaataaagtgggcatttaagcatatgatttgtctgttgtattagtttttcaccctgacaaattttctgcctgatgcaaagtttacacttctcctaaaactgatttgaatggttatttctattgtgcatattttgttatcctgtgtggagctattctgttatgctacagttacttctccaattgcatgattgctgtgctgaatcttcagaagacgctttgcaattttctttctagcctgaattttgttcctgaggtaacacttctatgaaatgcttattaatatttaatttgtactgtaactgtgcatagtcatgagcaaagttttgtgccaatgcatgcatgtaggatgtgtcgcttttgcttcattctattactgttctctgtttgggctgtagtactctaatcatccaatgtcactgaaacatcagaataaaccattgagtcttgtctgtcaggtctaaattggtactactagcataaccatatgtaattcgattgaaccctagtttgaattcagaatgttcttagtattatattttattcattgggttatatagtctggtaaactttctagtaatcttaattgatgttgctaatatctgtttataatatagtataatatactatggtttaggatgccatgaacttagttgctttctgggtctagaattgttacaacttacatagtccctaatttgcttgaaatagttggcacacgatactttgttagttgtgatgaatttcatctgtgttgaaaagaatggacactttctcatctaaacgatgaaattttcctatccttttatttggaagagacctagtaggaaatctactgggttgatcttgttacaaaaagttgcttcaggttaccatgtcagttctgacaactacatgaaaggcccgtactttcagacatgtcaacagttttcaggatgtcttgctactgattccaggatacatgatacactgtgccacgtactttcagacatcctaaaatattgcacctttattacagttttcacttttcaggatgtcttgctactgattccaggatacattagcactagatacactgtgccacgtacattcagaacttttgaaaaatgtcacaccttcacagttttcaggatgtctcgctactgatttcaggatactttagcatcagataccctgtgtcatgtacatctagaaatcctgaagaatgttgaattctgaataatgtttgcccctttacagttttcaggatgccttgcactgatttgactttgtcgccttcacatttgttcgtaagatattgagctgttgtaattgtaaggattgcattcactgacgattatttctgtagaaaaaaagttgtgatggtaagaactgcaaaattcctggagaacactagcgacagtactaatctacaaaggtttatcatattattactttagttactgatacattagcactagatacactgtgacatgtacgtctagaacttctgaaaagtgcctggggatctaatgaagagctgatttggtagaagggagctggagaagaaacttgtgaatgggaaatattttcctacagatatttcatttatattcaacttaatgcctgaaaaggtttgaaaggtcatagagctggtgttttccagtgacatttttttcttctgcagtcgtgatgctgatgcatgctcttcgacagataaacaatcaggtctggtcaatatcgaccctttattcatttacacttctttgtactattgccagtgtttgttgtcttgctgaatttgggttttgtcactacctgatatttttattaccatgtaaatatcacagtcagtctccagtcgtggtgaccattttccacacgaggaacagatgctggaagatgacctgaagattgctctgtttgctggtgacctgaagatgaagtttttgtgctagcttgctaaattgcaattattatttcttaatggccaaacattctctcatgaattgcgtcaatcagagaggcctgacccacttccagaagattgcgtgacgtgctgtgtgaattggatcccaagatgttcttcagaggttagcagggcagtcaaaaatactggctgcttgttatcgtcagcatcaacttgttcttgccgtcgtcatgctggcacaagcctgcccatgtcaccacgatctcgtcaccggaattaattccaggtcccattttgttgttatctctgaattccaagtcaaaatcaaagctttctttcactgttaatcgtgtggatgtggaaggatgcatatacaaatatatacaatcagaagctactgctgccgttctgcaccggccccatggaggaaaaaatgaccatgatcaagacaaaacctcagtatctgttgggtcttacacggagatatattggttgcagagacatctgaacctgcaaatgcctaccattttgttgcctggtgctgacattgcaagcagctgatcatgcctttgcatgcattcccattgaatggatcagcattgacagaatgacagctctatttgcaaaatgtttatttatacattgtagagataatttcttcactttgtgagatggcaagttagatgaaccacctttgttttcaaccatatctcgtaagcagaaatgcacacctatattgactaaatctgttgcagggccttggcttttccattgcattaaaatgaactaaaatttgtgagcttatgactagcttaatactattatatcacttgtgaaccagctgtaccttgttgtagaccatgcctgaccttttgttgcatgagaacttgtgtactgaagtctgaagggacactgtactctatgtcggctggtcaggattaaaccatttcaacgcattccagcagtaagtcttcagtcacagtctctgttactgaacgtgttacccaataatcttgtgttgactggaattgttcttctgaacctactcatgagaatcattgagggataatgatgtactcctaccaccgcactctgactgacatctcactgggcatgcccctgtttgtgagccactttcatgtaggagtattacccaagaatcatattgactttgagaaactatcaatgtgaagtgtgataactcgttctccctctgtacagattcattgtattaggaggagttacatctccaagatcgagttttttttaggacggagagtagtacctccgtattaaaagaaacctcagagcaatagccaactgacgatttctgaactaaaataagaggcaattctagtgatccatactgttttgatacatgcactccctcatattataaggtgttttatgtttgttttaatttatacgtttttgagtttagcaaaatttatagaaaaaacatagtgctatctactatactaaattagttttattaaatctaccaccgactatatttttttatagtatattcgttatgttttaaaatgattttcatttttctatacacttggtcaaacttagaataaactaaaaaacacaatatggaacggagggactacttaaaaaaacatcagcacaatagcgaaatgacgttggaagtaaaataagagggaattctagtgctatacgtttttgagtttagcaaaatttatagaaaaaacatagtgctatctactatactaaattagttttattaaatctaccaccgactatatttttttatagtatattcgttatgttttaaaatgattttcatttttctatacacttggtcaaacttagaataaactaaaaaacacactatggaacggagagactacttaaaaaaacatcagcacaatagcgaaatgacgttggaagtaaaataagagggaatactagtacaaataatgttgtgacacatggtattcagtacaattctgtttatttgaggagttgttaagtacaattgtagtaaaattgtacattcggtgaactaaagacatcaacctgcgactgaaatcatggcatatatactaaacttaacactataacagatcagaacagcaacatctggcgaatcaatcctgtcatacagtacaccaagaagtttgaattttcttcacatatatccacatttgagttcctacctacacatgcaactctcttcagcacatgcaaatacacagttacacgcacaagccttatcgcccattgtttcgcttatatttatgcttatccatatagtttataagaaaagataatttatagataaaacttttatatatctgcacttagcaattcaaaaccaaatgctgtaaaataaaccataataaaaaaaaaaatcaaaaaatcaactccaaaattaagttttaaaatacaaattatagtctataggcataagcataagtgaaacgacgaataaattagagttggcagggtaccccacatctgaacccctatatatacacaaacacaagacctaggatcactcataccataagcaatccaatccgatccgatccaatccatccaacaaccaccaaatcactttcagttctcacacaaagtttcagataaaattcagctatctgaagacatcagaagaagtagctaatttaagctaagctagagaagatgaagaacaagggcagcagctgcaggtatcttcctcactcttctgcaccatgcgccaccgacggcgccagatgtttccgctgcgaccaccggccggcgatcgacgagatcgtcagggagcagtcgctggtgacccagctgcgcgccgtcgtgctgccggcgctggagacgaaggccgacgacgggcgggcggagatcgtggcgcagctgttcgggagcatactggattgctccaggaaggtgatctctgctctgaattctcgctacgtcggagaatcacctcctgacgatgatgagatcgtcgacaaaaggagggcgaagaggaagaacagtgagggcaagaagggtgatgatcaggtgaaagtgaagccacatgagcacaagagaaggtatgatttagcatttttttttccactattcatttggactaattgctgtgatttgtacaacagttgctattcatccatgttctttagcttgcttaattgttgtgtgcaataatcatagttgcatatattatagttggattaattgtcacctattaagaggatagagacattttttataagagtaatgacactagctgtactagctagctatttttttttctttttttgaaagatcactagctagctagctagctaatgttgagtgtgtgaatgacacaagtagctaaagcatatgttgctcttcatatctttatcatcccgatatattgcttgtagatacctatatatatgttgatcgatgttgctatatatgaaaggtccctttcctaataaagtgagttcgatcttgatctactttggattgtctttcctcattggcactgcacttaggactctgaattgcctcagaaaattatttgagtgtgcatgtgtagatgatttgaagttggtcttgaagctagcattatgtttctattcatgtaaatatttcctaattgaattaattttgcccctcatgtttcagcaggagatacactaactcaacatcacaaatcacagctgttccacattatgacggtcatcaatggagaaaatacggacagaagaatattaacaactcaaaccaccaaaggtatatacacatatatccacaaaacctcaattatttcatctctctctcacacacacatcaaggttccgtttttgtgcccaacatacgacgcaactaattaattaagttttggcaaagagaattcttatggcacaagcacacaactaacaatttgcaacataaattaataagcaggagctactacagatgcagctacaagcatgaacaaaactgcaaagcaaccaagacagtgcaacaactggacagtgccggcgaaaccatcatgtacaccgtggtctactacggacaacacacctgcaagactaacatgagcaatgctcctctccatgttgttgaaacaagtaccactcaaagcatctcaacaacatgctgctctgatgatcttggcgattatagccaaaagatggagaacatgcacacaccagagttggcagaagtgtgctctgatgagcttggttcttaccatgcaataataggggcagagcacagtgcactagggttggaggatgaacacatgcacaagctgctcgacacatttgcatgtggagcattagatctggacagctgggagattgatgcaattgtgagatctggtttctgctaggtgaattttgatgcatgttgctgtgatcagttttggtgcttagatggagtttttttgtattatatgtggttatatggtgcttactgaactttggtgaatgcaaaataaatagtttagtgcttgctagatagcaagttaagttaaaaaatatagttacttatattatttatatatgtaagttggtattgtaaggtacaatcaacaaccttgaagaattttgtccataaattttaagtatatatacatgcaggttgaagatatgaaacacactgtctatgatgagttgacactatatataggatgaattcagtgtaataatgggtctatttggtgtactaacaaacgaatgatgatgcacataagaccatctctcttgacccatgtatagtacaaggaacaagtagccatgcatggcaacgaaaatgaaaaaatatgtttgtgtttgacataatgtcaaaacaggcatgatttacctaaccctttttaacttgtgcgacttgtgtcagtaatatttttttaattatttctgacttttcgaaatggtctcatatgtatcagtagtgattgcttcctatatgtcatataagagtgcgttctatcctacatgttcccaacttttactcactcgttttttacatgcacgctttctgaacttataaacaatacattttttaaaaaatattcctatagaaaagttgtcttataaaatcatataatctatttttcaagtttttttatagctaatacttaattaatcatccgttaatagccaccccattttgcgtgtgtaggagagaagttcccaaccttctgtcatgaacacacctaagtagacagtaacacattaacttattactagttatcacccttacatttgttggtatatacatatttatttccatatgatgcatgctaatttctttttttttatttgtataatgacaaaatctattctataccattgagtttgttcgagttcaacgatttaccattgacattgtctctttctataatataccggcgactttatcgattgttctacaatacgccattaggctggacatttttttcaaaaatacccaaaatacccttatggatatacaaggttaacaattgatttatcatattagaagtttcaaaaaaaaattgaaaacttttatgtgacctccttacacaatatggaagttcgaatagaagtttcaagttttttttacatttatatttttttaaaaaatataacttatttgttatatgctatataaaatacttttttattgatgtttttaatataaatcatttttcatacactacataagatattatttgctagagagaatttattctataccattgagtttgtacgagttcaacaatatgtcatcgatattgtctctttctataatataccgacaaatttattaattgttctataatacactattggactgggccttcttttcaaaaacaccaaaatacctttagagacataaaagattaacaattgatttatatcattagaagtttcaaaaaagtatgaaaattgttatgtgaccttgttacacaacatggaagtttgtatatatgtttcaagttttttctggtatatttagtctttagaaaaaaatatttttatgtggtatatgagagaaaatttgcttatacgtacgatagataatagcaaaatttgcttatacgttcaattaaatccttgttctctccaagggagtcaaaattcgtgcatcaagcatgtcccaacattttctactagtatatatgttttcctccttccaacacctatacataaagcataatcaattaatatagattatttaattggtgttaattatatcgcacgactagaatgatcatatccactgaattgtcttatttttgttctcttcacgtgcataaaacctataaaaagtacactatgctaaataatagcagatacaacaatcaaacgtataataatgcatttctaaagatagaaataaacgataccacttccacagagtagagttgcacacactaatcagcatgcaggctgctactactacggtatcttttatggatattttttttgctcttaacctactttttttatatgaaatttggatatatgttttccttgattagattcaatcaccaaactagtccttcttatcaatattcccacatggatccactcttttcaattgcatcatttagctagtgtattctggttatttccttttttttttactttagcatattatggatatttttcatattctatataatatttgtgtggtactatatacctgtctggtatacacattgcgttgatttgaattattacatcatcttaaaaattgtatcctagtacagctacattacaactacttgatgagtgattgtgctttctgtttaaaataggacacacatgcaaaaatatggtcttggaccgttcatattttctaatctagtagtattcaattaggaatactagaatattttcttcactgttagttgaaatcacaaatcaacggcagatcacttctaccggtaatagtactagccatcgaatattaccggtattgccattggtggatatgaaggttttgtaaggcacatatttggtgcagaagctataatatatatatttcgtccattttaaaatataaaacgtccttgttatttattttcgactgatatttgaactaaatgttttgtgtcgtatatatagtatcattttatatttgtgttttagaatatcttcatatgaggttattaattagttctcgtacttgttgataatatattataaaaaatcaatgatcaaaggataataatgctgaagaccttgtaaaatgttaatatactcattatattttattttagaatggagagagtagttgcaagaagttaaatatgggtacaacactactactgtacaggttattttgccagaagcatgtcctgcacaccaaacagaggtgatgctgatggcgtcctaggaagactattttgtttcgattgggattaatttgtttgtccacttgctaaacaaatcatttgggtcttgtgctggcaacacaccatagtttactttatgaacaaattaaatataatccactgaaagttcgatatgaactacaatataagaaaaagaaatgtgagatggacctgagtagaaagaaacgtactcaaatgcgcacatgtgcaagcatgcatcaacacagaaagacgattggacaaactgataggagttagatatagagagatgctcttttaaatatatcgacatgcctgctccatctggcaatattaaatacaatgataatatttggttaaaatttttaaacttcgatcattttgtatgagactaagtttataaatctaataagtttgtgatattacgatagtatttttaaatacacataccatttttaaactaaacatttgagaaattataattttatcaaaaaaatattttctaaattttatcatagctgtcaaatacgtatgaccagagagatctagtaactatttatggatttagatctaaaagtagcgaacggttttaaactagctaatctcttgccgacgtcagttacattatggatctggtgagacgtagtgtattgttctgataaagttcttcacaagggttgcaaaatataatgtcgacctggccatgcacaatataatatggcctcttgcaattaatgaatgatgacataatcaagatagataggtgaaacacgatcacatagttcatgaggtgacattcatttatcttgaagtcttgaacgcttagacacttagtacaagatcgtacacggatatcagggattcgtttttaacacagcttagaatatttgataaaaagtttactattgactatggctgtgtttgaatgtgcaaattactacttttactaattcatttttttgcgcacgtttcccgagctactaaatggtatttttttaaaaaaaagactttctaaaagaaagttgttttaaaacaatcatattaatctattttttaagtttttagctaataattaattaattatgtgctaatgaattttttattttacgtgtgtggggataagttcctaaaccgaacttccaaatgcagcctaaggaatacacctaaagaaacgcgttcctagcatgcatctcaggataatttagtatggaggagaaagatcaaaatacaccttattattggaaaagtagtattggtcggtggtaagtaatgagtattgaagggataattttctttaatttgctgaccacgagtacataggagggtagagctgaacttattttggggcaatatttaaactctataattaaacttattttgggactagagggaatacactagaagagacctttaattcttcctctgtttatatgtagtggtagtttttaatattttagttttatcatctgtaaatttttttcaacatgatttgaatgttatgtattttatgagtttttaatttatcataaaaaaatgtcataacaaacagattgtgaagatgagaagggaacaaatccccctcccacccccccccccccaaaaaaaaaggaacaaatggagtgatagaaaatagataatatatatggactctttcagtggtgagagaggacattttatcttaattaattaaatttctttactttatttacggtttttgacagtcctctcttatctgacagctggaacctttttattttcgagaaacagagcaggttaaaattacatgtcctaatacaagaacagaaagaaaacaactatcagtcggcatctaaatgttgtacatctcacacaggttaattctcgtcggcagagataggcaactccatctgtgcggtacgtgtcttgaattaccatgaatcacacaggttaatcggaacttctgtttgctgctgaaatattcttctcttcctctccagccagatattcatattccatcacattgtgagaaaatgtttcatcaccatttctcattttctctaaattcctttggccgattaattgcaagcagggctccgcctttgaattttgaaagccttagtacaaagactacagatctgaattatggaacattaatagttactccatgtccccctcattccgatgaaaactagatcaacgcgccattgagttgagagaagttccgattgaatccattgcgttgagagaagttccgattgaatttcaatatgaatctttgggacttctcttgatatttatatccactatctatgtagcagttggagagataaaacttaaaagaagtttccaacgattaaagattatatttaatttcatttttttttttggaaaggatatcaattgctagaatgtgatgcatagagatctagctaccgatcatgcaaattaattaaaagcgattatattcacaactccattattgatgtgtgaaacatcaccatttgtttcagtaaagatatgggacgaattaaaggtagtacatggcaactagctagctcgatctataagcggccgccacaacattgtcctgaatggagttattataatctcggaattagcggatagataaccatagagactttattttagtttgtagtagtttattgtgcgagttggcgcttaactaatacacagcgatttaattaagaaatgtaccgtgccaagctagctagatgcatgcattaatagggtaccctgcagagtattaattaactgaaatactatcccttttgtttatccatctgacaattcaactaatatctgatgggaatctaagagggacagtgaccgggcacgcgttaattacgccaatttgcactgcaattgttctagtaatttgtctgtttttaattagtttatatatttgatggtgtggcgccagcctgaggttacttgtgacgttttgagctaggccactgatccagaaggttcaaatgatcaaatcatgcgaacgacatatatatctatatatcattctcgattgtggccctgtttagatccactgctaaaattttacaccctatcacatcgaatgtttagacacatgtatagagtattaaatatatatgaaaaaataactaattacacagattgtgtgtaagttacgagacgaatcttttaaacctacttgcgtcatgatttgacaatatgatgctacggtaaacatttgctaatgacgaattaattaggcttaataaattcatcttgcagtttacagatggattatataatttgttttattattagactatgtttaatactttaaatatgcattcgtatatcctatatgacacgctaaaactttacatcggatttaaacacagcctgaatcaacagatggcctatgcatgcagcaatcaatcatgcagttttgtatatatattcttaattattccgtacaattgagcaatgtgcatgcccggaattgcatgcagtgtacagccagctaaatcctaaaaacgtttaattttgtgtgtacggcatcgaggactggttcacttaatcaaaagaactaattaattggttctgaagagactattatgccatcgatcagctagctggcatgtgatatatatatataattaattgcattaacaccttcacttgcaatagaagttagtcgtgatgcagttcgacaggatcaggtgcatgcatatgtcagtcaggtcagcctgacggaattcagttcaacggggggattgagttgttgaaagatgatgaacaacgctgaaggatcgtatccggcgttacctacgcctgatggaccataatcttttcatttatatttatacttatacttataagctataattcgaatctttaaagctaaatttaaagttgattttaaatgttttttcattatagtttatttttttaacctttgcttttagatcgctaagaacacatataaaagttttattaagaaatcatttttcatttgtaaataagccaaacgatggagtctttagtgtactaaaatttgaattttacccttattaatttcaaagttaactttgtagttttagtttattttataacatttatttttttattgctaaggacacgtgtaaaaaattttacccataaattattttttggttactaataaatgatatataagtataaatgatgtggtactaatgtatggctgcatgtgcctaaggtctgtttgggccaccgaattgaggattgttgtcgagtcaaattatttagggaaatcaaaagcttttgcacaggtaggacaattggtctgctatcacgaatgttcttcgcttggatcattgtggaaacaaaatctttagggtggataacctagccatctaggttggtcccatctcagcttgttgatcgtatagggctacagttccaaattggcaaatcctgtcgcaatttccaggggatccaatccctttcatacagtgtttggagagctaatgacagtatgaaggaaaaggatcaaataaactttgttggaaaaacggtacggcgccgtatttctagacagggctagtgtgaattttgggagctagggtttttgtttgcaagtgttgtgtacaatgcaaaatggacattttatccaaattggtaattaaactattagtatgtgagtcgttggtctgtgtatgacaatataaaccagggtttgaactaatgtactaatggtcttggtaaacctaaatatgtacgtgtgtggtcttggacaagatatatatatatatatatatatatatatatgtgtgtgtgtgtgtgtatgtgtaagcggtcagaagaaaagtcaaatgagtatttgagactgagcaacatggttacgacttggataacactataaaaaacgatttagtacaccgttaaagacgaacaataattggtcgcatatgtaaaaatcgacctctattttcacacctatatacaaaaatctatttttgaaggcgagcatcttaagaggccgcatataaaattgagcttattttcacgggcagtcgtcttaagggactgtatacaaaaatatattttcgcatacgggccttaagtggtccgcatgcgaaaatacccccctcttctccacagttttttctcccctcccctcatgatattttcctcaccttcctctctttatctcctctcctctcctctcctttaagtgggagctggcggcggtgggcagcggcgccaatgaggaggtggccgggagcggacggtgggcggtgcccccgccgccggcgccatccccgtccccacctggcgccagcgacgaggaggcgggcggctctatccctagcaccatcgctgcagacgacggcgaggcagctcgctgtaaaaaccggatcctcgccgccgcctccattagaagctagggtttcaatttttctttttttgagatttttattttttatgcggccgacataagcactcacatgcaaaaacaacgattttccatgtggtttcgccacccgtatacgaaccacacaaaaaaaataggtttttgtcgcatggaaaaaaaagcttttttatatagtgtaaagagggtaattatagggttcagcaagatactgataaatatttaatcactcttgaaaacaagcctatttgaatagagccagaattgaggcggataggaacaatgccttaattataagggagaaattgaatgcatctgtttttattccagaatctctaatagtctactccacataagggttaacttggagataatatggctagagtgtcaacttataagctgactttcaccaaaccaagggaagggagaaattgaatacattttttttactccacagaaggttgtactctacacaggtagcccaatgagctctgcccttccccgatgctcacctctcttcctctccccatcccctccctctctatacgctttgacggcgacatgatggctgtagctgcgtgcaggcttgtcttgctctgctccggtggagagaggaggcctcgtcggcggccgagacgagagggacaagaaggaaattaaaatggaggaaggaggtggatgggaccatgaactgtggctcaggaaaaaggagtggaggtgcgtgttcccctccagggggtcacgcctccctccaaggatgctgctcggggacgggagatcgacggtgtgagtgaaggcatgagccagggctacctgttgtacatggcctaacagttagacagttcttgggctagcccatacagagtgaagcctctatcaccaatgtgttggccctcattgtgagtaaaacctacatgctcactaaattcaaatgctccccaaaagaacaaggtctaaacaaaaaagcaaaaatgttaatattctttggtaagatctgttaagtatgtaggaaagaaatctatagctagtctgtatattcttccaaggatatgcacatcatgtcatttttttttacagttgcaacgtaaacacaatttgctagttatataaaaaatacattagttctatgaatttatggctattatttgtctatcattgaaggcctcatgcataatcgataatttaggaaacatatataatcctatatacctgtacaaatcatccccactactacaattctctgcttcctggtgcttccatgtcaccctttttatccccaccgttggataagcatcgagcgcttccttccatccgcatcgctcctctcctcccctctcccgcatcgctactcgccggccccacctcctctcccgcatcgctcccctcctctcctctcccgcatcgcgctgctccgccggcccacacgcatcgactcccctctcttgcatcgctcctcccctctctcgcatctcacgccgccgcacccccccccgcatccccgccgcaccgcatccacgccacatcccgcttcgcctcctcctcttgcgccactctacaccacggttccgcttcacctccccttctatgccttgccacgtcgcacgcgaggtccgcttccccccttcccccctcagcgccacccagccctcgcttctgcgacccacaccgccccaacgacagttgcctctccttctcccgcgccgttccgattccatatccgagagaagcgaaacgaccgccgcccactaaaaccagacttcatcagcgtcatcaagacattaattttgtttgctcataatgccatggcgatatcgttgcggcccttcgcttatattgccaatgaaattctgcaatctacctccaccaactgcttcgtttcatctgaatctccattgcataggtacatattattggatttattcggagtacaatgatcttctgataggttttttcatcagtttgaatctttcatgtctacagaagggcatttgtttatgtggtaccgacggccttccttttgaatttgttctgtggctcctgtggattttcattcaggaaagataaatctggtacgtgccttttctcccttatgctttcacccggcttttgtttctttctactcttgatgatgaatgctcaatttgacctattatctttttgtaagttcaacaattgtttacaagataagttcagtttgattttattcggttatagacacctatttatttcgacttataggattcgttggtttatgctctcgggtagaatggataatacgataggttcttctcaaccaattatacgtcgtcgtggtcgaccacgccggcagccttctaatatcccgatcccacatcctaatcaaactgttgctgctgaatctcgacgtaggcgtaggcaagttatcgatgcaaataggaacagaggtttgttagaagattaacattcctacaagttgtcagtattttatgcagacaaaaaaaatgactcacattatcaatttcatcatttttccctagcatcaacctctgcagatcaacgaatattatgcccacggttaattggtgaatcttctaattctaatcatatagcacaaaatgaaccccctattcatattggttcatctacatccaatcaatcattcaatcacaggcgtaagttgtcttttctactcctaggatctaaccactttaaggtatccatttgctgtaaagattccttcacatataccatgacacacctttcaggcactatatttgaaccattgaatcttggtggtccacatcattcttgcagccactgtggtgcttttttttggtatgaggagtgaacacgtagagagagacatacttcaaatccatcaaataatttgtgttgcaaaggtgggagaatatggctgccaccctatcaacctcctccacagccattgttggatttattgacctcacaaaacagcactctttctaaccacttctttgatcatattcggcaatacaatagcatgtttgtaattacttcaatgggagctaaaattaatgagtccataaatgatggaagagcaccatatgttttcaaaattagtggtcaagtctgtcatcgaattggttctctgctcccaccacaaggtcatcgtccagaatatgcgcaattatatatttttgatacagaacatgagatctcaaaccggatcaatgttgcttcatcttcccgtgtcactttccatgctaatgaacaaattgttgcatccttgatagaaatgttgaatacaaataatcccattgttcaactattcagaacagcacatgaaagaatatccctagacgcatctgatcagttttgcataaggttatttggtaagctggatgcaaatggagatatttatagtgctccagtcgcttctgaagttgttggcctgattgttggtgatgttggatcagctgatgtagggcgagatattataatccaagatcgtgcatcacgtttgcagcgaatcaatgaaaatcactgcaagtttatggccatgcaatatccacttttgttcccatatggagaggatggttatcatgaaaacctcacatatcgtacaacagcatgcactcaatccatgcaacagaataaagttacaatgctagagtgctatgcatataggttgcatgataggccaggagacttcaatacaccgttacggtgtaaaagggtaacacaatcttatgaagtagattcttattgttgtgtcgaggggagccggatagcacattattgcacaccagccttccaaagtaaatatagatcatcaccattcaactcattgattaattctgtctcaagaggtattacatctggatcttctgttgggcaaaggataatattgccagcttcatttaccggaggacctcggtatttgtatcaaaattatcaagattctattgctatttgtagaaaatatggttgtcctgatctttttttgacattcacatcgaattctgcttagcctgaaattagagaagctttagcatcaattcctggccaacaattagcctgaaattagagaagctttagcatcaattcctggccaacaaccttccgatcgtcctgatattgtcaatagggttttcaaaatgaagctcaatattttaatggatgatataaagaagcacaatttttttggccctataaatgcaggtatcaaattttacattggtttccaaaagataaattttcctttctcttccttttgtagggttaaacatgcatgttaccaccatgcaacccttaaaacatatctttttaatgcagttatctatacaatcgaatttcagaaacgtggtttacctcatgttcacatcatcatatggttggccaaaacagaacccttagattccaagaagattgatcattatatttcagctcaattaccagatcctgcaattgaccaaataggatttgaggctgtatcttcttttatagtgcatggaccttgcggtcctcacaacacttcttcaatctgcatgtctgattgagccctgaaaaattattgtgcaacaattgatatggctagtattaagtatagcaaagaagtagaatctagtattaatatttggtggaacacataagagaatgacatacatgttcatccaataggatgccgtcaatgctgatgaggggatctgcagattttgatctcatgtttatagcatcccataatcttattagacgtccaaaaaccttgcagttttgctggccaacagatatatctttcaatgatgtagctaggttagccattgaggtaaatatgaaaaaacataataaagaaaaaatgaaacttaagtgaatatatgtactgagcaaaatatggaaattgaagtatagtaaaacattatatttacaaaactaacaacgaaaccaacctatgcatcacaatataccttatcagttcctgtttctatttattaggttgaataccttggaatatactacattgtgtgtgcaatttttataagaagtagggctgttctctattagaactttcaaaccattaggtgaagtcactctcgagaatgcatcatataattgaccatgggagaacacaggtgaaggtagatagactccaactctgctcaaggtctgtccttggctcttatttattgtcatagcatatgaaagacgtattggaaattgtcgacgccgcaatttgaagggccacttggattgagttgatgttgtaacaatgcgaggaatatatgcttttgtacctttcgcttttcctgtgattatttctccctctatcacacggcttgttagttgtgtgacaatgagcctagtcccattgcagagtcctcttgatggatctagattacacaaaagcattataggaacaccaattttcaagtgcagcacatgttctggaattccatttatagaaattgtgtttagaaactctgttggatatagtgcctctatagcagtacagttagtagaactgtcatcaattgaatctgagctataatatgacatctcactcgcttctaactgagcaatcattctattgtttatttctgaaaccacctcatttgtaggtgctaaaattgcacgctcacacatatatgatgtaagatttgatggttgacatcgtaagttgtagacaaaagaaatcaatccatctagattcctacagtctggtgatagaagaagggactgaggcatctctatgaacatgttcgttagttgctctgggacatcaacaaaaggttctgtgccatttcctattttcaaaagccaattagaaaattttcttaactcttctctatcttatgcagaaatagatgcagaggtaagcctcatattttcagttaactcaagaagtatgtgttgattccacaaataagagttaacaatgcatgatctcaaaatctgttgctttgtagcattttggatgactggtagtgtctgcttgaaatctccaccaagaactactgttataccaccaaattgtttgtctaatgaatttgggtttgtttcagacaatatatctcatagagttcgatccaatgactcaaatcaatatttatgattaacaggagcttcatcccacacaatgagagatgtttttttggatcagttcagctaaatttgtatttttctttatactgcacattgaatttttagagatttccaataggattttgaaacgggaatgaggtgttctcccacctggaagcagcaaggatgcaattcccgatgatgcaacagctaatgctatctttccctggcttcttatagaattaagcaaagttgtccataagaatgtttttttggttcctccatatccataaacaaagaaaatccgtccttcattattgatggcagaattataaatagcattaaaaacttccttctggctgttattcaaacctgaaatagcttcatctatagtggatggcatgttataaacatcgtagctgagctcatctagtataagtctattctgtgctgaaacacttccaatatcatctggtagtggcaaactaaaatgggataagtcatagccagcatctcttagcagtttatctaacttaatgagaagaacagatctaacataaggattggtgcagctgttggcctaagaagtgttgcggggcattcgatatgatatatcttcgctcatatatgattcatgttcactgaaaagtcttgtaggatttgttacctcacaaaagagtaacattgtaacaaaaagttgtcacagttgggatggtaaggcccattgagctgcatctttcaaagcatttgaccactcttggtcatcaccaaggagacctaatgcttcacatgctgcccgaaatgtaggatattcatgacctgatatagttctgatttcagcaaaggatctagggcccttaacgatgtgcagtagcattcgcagatagtaagcttctccttgtgaagggtttacataagcaatgcagccaattctacgttgagaaccacgacgatcatcccaatatttgccttgattgtgccacgtccaatgttcagggaattctatatatgtaagttgcctagcacattgatgcaaaaagaaagacctatatctaccagtgccagaactacattctccagtttaaacatgacacaagaattcaacccctggaatctagaggattaaccataccaaagttcttttttgacttctgcccatttgatgaagtcctagggaaaaatatcagttccaaacctctcataggtaatgctatctttaattccacattgaatcatacttattacacttcacattcttttggcttattcctccagattttttttgaatgaatattcctccagatttgattggagtaatcaatcatattggtccgtatgattttgcgagaattaaaattcaaaacttagagtacgtaccttttccaaacctgatcgttaaaatcaatgctctcattaattacttttgtgtaatctcagcaattgtttatatgcaacatttttgcagggaacagactcaagatgtcctactctggggacaatatggagaatcattcaacgaagatgcaacactccataaatcaaaggatggaattgtaatagccatctttgttggccttactgcaggaaaattttcaggttcattctttcacccaaacaaatgccctctcatacaaagaatgcagaacatttcaacttcactttcacctgcagctataacagaagcatcttcaagctctgctactgaaatatatattgacctggacacacctcaagttagagagtttcgcactaggtaattctctttaacccattcaaaccatttgcacttgaatattcctgttcaatatgtattatatttcacgtcaaaaaatgccaacctatctctttgcaatttgaagctactaatgggaacgtccaactcttgagcaacaactccctaaggttatacgtttaaccccgatccaagcagcaggaaaaatgtacaccttaagtgagatatcagctatgcctatttctgcctttcaggtacaactcaatacaaaagaaaaaaaaactatattgttattaccatgccatggattcctttcgccaagatttaatactttttattacataagggtggagctacatacagtgctactgcaaaaataactgccatactgtcatcaattaaatggtattacataggatgccatcgttgtgataaagggtacaacaataattctgattcaccaagatgtgcttgcgaagtttcattccgcaaaccaatgtacaatctcctactcttatacattcattcgaagaactaaaatagtttactgtaacgctaaccactctagatgtatctaactaatgtacaatgcttcaggtacaaactccttgtcacgattacagataaatcagggagtttagatgcagtagcattttcttttgttgctgaagatttggtagagcttgatgcagcccaagcttcccaaaacatgaagatagacccggccgatcatccaacagcactcaataatgccattggtaaaacaaaaatttttgctatagggatgaatactgatacatcttctaagttccctatcagctatgtgcttaagaagagtttcacaattgagcctactatgtcggtccctatgctcacagatagagaggttagtaaatactactgttccatattacttcagatatcctgttccatattacttcaaatatttcaaactaattaaattaaaatataaaactaatcaagcctttgaagaacaaagaggtactacagcttccaccacctgcaccacatacagataacccaaggtttgttgttctatcaaatgttctattcattacatttgtacaacaccataatttttttagataaaggattttcattaaaacccagcctctacatcacattggatatatagtactaactgctgatgccaaataaatttcagcacaactattcataatacaggagcatcaagcaaaagtacacctcctgaaatatctttggctgataaaactccaactgaaaaaaccaggtaaatatacaaaaaaaattatgcttaataaaatcattcatatgattattatccattactgcagctcaaccagaaagagagccattgatttcactaaagactccattgaggaaaccagaaggtatattttataaccccatttatattgccttttctgattaacaaatatcaactcacaaccaaccttggaacatttttccttttacactaccaaaaaactagatctccctgttctcaaacattacaaagaagggcatgtactactttggaaaaaacatagaataacataactcaactataatactgactacaatatttttggaactatttcatgcagcaaaaaactacaacatacagagggaaaagctgattttcctgaagactcctttgagggaaccaaaggttatacattattttataacaccacacatttcattatttttatattgatttttgtgatagataaatccactcatgacttacaatacttttgcctttaacactaactgcaatatcttatgaaccactccaaacagcatagagctacaaactgcattgcataccaatctgcctgaccaatctacataataaaaatggtacttattcttcacattcctaaagatttacttcattatcttacaagcacatccctgttgtactactaatatattctccaacacaaaatacaggtgaacacatgctgtctgacctacggtgatttcactatggggaagacttattatattttccttccatatgaagacttcattatgtcatatgcataagacttgctatattttattagggtcccattctgttctccatcttgcagctatagcattatctgtactacaattctataatatcagtactcctcgattacaaaaacatataagagatttcccatattttcagaatgtgtttgttcatattatcacccttttcgaaattacatagttcggtattactttttgcactcatatcccgtagcaacgcgcggggtatcttctagttatgaagtgttttttgctatgatgtatcaattgaaggacaaactatttttatgaaataaaagaaggcctgaatagtaggatggaacacagtaaaatgcctcattttcacccacaaggacatatcgggttctgaactgaaacatagtgtgatctctaagcagtgttgtgatggaaacaatagactataccagctatagcaacaaaaaccctacagtcacttgatgtacacaggaggttcaacgtccgatggaatggttactgacagggcctgattttagcacgatctctaacatttatatatatatatatatatatatatatatatatatatatatatatatatatatatatatatatatatatatacactagaatttatgttcaagaaggaggcagcaagcattatccatgggtatctctcaaatatcaaaaagcagaataaatattactgaaaagctaaccaattgaactactattggacttatatttccttgagcacatggcactcttcttctgaattatgtaaaaacaaaggaaaaaaatattctgccaatgagatgaaatataaccccacacaaaaggttcaatgtcttgccccttgatcttcctttaaaatggagtcttaagttcttcgttatggcaaaagatggtaccttaagttgtagaagtaaatgttaagggctaaaaacaatgactcagtccttgtccagttcatgttgattgccgagtatttatacatatggaccatatatatggtcattgacagagagtaaccaacactgcctgaattccatgttatttggtgattcttatgggaatggcagaaggagaaagtgaggaacagagtacctttttaattcacttcttttacctctctgccttcctttctcgattgaaatagacataggaggtatcagagaacatgttctgccggcagggacaatgtcaggatcagcgattgcttcgcttcatgcatgattcgcttcagtcttctcttggcatgtcagtatgactagtcctgacttaggctccgcgctgtttcagaagacggcaaaaccagattgagcaatccttgttagctttggccaaggatgcaaagaactcgcggagcagcaaacttacgcgagcagcgaactcaagcgatggcacacacgcacaagtggcaaattgtagtggacacgacaatggcgacgcacgcgcactcagcttttctctctatggctcaatggagataaacacaaagaagtgcacacacacaggtttttgtagcaattaacaaatgactgaaaccttttctctgttattacaaactgatgattacacggcttatgtagccttgcagacatgcatacacagctaacagcccggctgggtcgcccgcacgaccatgcatgagccactcattcatccgatcggcgcgtctcacgcgcaagaatcgctcctctgagctgactgaaccacgccacaacgtgctccactaatcttgcatgcaactatctaacttgccactaagacccggtttaaatgggactaaaacttttaagtccctgtcacatcggatgtttggacactaattataaatattaaacgtagactattaataaaacccatccataatcttggactaattcgcgagacgaattattgagtctaattaatccatgattagcctatgtgatgctaggctaatcatggattaattaggcttaaaaaatttgtctcgcaaattacctttcatttatataattagttttgtaagtagtctatatttaatgctctaaattagtgtctaaatacagagactaaagttaagtccgtggatacaaacaccacctaatcctcttattccctagactttcagttgctagttgtgctgcaacacatataca

SEQ ID NO: 61249 - DNA, 12345 bp, Oryza sativa
agagttcctatggattcattcactgtagcagcctttgatttgtaggaattggtcataggaaaactgaaggaaatattccttcgttgctgattctatgggagaaacacaggaaacttcctatctagtctgagctcatttttcacttgctttgcgtaggatcgaggcaatcaagctcctaatctctttcttcagagcaggagaacaagcaatgaatggataaaatttgtgttggatgcagtgtatttattagaaatggaaaatgggcctaagttcttaagtaaatatttctgtgtttttcctatacccaattcaaacgcattgtttacattcctctattttacacgtgaattcctattctatttttgtgttttttctattcctgtattttttcaatccaatgtttcaaagagaccctaaattaattaacagatggattctccagactaattaagcttctcctcaacgaaatatacaaattcactagggtggaatttagtatatctgggcctttcgtgttaactagattaaaggtcaaattacactagtccatttttgttaacaacctccttcactgaattcaaaacaatgatagttctcaatacaacttggaagtgtttaggcctgtttggggagtttctaatagctgcagcttctcctagaatctccagttgccagaagctcccccaaacagttcaagtttttactcagattctgagaatctgtagttgtaaaatctggaaaatgaactagaagtcacctaacttctcagtagctacttctcagaatcttaagttctcccaaacaggccttttagctaggacgaggtagaataaaggtgtggatacaagctactaaaaagagactagagtgttctgaaagctccagtagaggaactagcaagagaggaagatcgacgaggttcagactgaaccaggtcaccactacccactgctgccgtggccgaagccgccgatgcttgtttgattcgttcgatgccttccaatcaacgttgctgctattttttatctcccttcaaggatttttgggccgggcttggaatatggctaacatagcccatgtgtggttcaattgagtttctaacaatcctctctttttaaaatttggcttgtccacaagccgatgcaaataattgccaatgccatcaggatcccatgctatttgaagttatttggtagaagtagtgaacctgtcatcagtaataagattcaaagtctagggcatcattgcatggagtagattcactgcactatttctcttcttgtagtcactcagaccctctgtaataccccgtatattaaaagatattttgaatttttttagtttgggttgacttgttaaaatagagatgttaacataaataaataaaagaaaaatatctttagaagtgggccaacatgagaaggcccataaacccaacccattagttctctcctacaacctagagagaggggaaccgaatcccacctcccctcttggtgccaccatccctctccttggccggcctccaaggacgcctccttcctcccctcctcctatgtttgcatctctcccctctacagcaaattgccctcatagatctccaacctaagaacctggatcaagaagcgaagtgtaaaaacggaacgaggagaatagatctccagcccaagaacctggatcaagaagtgaagtgtaaaaacggaacgaggagaaggagaggagtaggaggggttagatcagagtctcccctattgtctcctcacaagttctctaacgaaaccctaggtgaggcttttctccttgttgtatagttgttctagcatggctttagtgttttaatttgtggttagagaaggctagagaaggagtttgggttgttgcagtttggtttgttacagttctgcatgtgggcagatttgcagtgcttcagttttttgatgtttcggggctctaaatgttatttcctgcaaaagtgtataactagaaagttgtagataatatttggatttatcttctaaccaaagggcgcgattttatctcaagtggtttaggagatataatatttttagtatgactattgtttttatgtcataatctggatagtagtagattgaactgtttatggaggggttaaacagcaaaatcagtcaggctgcctatagacaaagctgtagagttttccccaagctttccatattggtaaaatacacttttatcggatgattagaactccagatatagtttgttttgtatgtaccctctgaaattttggacagattctgaagcttgctttcaagcgcaaattagaccatttaaatggcagaataaaaatatgctttctacataaaagttgtaggtattgttccgtagattttcaaaatgtatatattttcagtcatagtcttttcatatttcaagatataaaggtttaaagcagcaatcttgtgtacagtccaagcggcgttccttgtattgcgttttaacgggatggggcagtaggttcacctttttattgttttatatgcatgtttgaatgtgtttgcttaggttttgtttgtgattaggttgtgatccttcagatcgtgtatgataccaacccttcattggaggtaagtgcatgacgaactaattgtgtgattcttggagtgattgctctatctatttattttcattatatttatgtgtgatatgtgattacatatgttcagattgttcatgctatttagatttcgagttcatcttatgtttacgatgttattcttgtttgatagtccggattctggttctgattaaataattcaagttccatgtttgccatggatgtgtaatatggtttcaatttggttctttgtttccggtttcaattattcatgtttcatgcgagccatgtgctatctagttttgtattcatgttcatgtgggtaagcgctgatcacgcttacttggctttgtcggcaaatgctaggatgtattcactattgtccgggatggaaactactatttcaattcatgcctacccgggatgggaactactatcttctttgacttggtgtttgaaaatgtgtttcctatcaaagaaagaaagcattctgttcatgctttattgccaatgatgtgtatatgtgttttctagtttcatattgtacttgctgagtatttttatactcactcttgtgttttatttggttttaggtacgcattgagaccgacatgcatgggcgggaagtagctcccttatatatacatttatctgcacactatcaacctatattgcctaggtccataatgacacttaaactatatcatggtccagtcttataataatcttttagatatcttttagtttctttccatggattatatgcaaagttttaaatctccggctaagcctcttagctgctgaccttctcaacagctaagcacagctatagctggagatagctgcagctaagccatttagctgtttttgcaaataaataaataaataaaagacatgatcttggcataacttcataaccattaccaattgatacataaccagttcaaatgagtacattacaagttcataggagtacattacatcacaggctaagtggttaacagaatactgaaacatcagtttcacaaaagtacagcattctggaataaagacaacagtacaacacaaaggtcatcaagaattctggatagtggatactaaattactaatatgaggcaatattgcaatcttcatttcttctagtcatcaatcatcggtctaagagacaaagggagagggagagggtgacttatcagaatcagaagtctgcattggaataccatcatcacaatcttctgagtcggatgatggagcttcaggatgcactggggcattgcgcatcaaagactgtaggcttctgactttcctcttcttagcgtgcacaggccttttccttttagctggtgctggtgcttgtggtgttgtgtgctgctgtgactcttttgcacattgttgatccatttcacttgatgaaggcacaacaccagtaatgaattcattgtcaccatctgccacaacatcatccacttccttctctataggatctctacccttgttctctctcttatttcttaacttggagttaaatttaacaaacaccagatctcgcatcctttcatgaagtagcctgttgcgcttctttgtatgaacctataagccaagtagtgaacacaacgctgcaggtcagatctaaattccataaataagcattataattcaaaatagacagcatgcacataaagctacaggtcacaaatttctttttacctgttcaaaaactgaccagttcctctcacaagctgaggagctgcaggtcaaactcaaaatccttgcagccaacttcctaagatttggtgtgcttgtgccatggttcagccaccattttgctgcataaacattacacaaattacaacaaaaatgatattcagcaataaaattaagttcacatgttgagatctgaacctggattgaaatttttgttctttcgctgccttacggcaatttcgtgtccaaaactcccatgctgatcttgatacaagttgagttcttcaattattttgtcttggatatcttcatcatcaatcaacttgtcaatacaggaaatcacacctgctctaaatgatccatcactctcgatctcttgcttatttgggaagtagtagtaggggttcaaatagtacccagccaggtgtagtggagccttgatcttgttgtcccatcttttatcaatgatatcccaaacttctatgaagcggctcttatcattatcgaatctctgagaaatttctttcttcgcctcaagcattaaaccatggaagaatcccattgatggtacatcgctgtccattcttctcaacacgttagccaatggctcaaagtaattaactgcaatgtcaacatttttccaaaaggtttcagatctgatcactttgctggctttcttccccttggcctgcttcaagtaacccaattgctccatctcatctgatttaaatagtcttactaactcttttttgttgtctaacaagctttttagattcaaataagctgtggcaaatcgtgtaaccccagagcgaaccaagtctctgttaagaaactttctcatcaaatccaacaccctagtatgagcatacaagaaaacagtcacttgtcttgcattagcaatggtttcctcaactggtccaagcttcccaatatcctcgagcatgagatccaagcaatgagcagcatatccattccaaaatattgatggtctttttgctgtcaatagacttgctgcagttgtgttgacgctagcattatcagtcaccacttggacaacatgttgttcccctatctcttctatgtacctgtccacaagttcaaagatatatttgccatctttcctgtcacctgagcattccactgaatctaagaagagtaccccatgagcactatgcacaactaaattcatcactcccctacccttcctatctgtccatgcatctgtcatgatagaacaacctgtgagctcccatgattccttgtgctccttgaatccatccatcaccttttccttccttttctgtaagaacgatccactcatctcatagggactaggccctttcagacttctaccaaattgtccaatggcctctaacatatgagcaaagctaggaagggttactgtgttgtgtggaatactagcttcatagaaccattgacatatgtactcacaagttctattcctcctctcttctcttttctgagttgtcaatgctgtttgaaccttattgcttagcttaattactctttgtgtcatactggcagattcttctatagaaggaggcttgtagtacttgtcaatagtatgaccacctgctacagatctagagctactagatcctgttgtctcctttggcttcaccacaagaacattattgccatgatctgaaccttcactgccactttcacaatctgaattttctatgtcaacttcagctctggccacttccttttctttgtttttctgttccttttcactagtcttcttggtaagcaaatcaaacatctcttgctgcactggacttggaactttctgacacttagtagtattgaaacctttaattccagcaagatggtacttaattcttgtaattccagcagtgcagaccttgtcacaatacttgcaccgtaggtgatgtttcttggttatgtctgggcagaaacagtgagcccatgcaggatcatctgagttgataccagcttgttttggtccagcttctactgagacagaggcagcactggacggattacctatacaaaaagcaaacttagcccacattaatgctagcgtcaaagctgcctaagcatcaaaataatgcaaactgatatagcacgtattatcattaccacctaaacaggcgaaacaagcaaacgagagatctcagggagtaagaaaataattcacatatagtaagatctacatcataaggcaagtatctgaaattagaggtaacaaatatggacaacttgttcacatattgtaagatctgcaacatacaagcaaaaaagagaggaggatgtgagaactgaccggattgttgtgccatgccgtcacctttggtgctgctgcttcagtgcttcggagacgttgcactgacggacctcctcgtcggacttgcgccgctgctcagctgccttcaaagccgccgccgctggttggacgcccgcttgaagcagcagccggcgccggtcgcctccacgagccgcttgcgttggtcgatccgcttgaagccaccgccgccgccggacgcctctgcgccactgccgccggccgcctccacttgtcttgcagctggagagtgagcgcttcgaagttggaatggatagtgtgctgctgggagcttacgagctagggtttgcagcactttacccacctctcgactctggtctagttgggccggtttcctcttgggccagaccggccgcgttttacaatttagctacgctaaattacggccagtttagcggctattgccggctaaattgcgctattagcgtcccgctattcttagcgctaaaaactgcatctcttagctccgtccgttcccagcagctatctccggctatagcggcagctatagccggagatttaaaactttgattatatggatggatagcgctatgggaatgatgttattattagtttaatctataattgcatgtcgtggatgttcgtatttataagagagactctttcaaaatttttaatgagtttaggacttagtggtttctgtaccgtagtgtgtagcattctaggggcctgtttggtagggctccaactacaaactcctagctctgaactccaactccagttggagctagcccctattggagctggaggtacccctgaaagtgataattaccttggggaggatggggaaagatatttatatcggttcgcaatgcattaaataacacggttgtgtcatgcattgatccaggttgtccaatagatgcatagataaatctcatatcatgatcacaaatagccatcacattttgagtggttgatttagatctaccaatatatctgatcttctcttcatctggaacaactgcaaggatatgagtaccatcaactgtcccaatgcaatctttgaaatgtggccacatacgacgatccttcctaattctatcatggacagtaggaaagtttggatcctttggatgcacaatatcatgtcccaactccacaacagcaaacaatacttcttcaaattttcttgatattgtctcaccagaatgcttaaaacgattttgtgccctttggtttgatgaaccgtcacctagaatgtacagaaaaattgcaagtgcctccattgtgtgcatgtgtacagtaggtgccctttgcagcaaattgctcaataacttcgtcatacctagaattggataaatgggtatttggacgattacccacaactacttgatcagcaaaaatctcacacacaactctagtgttgtagtcattccaatcaacagagtcaattggcattttaacactcttcgatagcacattttgagccatgcctgccatccattcacaccatagtttcaaaaatttaggtcaatgttcagaattactagtatagtttcacataatatgttcaagccaggttatactacatttatacaccaagaacttttggccaaattatatatgaatgaaccctgaagtggacaccttttttcccttagtacaattatatgcatcaatctgaaagtcatagaaccaaggaacagcttgtaataaatcaagcatacaaaccaatataggtacctacattatcctctcacactgcaagagaaatatagaacatatgaacatatttatccagtagatcagagtctacaagtccatgtaacacaagattgagcggttacgaagcaatcatcaacccaaaagataaatccatctcacaaaaattatgcataaaactgtctcacagaaaacatgcataaatccatctcacagaaaacatgcacatttgaaggaaaggtttggaaaggatttctagggtttgaggaggggataccgtgtggggctgaggtgtcaggactcagcctggaaatgagatgcaacaaactgaaactctgaatactctgaactttttgaatgtttgagttatctgaagatttgaggaggagatgtagactttcgggaggattatgaagatccaacaacaaacaaaccaagcgaagcgatatcacgaaatcctagccattaatcgatgtcggggaccactgttctggtcattcttttgtctttttcctacttttgagctgtctgatgcttgagagctaagactacctcactttgtataaaaacgaattgcatctgagaatgaaagagatatcaaaactcgcaattatcttatcttaggaagtaatctagatttaggaaccctagtttaggtccttgcggcgcacaccaaatacgttttattctctaaaattgggttccatttctagtaaaatctgtctccgatcttgacaaaggtatcagagctcagctctttccctggctctcaaatttggaaggcgcaggttggtggcgatctgtggatttgctgccgtaaaatcccgacgccggaagaattcgatctggaggcgaagaagggtctcgatctttggagaagggttggcaggaggctgtaaaatccccggatccaaatcctcgagacgggcggcggtagaccagttctatgaggcaatacagggagggagaaatcctgagctgtcctcacagatcgaaggaaactttatgtatggtaaacaagactcgatcgcacgggtcgctggtaggtatggaggagatgaacgaagtgaggttggagctggctgggatgaaggacattgctgatctgaagaatctcaagtcagaggtaagggaggtcaagaaattgttgcaggaactttgcaagcagaagggaactgatgcagggaattcagagacagaaggaggcactgttggtggaaatcctgaagcaagtgcaggtgatgctgcaggaaccagtgaactgtgagatagaggtatacccaggtccaccttcaccacttctgccgtgtttgagatagtacctcccacttcttctgtgccacagtggagccaatctataccctgttctatgcctgatccacagttggggcagcatttttctaccacacgtcccacagtgcccccacacatgtttccacagtttagtactgcaaaccatgagtcccaacaggtaaacaatcagtttttccatactaggatcccacagtttcagcctagagcagaaatgtatcatgaacagatgtaggggaaccatagagtaaggatgtttgatgagcagaggaatcagtatgtagggcaacatggagaagcaaatcattatgctgaagctatactaaaaggacccaggttggaaataccttttttcaatggtgatgaccctattgactggttgaagcagtgtgagaagttctttgagttgactggaactccaatagaccaatgggtcaatatgtctctagcacattttcagggaagagctgcaatgtggtttaggggagttggattaccttggcaagtcatatcttggccacaatggtgtgccatgatttgtacgcggttttctgcagctaatgttcatgaagcggtggagttattccaaaatgtcaagcaatatggaatgaccgtggagcagtatatagacaaatttgaggagtatgtggacttggtgaggagagatcacccttacctgcaagaacagtatatcacaagctgttttattgggggtcttagaaatgacattaagcatgatgtgtgtgggcagaagccacaggttttgcttgagtcttacaggtatgcgaaaacatatgagaaagctgctcttgctaagaaagctacttatggggttaacagaaatatgagtaaaggatttaatgctggagggcagggcagaaatcagactaacaggaatcagcccagaaatgaaggggaaagaaaggaggagaaaaactattggttctgtaaagaaccttggttgccaaaacatcaatgcaaagtaaaacaagcactacatgctttgttagttgaggggaatgaagaggaaggcaccactgaagaaactactgaacatgaatccaatgaggaagatgaagggaaaaaccaaactgatgataaaggaaaaactaaagaggtgatgtgtgtatcactgaatgctatccatggtacaactagacctgacactttttcagtgatgattcagattaatgggagtaaaatagttggtttaattgatagtgggagcaccagtactttcatggatctagatttgctattaagaaccactgtccattgataacttcagaagtcaaaagagtggtagtagcaggagggggtgagttgaaatcttaagttcaggttctagacatattgtatgagatatagggaaggcaattctgcaactctttcaacttaatttcactcaaggggtatgatatcatattaggagcagattggatttatcaacacagtcccataatacttgatctgaagcaaaggatgcttgaaattaccattggaaccaataaggtcattttacaggactttactaaacctggaaaacatctcctaattaacagcaaaaagatggagaaaacagtgagaaaaggggcagtgggatgtgtattccaactctgtgaagtcatagaggaagaagcagggccaatacctttggagattcaaaaggtcatttaccagttcccttaagtactgcaagaaccaaagggactaccacctaacaggccttgtggtcatgtcatcactttgaaggctggtgccataccaccaaatttgagaccatacagagtccctcattaccaaaaataagctatggaaaatatcatcacagagctggtggaatctaaagagatacatgagagtgatagtccatatgcctcacctgctgtaatggttaggaagaaggatggctcttggagattgggtgttgattatagagaattaaactcccaaacagtcaagaacaaatttccaatgccaatcattgaagatctgttggatgaacttcatggtgctaaaatattttcaaaactttgacttaaggtcggggtatcatcaaattaggatgaatgagaaagatgtgcacaaaactgctttcaggacgcatatgggacactatgaatatcaagttatgccttttgggttaactaatgcccctgcaacctttcaatctcttatgaaccaagtactccggccatttttgaggaaatttgtgctcgtgttcttcgatgacattctaatttacagtcagaaccaggaagaacaccttgaacacttgaaattggtgatgcaagtgttggaagaaaataacctagtaatcaggttgaagaagtgtgcttttggactgtctgaagtagcttatctagtacatattatttcaaagaaaggggtggctacagatcccaggaaggtggataaaattacagggtggtctattcctactgatgtcactgaactcagaaagtttttggggatgacagggtactataggaggtttattaaaggctatgggttgatttgtaggccaatgcatgatatgctcaagaaacagggacttcagtggggacctgagcaaactgctgcttttaatgagctgaagaacaagatggtgtccagtccagttctggctatgcctgactttaataaggagtttgttatcgaagctgatgcttgtggcacaggcataggagctgtg

SEQ ID NO: 61250 - DNA, 6228 bp, Oryza sativa
tgtgatgtttttcagttactggagtatgaacactgacaactcaaactttatgagtgtgcataaatgcattcgatgacatgcacggaccatcatagctagagaccgaactgaattatttgtcttactgtctgactgaggctgtgtttagatccaaagtttggatccaaacttcagtcctttttcatcacatcaacatgtcatacacacacaacttttcagtcacatcatctccaatttcaaccaaaatccaaactttgcactgaactaaacacagcctgactcataaagtagagtatatttgtaagagaggagcacatatctagctagtatgttattttgcatgtgttttgccacaagaccatactggatcactgaatctgaaaaaatgaaataatgaggttacctttttctatagcttcttgggtaaacgggcaaccagaaagaaatatctggcaacaaagttgaggggttttactcaagtacagaaggcgaacttgctcagcatgaaaggaaagaccggagtgatcctagatcaatgggaacagcagcggcatggggcgcgtctgctgcatcgcaagacgacatttccatcagacccaacaaccaagcaagcacatgctatgttgcgaggaattgaaagaaagactcaccccagagcgaggcctttggtgcgtgcagccatggcaagccggcaaatcgatcgcctattgcgaggaagatgacgagcaagttccccggtgattgcgtggatcatccagatgggctggctcttatgcagtgacaaagagtggaagacaagagatattgctgttaggtggtatgtccatttagcttttctgtatgtgtcccagtgtggatgtgaaaagaacagattccagtgtccacttagtctgaaacgataagaacatcttgacttgctgacttgtattgggcaaaatgcaagaaaggatttacggatggctgggctgatcaccactaacagtaacgctgtcaacttatctggttcagcttcaccaagatcaattgctcaccattcattgtctagaaaaatgatcgattctcaccattgggttgttttctggccttctgtccatcaccgtattctcctctgaactgactggtttgaacgttattttcacggttgttctatcttttcggaatgaaataatattaccttttttcaacttgtgcactcatgcacaattgcacacaacatattgctgcacttgtagtcctctcctctgccagcggaattgcagtccagccgcagctttctagccaagagatgttcagaactgcaattatatgcttcaacagattgaacatgaatatttgcctacatctacatgaatttggtcttgagtttaccctttcttgagttaaatatgcaagaacatcaaagagcaaccaacaatgtcgaaactaataaccgaatgagaagattcagatattcattattgtccattgatttaagatcaccaccttcctccttgggtgctactatttccaggttttgttggatcaacagtgcctttgttatataacatcatgcatatatattgtgcgattctgaccggctgattagtgattagtagcatttgtttgtagcgatgttattctttcatttgttggctcaaccagatccatgggtacttttatgttgaaaacatctacatagacgatgcttatgagcaatccagaaaacaaaaggtctattttgcattcggggaagtcatagtcaagtagcgtagcactgtgcccgtaaaaaatcagtccatgcacaattcacaggtttcgaaatcttagatagctatgaacacacattaagcatgtcaaaaatcaaatccatgggcacctaggttaaaaactttttaagaaaatattttttataaaaaaaatactttctcatgcgtgcagatgcagtaatactaatagaatccgtaagtaaaagtccgaactttcagatgcagacaagcagtgagtagcagtgactgaaacttgcatgtattattcatgttgtgtgttcaggcagagttggggatgctcgatcgtgcgcgcccgcacatggcggtccggccggcctcgcagcgaacatggcggtgtggtgggcaggggttcgccgtctcagacgaggaaagcgacggcggcgggcggccggcgacggcgagggcttggcgagcggccgccctggggagatcgtgggctgctacggccggatgcaacgtgcggcccatattgtatggcccatcaaggggattctctgtggaataagttcactttggttccctctatttgtcgcctagtctgattttcatcccttaattgcaaaagtgggtacgacaggtcccccaacttacgaaaccgtttaaataaggtccctcggtagtatttgacctcggttttggctgaggtggcgcctacgtggctaatttgactcggtcttcatctgacgtggcattgacgttgcgcttacgtggcaattcgatccaaaaattaataaaacctatgggacccacatgtcagtttcacacacacaataataaaaaaaaatggtggggcccacgtggaccccacctatcatcctcactaccccttctctctatcccctttctctctatcctctctctccttcttctctctatccctccctccctctctcccttgagaatggcgagcggcagcgagcggcgcagaggggcggcgatggagctgagaggcggcatgcagcacatgcagcatggcggcggcgtctgggacaatgcgcggttggtcggcggaggcggcgtgtcacgccccgaactagtaccgactggaactagcccgtgacgctccaaattaacctgttgatcgataccagtcccaggaaacagtgctggtatcacaaggagacagaatatcacagcaacagcggtctctttattatagagtagagatacggtcatgttggactacggacagaccccgagctcacaactgcattacaaaagggaaacggaagcaggacttggaccaaacaacacaggcgcgacttgggaactaggccgaaaccctaaaactcattgtagccggcttgctcctgaaagaacttctcatcagcaggatccgcttcatcttcttcagcaactggggggggaattatttatatagagcaagggtgagtacgggagtactcagcaagccaagggaaaataggtgtttaatgcaggcttcaaggagaggctgttgtttttgcaattgattttatttgaactcttttctaagaacgactaagtgagtgcttctcaaactacacggataagacagtgcgtctcgtccggtcggagtatgtgcgatgtatcagtctttagaattgaaacaaggttggcacccggccgacagcttttcaacggccactcgggccaacaacttttcaaacggccacccgggccaacaacttttccaaacggccacccgggcctagctgatcccttcagctacagatttttcaaacatcgaacccctttttcacaacagcaatttcacaagcagtagtcaaacaaaactacgctaggaatcacctcacatccgcccatgaccgtgggcacggctgttcgaatagtttgataacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacctatgtggtcgtacttgtcttatgttcggatgaaattccaaggaaacgatccttaagtgcaagagcgggaaaaccgtacacccggtacgttccccggttcgcggttttggaaattcatttagttcgcaagcaccgacccaggtgtcgggttttccaagtcttttgtaaaactccagttttacccaaattgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccgatctgccttgcagacgggacaacagattaagtgcgatcctatcaatgcataatattttgcaagcaatataattgaatttcaaatataggctcaagatgttcaaaggtggcttgccttgctcgagatctggagcttgatcctcgaaatcctcgcgctgcgggtcttcgggctccgaaactacacgcgaaacgggacaactcagcaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggatggaaaatagacttccctcgggcggctagggcgtggcccgagagaaagggcggctcggccgggcttaacgggccggccggcccaagaaggcggcccagagcggcccaagacgcgcgcgcgcgggagggaggagagagagagccggtggaccgggctcaccacgcccggtcccgggtgggacccgcttgtcagcggctcggctcaccgtgcggagggagcacgcggcgcggcgctagggtgggggagggacgcggtgcacgcgcgcggttcacggtggatgcggatgcggcgggcccacgcgcagcctcacggctcgcggtggaacgcgcgcacgaggaggggctgaccggggtcggctcgacccggtcttggctgagctggcgcctacgtggctgccacgcgagccggcgggaggtagacgacgacgccggccggaacggacggcggacgacagcggcgagcggcggagcgaaccacggcgatacaggcgaaagcgagcacaccggatggttgaacaggacaaggggagacgagccaacggctcggattcgccggaggatgcccgacggcggcgaattgcggcggcggcatccggcggcggaaaaagggggaaacggcgacgaggtcacgaggggccgattcccggcggcgagagcatctacgcggccacgggaatccgatgctagcgtcgaattgggcggagctacgccgagcgaggccggcgacgagcggcgcttccgagctcgggcggcgacggcggcgagcacccggcgagaggcggcaacggccggggcggcgccggctagctacggggaggctactcgtgctactaccgaaaactaagagggagaggtggagcgaggaggaagaacggagggagcactaccgcgatgaggaggggcgctgtgacgagaggccgacggcgcgggagtaatctctccggcctcgggccggggaagaggaagaagagggcgcgcccggagtccccttccgcgtccttgctcgtgccggctcctccgacacgcgcaacgacgaacggcgatggcgaacagagcacgggggcggcggcaatggcgcggaggcgatggaaggagaagagagggagggcgcccggggctttaagggcggcaatgtcggtttggaaaccgactttgggcggtcaaggcgcgagctggcgctcggcgctcgcgtccaaatcggcgacagggcggagggaggaggatgacgccagcggtgacggaaaaaggggaaaagagggagagaaaaaggggcttgcctccttgccgcttttggaaaaggaggaggggagcgggggcgtcgcggcagagggaggaggggctctgcctccgtcccttggtggcttgcgcgcggaggcggggccgaggcgatgacgacggcgatgacggcgggacggtttggagcggcgcgacgacacgggcgacaggcgcgggctggcgcggcagagggtgacggcggcggcgaccgggcggtcggccaccacgacacgcgcgcgcgggaagcaacgggcggcgcggcggtttgagaggcgcggctcgggcacgcgcgctggctag

SEQ ID NO: 61251 - DNA, 99043 bp, Oryza sativa
aacgtgaactaacggctgtatataaggagatgtacatatgtttgttgcacaatatgcatggccagaccggctagaagacacttattagacgctcataacccttggattccctttcatccctagaaaagaaaatccgtgttcccttctgttgctttttaagttgcttctgcttcatctatatatgtccaggatcccttcttgtctgtatatccaattttaagcatggttggcgctgccgtgccacctacataacgtgagttgaattgatctttctttctagaggtgaatttgctctgaaattttggtttgctcttcaatcatcatagtggccaataaatccaagttgctattatcccccccccccccaccaaaaataataatccaagttgctaattggaagcccacgtcaacatttaggctgagttcgttttcttcctttcacagcccacatgacccccggtgacctgtctaaaaaaaataaaaataaaaataaaaataataaaaaaacccacataaccacatccctcatttttcgcgcgtacgtttttaaaattgttaaacgacatgtttcttgtaaaaaatttctatacaagttgctttagaaaatcatattaatctattttaaaaaataaattagctaatacttaattaattatatgctaataagtcgttccgttttacgtgtttgatgtattagctcccaacaacagagaacgttgcttcttagcacacggaaaatggaacggctcattagcgcattattaattaagcattagctattttttaaaaaaagaatcaatatgatttttaaagcaactttcatatgaaaactttttgcaaaaaaatataacgtttagcagtttaaaaaacgtacgctaaacatgagggatgtgaattggaaaagttggagaaagaactaagccaagaatcacctcgagtgattgtacttgttgacggcgatatcccgtagtgccttggccaactaaccaccacaaccactaccactcgcggccggtcacgcacacaccacctcaatcaaatttggaattaagatattaaaatatgttactttaaacagaaaattaagtcatgaggcaatatgcacaaagtatagaatcgctaattcttacacagtttttttacaagggaacggtgctgtgagcaagtgagcaacatgccgacgtatataccgcaaaaatcactgttcatttcaacggaaaattgcagtaacagcaatgggtcgagtatgaagaaatcaaactatcaaagagcctctatataccattaataaaaagcctcatgacaccaacaaaatgacagtcgtcagccacatttctttctggggatttcacacctgcacttttgaagtagtacttgcgaatccacgtccttacgggccttatagtaccacgtcttctgaacagaatatgaacaaactgacgaatctgaagtccctgaacccgatcgagctgacgaaaacactaatcctgtttgtggatattcacattacaatatcggtgctactagctctaccatatggcttcctgtaccctgtacgtacctcttatgtgttatttacgatgttcgtatttttgtacattttcgtgtgtataatcgtatatagtatacatgcgaaagcaataaaccatccaggtggtgcaaaagactggccgcgcactgccttaatttagctaggatcggaggaggaggcgttcggcgggggtgagcgagtggcggaagtggcaacggtggccgtaggggcagacgtcgccggcgagcaccatgcggcacaccgcggtcttgtagcgagggtggcggatgacggggcggagctcggtgacgccgtgcgcgaactggcactggtcgccgtaggggcagtctcccgtctcctcccacttgttgcacagctccgtcttgaacatgccctggttgtacacctccagctccgcgccgctgtccgcgggttgcgccttctgctcgtcgcctttcttgccgccgtcgtacgcgcgctgctgcatgatttgatagtggtgcgcaacaatgtcaaatgccgatcaaacgggctgagccgtggtgttcgcgaggcgagagcgggggactcaccgagttcggggggttggttgggttcgacgacgtgcggggcttgcggttgggggccgccgaagtggcggtggcggcctgggattgctggttcagcttgaggtagcttgtggaccgcacggagatgctcttcggcagcacggcgagcttctcgggcgtgcgctccttggtggcggccgcgaccttctgctcgccgaggcggagccgacggatctcgtcggcgacggcgacggcggcggtatgcttcccgctgagcagcgcgagacggagggcgaggtcgctgttggtgacgcggagctcggcgttctcaagacggagcgccgccgcctcttcggcggcctcggcgaggtgggagaggcaaagctcgtagcggtcggccacctcctggtactgcagcgcgaggcgcgcgagctggagccgctgccccgtggcgtcggcggccgctcctccgtcgtcgccgtcatcgacgagggaggcggaggaggacggcgagagcgagacggaggtggctagcggcgacggcgaggagaacccgaagctggggctgaagggggaggagcagcggtacagggcgtcgtcgccgctggggaggtagcgcggcgaggacgcgagccgctggtctccgaagttgaacggcttgagctccaatgccgagcgcaccggggagacaagcgcttcctgcattgccgacggacaccaattgacttccgccgcgaacaaacggacggaaaatgtcacaaacgtgaaaaattttcacacaacttggtacgaacaagtgcacacgtgaaattcctagctgttgtatcgatcgagcttgtaatgttggacctgatcaagtggaggagtaattcgatgcaattacctctcggggcagtgccgatcgaagctagagaccagctgattcgggggagaggacgacggaggaggttggtgcggggatcgcgcgggctgagttatatagcgggggagcgtaaactgtagaaggggagaccgtggggcccgcgcgtctgcgagagcggggcggcaggtgtaacagggaattagccgcgcccgtacccgaagtccccaacacggccgggttcgttagcgctgctgcagcgtatagtagggaattccgtgagaccgtggctacctcaactgcccatcaaatctaacattgtaaacatttttgtctagggtttagactgttaaaatatttttttcaaaaaaggatatgcaaatatgaaatgtatagatgattgtgtcatgtattcatacatattctcctatcaagagaataaaaaaaatcaatcatggggatgtatctagacaatgtgcatgttcaaatacatcctaggattaaactttttttttggatggagggagtaaatttatagtaatgtcaaattcgatatgcacaaagaaacaaaaacatttatcactaaatttattgttttttccttcttttcaaatttttttcatgtgtgaattaagcttaatttttcatgttgatagagggatatacaacaagcgatttgtgcttttatattttttgaatttttataactatgtaaactgtatgttcaacctcaacctcaagctttgcttatctggcatggcggagagccgtttggtttttgctaaagcacatgcaatgcatgcttaatttgcagaaactacagtttagatttcagaaagatgtccggtgtatgtgtagaaaggcagagtagtgtgtctgtgtgtatgcggcgctcgtctagtattgtcctgttgtggaattcgacgcgcggaacattttcagatcaggatatttggtaccaattcccatctgattctggaaacgttaatcctgccaagatcacgtacgggaagtacgctctaacattaattccttcaactatacttcatcgattcccttgatgcggaccaacatgcctacctggctactattttcgtctcaaaataattgtatttccatgatttaaactttgtcccaaaataattgtaattttagagtactaattgccccatcaatcatctctcattcaaatttctctctattataccctcaaccatctttccactctcacataaacatcttttaatgaggagcaccatagtcttttttctcaaaccttaatatatgctaaacaatatagaattgtaattattttagggcggaggtagtacttttgtgtctcgtgtcgtcacgtcgacaaagatgacaagtccacacctcagttgactcaggaacgctctatcgtggcaactaatcgtactcctacaagcgaagtactcggtacaacggtacaaaaggccctcttccttgtacagttatatggagtaattagcggttacactgagctggtagatatgcgcccatattctttgcttacaaaaagccattattcagaaagccgttcacaaaagaaaaaaaaacagaaagccattaaacacgttcatatatatgattatatccacgcagggaaggtccatggaccaattgcagctacgtcggtggtcactagtggcacaagacagacagataagtgactatcagattagttattactacttgcttaacaactaatgaaccatggtgggaccaccctacacgaggagcccctgcaccggactgaggtgaggtgcgcctggcctctgtcactgacctggaagggctagtcaccagactcgatcaccacagcgcaaagaggatcgatccgagctagcgaaacttagcttgctttgcttttacgggtcagtccctgtccgcgagctcaggttgctcagctaacaaaccccgcgtcgatcggatcgatcgatcgatctgtatcccagcggcgtcttttccttaggaaaaccacaccacacctcaccagtcacaccacacacacagcaacacctgatagatgcaatcatgtgttgcttcctgcatacagctttaactaactcgaccgggaattcggaatatcgcctcgcctaccgcaggcaggagcgtcgtattgtgcggcacgtcggaatcattcctggagattggagaccggcaggcgtggccgggggagagagttagctagaggagaggaaacgagaaaaacgggaccatctatacatttgtcgacaaattttctactaaaaaatttgacagatgtaattatagtacaatcgtagtgtaattacactgtaacttgcatgtaactatagtataacttgtacgtaagtttcacataattttgaatcgttagatctattacaagatttgttctggtaaggaagaaaaaaatcacagcacacacatgtgaaaggatttgttcccacgacctctattttactgaaataacatgttaccgagagattcttgaaagttacatacaagttacattatagttacagtgtaattatatacaagttacagtgtaattacactacgattgtactgtaattacatctgacaaatttttggaggaaaatttgtcgactatagtaaattcgagaaaaacacttaagtatgtgggtgcgtgcgcgagatgcgtttcttttcttcccgctgccgcgacggccaaacgaaccgggtggacttttaggtgggtgcttttcccgtttggcgatgccggtaggatggatttgtgctcgccggttgccatcagggtttgttatgcactgtgcggtagatggcgacggttcgtgcgaatgaaggcatgcaccacgacgcgacggggctgatgtgccgcttggaccagaaatggatgctgatatgcgatctctggattctgttccattcgtcgtggatcccccaatccagttcgcccctccacccacccaagatatagattttacattgatttctattaacacatttctcaatctagtaaatgatgtattacatgtgaaaagatgcttttaaatataagataaatctatttttaagtttaaaataattaaaacttaattaattatgtgctcatgacattcttgttttacgtgtatctacttaatcttcaccattcgcaggttggaacggttgcatgtacttaagattaacaaggacaattcgcatggaaggatatagcgtaaattatggcatggcaaaccataaatatagatacaaaatcatattaattatgatgagtataatataaaattagcagggtaacccgcacaattatgtggctagcacagcaacgaatttatattattttttttaaaaaaactatcttttataggattccttattcttatcttgatcttcgtcaaatttggtgagcccctatgacacttgctattcgttaaccctaccatgttatccaccagtccacccctttccgctcgtctgcgcgtcattacaatcatcctcttcatcgtcatcacgactatgaaaatggggttccttttgatagattttagaagtctcaccaattgcctccccttcacttatttggttatgatcccttctctttattgtggtagataccttcaaaattcaaaccttatcattgttaggttcaaatatttatagttcttatgtctcgctagtcaccgccttcctactctttttgatgctgctcctgccacccagcttcgttcatgccatcatcttctagaaaaaattgaaccacaaccattaggagctctatatgtgttgcaaaagaatttttatattaaaatatttacaaaatgtttttttttcaaactttaacaaatctataccacccctcatgttctctgcgaggactttttcaaaaaccccatagggttttattttgaaaaaaaaagcttttttttacgatgtggtagacgatcgttggtgtgtgctattagacgatcatcgggggctaagcactttgtaggcaaacccgcctgcaaaatggcaccccatcttggcaatcgacagttttccaaggtgccccctttaagcgctctaggaggcctgcaaaatggacagttttccattgtattcctttagaaaggctgcaacttgcaagggagcagcttgtaaaatggccatgccaacctctagatggcagcacttaggccctgtttctttcagcctgggattattataatctagattattaagattaagctgaaagaaacatacaacttattaaaatagcttattataatctggagcccagcttattataatatggtaagctcatttatgtgagctttttctagattattgggtgaaaaattacccaccatgctaccccactccctctttagacttgcaaacccaataatctaggctctaaaaatctaggaaagaaacaactaaccgtatattatactacagattataacaatctagcttatagtaatctgactcaataatttagattataataattctaaactgaaagaaatagagccttagctcatgttagcggatgcttgccacgttataaaaaaacacccttctagagaatatttttctttcgtaaagaatggactcgtagaggacgggagaggtataaagttgtgaatgtttgaaaaaaatatttttaataaaagaatggttctgttgcgaagggagaactaccctgcatctcacgggcgagtgttagggtagcaaatgggaagaaaagaaaaatcacacatgtgctctagccaaaacaaaattggtgattaaaaaggaaacgaatacttggtcaaaccttaactgacagagaaatgttgttgcattcacatgggatgtaatgcacgcatatgtaatgcacgatcccaaagtgtgtagatcctgaaggggttcacaagattctcccacgatcggcacttctcccacattgcctaagatggaaagatgcacttgccattgtaatgagtagtcgaacagaggttgataggtgataggcagttgtaagctgaggggatcacatgtgtaaatggataatacgtatattagcgaaggacagctatcacggactatacgatagccgtagttcgccaatggaacacttgtccgagaactaacaaaagacataggcaccccaaactatcttagaaatcaggtcgtgtgaggccggtgcgtgttgacggtcgttatcgatcagtttcgaccgtcaatattaccaaaatagaggagaactagtgatgcttgcaatgcataaatatgttagaacaataatattccactagaattaggtttactaaccttttgcagagaatgacaataaagtgaaggagaatcgacatcaactcagacgataaattaatcggacgatgtcgagaaccagacttgtgtatgaatgggccaagaactcagaattgacacgatgaatcaggccaaaattcacaagtctacgaagtgaagcagcagaggaggccgccagccgaaattgggctggattgggccagccccaggttcggccaaacctgatggttcggccgaaccaccctcgccttcgttggatctaggttttggctggacggtcgagatgaagccccaatgacggtcgagatgaagccccaatgacggttggatctaggttttggctggacggtcgagatgaagccccaatgacggttgaagctataaaaggacttcaccttctcacttcactcacacacctcaagcaagagctctatcattcctctcaagtttagtttagtagtatctagctggtggaatagaattagaataggaatcaggagtccggaagtcttcggaagagttcgggtatggctctagtagctttcctttcctcttttgtaagctttgtacttttattagaatactattctacatacatttatggtattggaatactttctgagtatatgagtacctactttacattatattcatgttatactgactatactgctaacttatctaggagatgctttggtgcgggtatagtgtttgcatatgcaattactctatgtcatgacgatgatattagagtagtatctagtagtttaaacgtggtgtctagattacaggatatcattatttggggttatatattgtggatgagaggtgggccgctgatggtgacagctcaataggggtattcctccgcgcctatatatactcctaagttaatttcttggggagggtactcctccgtatttagccccggttggatggtcatgacgggctatcgtaaggaactcggcagtcaggggtggcttttcgaagtaccaggagggcatcggatagagggtattagctagtatatcagttaactagaatgtatgtataatttgtatattagaagtataggaatagatttcctttctcttttctttccacccagcttagattatttattatgaggatgagtagaaatgcttaagtgtcactctacccttggattatcttaacccctgcttagaatatgattatcacaagtaatatataaattattagttgagttctctctacgtgatcttcccacgggataaaataaatacgatacccttggaatactctcaggtgaaatgctacaatggtatatccgtgcgcttgcggatgaactctgtaaccataatataccagaagtatttctgcgccattgctgagaattatgtttctagtaatatcgttaagaaataccaacagtgcgcaatgagcagacaacaattcaattaccacaaatactgtatttacatatccacgtatctttttttttccaggccagggcttcgcaaattaattaatggtgacatccttaaaataaaggaagaaccataagcatacccggggaaacaaaataccgaagtctgctacggatcagatctaatcacagtatacaaagtgtgagatgaatcgccagcacataataatttaatttattctataaataaatcatgacattgcagatgtaaactaccatgaacgcatcattagatctacacatgtaaactaagcagtaaaatataaacagatcaaatatgcgcaacatgtcgaacacgtaccgaggtggcggaaagaccagtttctcggcaggaactactcgtggttgcgggcgtcgacgaaggcgcacggcacgcgagcggagaggaaggcgagccgtcgtggacgaacagggagcagtcacgcgaagcgcttccgaaaaatattattgccgccttctcccggtgcaggacgtcgaaggcagaggttccggagacctgctctcccgattgccggttcacgccggcgagcgggatggagtagtctacgagcgacggcgcagtacagagtaggaggcaaactctagattgatttcgtgtctgttgcgtgaaggtggcgactcggtttatatagagataggtcgcttgatcagggcgcccgcatgatctccactccgcgtaaccgaaccggataagtcgcgcgtaacttattcggactccacaccgaaccggataagtcgcgcgtaacttattcggactccacgccgttttcacgcaccggatttttcgaaatgtttccaaaacaaaacaaatccgaatttcctacagcaaaacaaaactgcaaaagaaggctgcatctgcgcaagggtgaggagccaattttgcggaccattcgacgtgtacgtcgtgcacacacggccaagccaagcaagcgagcgagcgtgtgttccccctcttctctccaccacacatgcttcaagtggctaggaggcattcctcccttttaaggaggtccccctctcctagaataagcaaggtggtactaaactccacatgtatgccatctcatgaggtgggcttttgtgatttttcaaaaattaatctttgagtgggctttagcccatccattaattccaacaagttaattgttacactgatcggcatgcagacaaccactttgaatagagctcaatatccgcaggagaaacatacgcatcttcctcacctacagcttccaaaaagtcgcatatagcaacctgaaacttccagttctctccacttttgagcaaagctctgttttcaagcattgttcatagctttgtcgcaaaccttgctatgtgtttttttacaaaaattttctataggaaagttgctttaaaaatcatattaatctatttttgaaatttataatagttaatactcaattaattatacgctaatggctcaccttgttttacgtatcttcccaatccccttctctccaaactcagtcgggcacctctactacaaccgtatgttttttaagcaatttcatccaggttaacattggttggtacctttgaagaagacaaccaaaatatacgatgtgaattaaaataatgagtcaattatatattatagcactagaacatgattactcaagacacataccacaaatcttctaactttatcctcaatcaatgctctccgacatgaaaaatcaggaagctgcacatatctctcaaacctttgcctaaacaaaacaatagagttaatattaagaagtgcaatgcatacattgataaagaaacatttactattcgtacttacgagttgtaacattattaagtaaacatagtattgacttctgagaatgtttgaaagctactatcactgaatatgcgcagtactttcgtgcttatcccgaaaattgagcaacctatggaacttcgggattttcgtcccattagtctttgtaacgtcatttacaaagttgtatcgaaatgtctcgtcaatagactgagacctatcctggatgagttagtttcgccttgccaaagtgcgtttgttccgggtcggatgatcacagataatgcgattttggcttttgaatgttttcactccatacaaaagaatagaaagcctgagaacgctgcttgtgcttataagcttgatatttcaaaggcttatgatcgggtggactggggttttttggaggtataagctgggtttcgctcatcgctgggttagatggataatagtttgtataaccacggtgagatactctgttaaattcaatggaactctgctctctacttttgctccatcacgcggtctttgtcagggagtcccgttatccccctttctgtttctgttcatagccgatggactaccattgctgttggaagacaaagtggctcagggagctctctcgccagtgaagatttgtaggcaggccccggggatttcacacctgctttttgctgatgacacgcttttgtttttcaaagctgataacgttcaagcccaggctgtcaaagaggtcattactgattatgctttggcaacaggccaactcataaacccggcaaagtgctcaatcatgtttggggaatcctctccgccgcagactcgggatgttattagagtgaccttgcaaatagctaactctggttttgaggacagatacttgggcttcccaacccctgaaggaagaatgtgcaaagggaaattccaaagtttacaggaaagaatctggaaaaggcttattatctggggcgaaaacctgctgtcgagtggcgggaaggaggtgcttataaaatccgttatccagactattccggtatatgtgatgggcatctttaacctaccggagtcagtatgtgaggagttaaccaagttaacacggaatttttggtggggtgtagaaaaggggaaaaggaaaacacattggaaatcctgggagtgtttaactcgtccgaagagcaatgggggcctaggttttagagattttcgtctcttcaaccaagcacttctagcacggcaggcctggcggctcattgttaatcctgacagtctatgtgcaagggtactcaaggcaaaatattttccaaatggttcccttgtggatacaagttttggaggaaatgcttccccggtgtggaaagcaattgagtatgggctgtcacttcttaaggaaggaattatatggagaatcgggaatgggaagtcagtgcgcatttggagagacccctggttgccaagggatttttccagacggccaatcacgcgtaaaggtaactgcagactaaaatgggtctcggaactgctgtcagaaaatggtgcctgggatgaaaccagagtaaaccaggtgttcttacctgttgatgctgaagcaatatgcagtatccgggtctcctcacggcaagaagatgactttgtagcatggcacccggataaacatggcaaattttcagtgagaagcgcatatgggctcgcatgtaaccttgttaatatggagaccagttctagttcttcttccgcaagatgcaaaagaatgtggaatcttatatggcagaccaatgccccccaaaaggtcagaatttttgcatggagagcagccaccaattgtctagccacaatggagaataaagcaaagcggaagctggagcaatctgatatatgtttagtgtgtggtttagaaaaggaagacaccaagcatgtgttgtgcagatgtcctgacgccaggaacctatggggggccatgtgtgaggcgggtaatatatctctaaatgggggtaatctgtgcaatgacccgggttggatttttgatcaactggaaatcctgttggattatgagcgaactgtgttcctgctgattctttggaggatttggtttgtccggaatgagatcgtccatgggaagcaaccaccccctatagaagcttccaagcgtttcctggagagctatgtaaagtcactgttggagatccggcaacatcctcaagcgaatgtagagaaggggaagcatgttatttcctttgttaatgggaaaaccaatccagccaggcgacctcctgaggataaaaatcaaaaatggaggaaaccgtgtgaggggtggatgaaagttaatgttgatggctcctttgatgcgcagactgggagtggaggcattggcgtggttatgcgggactggagcgggaaggtaattttcgcctgctgcaaacacctgcctcgatgtggtagtgctctggaatcagagattttagcttgcaaggagggcattctcgtgggactccaatggtcgcttagacagtttgtagtggagacggactgcttgatggtggtgcagatgctcgaatcaaaggagagggaaatgtctgaggtagcttttttggtgaaagaagctacagaactgttatccggtgatagggagattcagctccggaaaattcatcgcagccaaaattcagtcagtcatttattagcaaataaaggccgttgtgagggcctgtctgtcttttggttagatcatgaatgctcttgtatttctcgtcttgttttggacgatttaagtcctgagtaatatatccctttccccacaaaaaagtttgtaacttgtttagtccgataatataggagtaaaaaaaacaatacaggattagtcaacaaaaccaatccataaaacataggattactcgattgcatttttggatgtttcgtatgaaaattgcacatttacttgaagagtgaacggctaaaagaaattccaagaaattgaggctcacgctagattttttttttcaaatgcttatggattggcctactccatatacaggagttccaagatattttttcctttttgtttgtttacaagagggtagagataaaaacgatacgaaatatttccagtttctcaagatatgccaagccaaccagtcgatgtgctcatagggtaaaaacagtaaaaaaaataatcttattagtgctcaacctgtgtgttttaaaaaaaagagtgaaaagtataaacacgactacaagcagctttctatattaattaatgtcactaaaaactatcctcctacaatattagagacaataaaatttctaaaccattaatgcataaatattttttttattatacttctttctttttctacaccctcatgcaacaaactttctattaataaatgtcaagagtcaactctgagctgttgtcatgcgtagcaatgtgtttctccatactttcctttttttttccacgtcatcaaatttacttgcatgacaacgaagagaacccgttattagacactgttgtaaaccggcattgccttgatgatccttttatgcacttcctgtcacggtccggcccatcctagctgccggcctgcccccgcaggaccgggaactttgggaatttcctttggatccagcattccagtgattccgtcggaactgagaccgagacgacgcccgcactcctcctgcgggccaggggtgtcagcagcacggcggcggaggagcggagcaaggagggagggagccacctgatccacaggagcgccgcggccaagccgcccccgatgtgtggctctcccggcgcaccccgatttcctcgcccccacctcggtcctcgacgcgacaacgaccagtagcaccgccgcttctccgccgctcgctccgactccgagccttaaacccttctgccccccacttccgcgacctccggaactccaccagcagcagtcacgcacgtctctctctctcgccccgcgtcctccacatggcggcgtccaccacctgccctgctcgctccatggcgtccgtctcccgagccctccgcccgcggccgcacgccgctatcgcctccgccgccgtccgcacggctgctcgtctcggtacggcgctcgttggagcctgtttggaggagacttttgcttcttttttttttcccattccatccctctgagctggatgttggcttgtacgcagggggcggattggggatcgtttgttcgatgccaagctatggtaggaaggagaaggaagaatggggattgaccattgcgtccgcaccggcgaccactgctgctccggctctgaggtacgtgccgtatgagcacctcgtcgatgtttattgggtccggggaattgctttccttaggtcgtggattacccaattacagaagagatcagggtttgacttggtcaacacaaactgcgtttgttgagtgttcactagtcacgttgtgctaattggaagtaggtgctgcaacctttctctgctactttaaccaaaagtcccatctgaagctgcaaaggctgctgattgggggttcaacaactgcagcttattgtaaaaggagaatcctgaatatccttctggtgatgtgctccaaccaaggtcccatgtggtcacagaacttaaagtttttttttcattatgaacacttccctttggaagtataggtatcttaatgttatcatgaaaacacagtaacaactctaaaatactggctttagtcatttagtatgagtaatgcttttgaaggaagtaaaatgtaaactagaagggatgaaattgatgaactattcaataaccatatagaatgggtatgctgcatgtggtgaatttgaagtacatggtatacgctagcaactgatcaattctcaaatttcctctaaacattgctatagatgcaaaaaaaaaaaacttttaaaagagtgactttgtaagtaatcacggtggccaaaagttcttgctctaccattttcagctgtcccaactagattaactcagtggattagttgtgtgagttgtgtttactttagtcatgcaatctgttgaacttcattgtatgcttttaagcaaggtggcatgtgtgcctatccttctaagctttgcatttcgatgtttaagggaaaattcatcattaccttctatattttgagtatcttctggactatatttgcatgcctcagaacaagatagaaagtgaattgattggaacttctcatagtattatgttctgtctctgtagtcagtcgaagtatttgctgttctgtttagtgcaatcatgacccattcttcaatcccctaatctgattgttttcaccatttttctgttgcaccttatgttttagtgttatggcatttctaatctgtagttcagtagtttatatttgagaaaaaaagcccagtaccttttgcaattaaattttctactaattagaccaaaaatttcaaggcgtgatagctagcatacttgctttccttacaggccacatagttatatttttaaatagtgcaatttcatccacatgattaatgatcctacagatcagcaaaactatattgctggcctttcttgaataatctcattattaaacacttgttgctctgattttaattacttatggtaatgatgaaatgatctgttgtttcctcagaagctgtcaactattgtgcaaggctgaagctaacatatccagtaatctgccagagagcattcctagtgaagcaaaccagtacgagaaaatagttgagctgcttaccactcttttccctgtctgggtaagttgatttgggagcatttgaggattttatctgcccttttttagcttctagttctgttacatttggtggtttgtaaagcaaatattaaaaaatgtactaaggcagagctcaccttttgcaggtcatattaggtaccattattggcatctacaagccatcgatggtaaaatttctaacttgacaatacccattactgtctgtactcaacagcaaatgccacagaaactgactttatagttttcttggaaaactttcaggttacctggttggagactgatcttttcactgtgggcctaggattcctaatgctatcaatgggactaacattgaccttcgaagatttcaggagatgcatgaggaatccatggactgtatgtttctgctcctgaacgtcttctcttaaagaaatagtgattatttttctgtacttgaggcctccaacttgatataggtttactaatgcaattgcctgttgcaggtgggtgtgggatttcttgcgcagtatttgatcaaacctatgctgggatttgctattgccatggtaatgctaggccatgccttcctattatttctaatgaaagaacaaaaaaatgaaataaacacaatctgttattcctttgtttggatatgctgctatggcagctatgctaggctttcctttcatgcgaaacaggcttgttaaagattctcatgtaaactctgggaaatattaaattgaaaggttggtgccttgctcaaagaaataattgatttgacaagcccttccctgaaaagatgcacatgccattatgctacggtttcttttcatgagatttttcatgcaaatgttaattgtaattaaattaaaaaggttgatgtcttgattaaatcaataatcaataaactgatctgacaaagcaaccttaaagatttgaaggttcaagatcaacatcaaagatttttttaaaggttcaagattgttctctggtttcatttttaggaccttttcctttcatttcctgtgtcttggatactttgagcatgtcacgtatctcaagtttcttttgtttttccatttaattttacctttttcccttgtaaggtgatatctcatctcattgcaatttttatgtgaagaaagttaatctatgtagggtagccgatacaattttatcatatcaaatgtaaactctacccgttatctgcattctttgttttccattgctgtctatttgaatccatagaatacaatttcagtggtatagtgtttctctttggttattgcaaaaaaagtttgaacctaaaattccttctagtgcattttttttcactaagatatctgcacaaatttgacgtctatatttaggtgcaacctaatatggatgtttattttacagaccttgaagttatctgctcctcttgcaactggtcttattttagtgtcatgttgccctggtggacaagcatcaaatgttgctacttatatatccaaaggaaatgtcgcactttcagttcttatgacaacgtaagcttcagatttgcttgagaagaaatttctttggtgcttgttctgatctacttgttatacatgtaccttcatctttcttgaggttctttatccctaattagagtgacagcctttataattgatttctgttgtgctcttatcattctgttatcatggtaaattacccgtttttttcttggaagacacattttcatgctagccagtctcaaaaatattgaatacattggtttagattgtttgtatgtgttaccagtttcgcaagttttaaccggcatatttatttgatgccaacacttttgtattgtctgtactcgcatgcgtagaaaatatctgcatatcatggttacacactcaacaagctttctattgagacatcaaatttggacacactatttacgattccaaagatttagttcacagattgcttttagcatgccaattcaatttgacatgcttccagccatgaagcgtttaaagaatgttactaccttgtaccttttctagtaggttttcatggcaggcttcatacataaactctttttttggatgataggaccatgttccaaaactattatagtttgatgtaattattatctgaatgaatgttgacacaattttgtttagtcgtgtaagcaaaacaacctaatatgcatggcttgattggacaaagtatagtttaagggctggaattgagggcatacggtgctattttgcctatgtgctattattctgctattttgttgtgccatttgattttaatacagaaaccacttaggatgtgttcaattgtgctggttcgtaactcattctccccgcacggaaaatgaggtagctcatgattaaggctgcgttcgacaccgatggttcagaacctctctccggcatgaaaaaagggatgactcattagcacataattaattaagtattagctaaaaaaactttaaatttgattaatatgatttttgaaaactattttcctaaagaatttttttctgaaaaacacatcgtttagcaggttaggaagcatgcgcacggagaacgagagagtagaagttgggaaaggtgagtatagaacacaccctaattaagtattagcttaaaaaaaacttgaaaaatggattaatatgattttttaaagcaacttttctatagaatttttttgcgaaatacgcaccgtttagcaattcaggaagcgtgagcgcggaaaaagagggagtagaagttgggaaagtgcagtatagaacacaccctagatactctgttttcttcctgagtgtcatgctcccaattctactctgactaattgtgattatctttacatttcagttgttcgactattggtgctatagtgatgacaccactccttactaaactcctagctggtcaactggttcctgtcgatgctgcagtaagggcaccatgattcatatttaaaaccaactaataatccatttttatttatcaagtgtccatcagtataagaaaattacatctgtccagggattggccatcagtacttttcaggttgttttactgccaactattgtcggaggtactaaagaagcccaatggatacctgttgtgctgtactttgggatcttatctttgacagatttactgactttatttccattattttgcagtcttggcgcatgagtattttcctaagtttactgagcgcattatatccataacaccattgattggggttctcctcaccactttgctttgtgctagtcctgtaagtctgaaaacaactccgtgttctgtttcacttccatacattgctgattgtttaggctctccacaaattttgcaaatttatctgattatgatgtattatcgtctgttctttattttgagtaaattgctgctctcttcattttcattttgaatattgtaaatggctagatgaggctagatgaaacataacttagttacaatgtttacttgaatttactgtttctttccagatcggacaagtctcagaggtgttgaaagctcaaggtggtcaacttataattcccgttgctctgctgcatgttgctgcctttgcacttgggtattggttatcaaaagtttcctcttttggggaatcaacttctaggactatctctattgaatgcgggatgcaggtaaataaatgctgaaatgtcttagatataatctgttattgtccagaacctgcggtttgtacagtctttggttatttaatggttcttatcgttgctatggatgcctcatgccagaaaggcataatcaagtcaacatgcctgtttcatgcagtctattgtgctggtgttgtttagatgtagtttctcatttacttatgcagtaatttcagcactctgcagcattctgttgccacctaattaggctaacatgtttcctctgtttaattatggtgaatattagaaggccccaagataacaggatgaatatgtctagttttacactattgagcttcgagcaatgaaacgaggctgttgacaagcttgaatcttgatgatgttataagtactagtagtttagtagtatgcaaagtaatttttaatagagcgctgtaatttttaatgacatttgtgcttaacaatgtctcttcctgtttccagagttctgcacttggatttttacttgcccaaaagcacttcacgaatccactcgtagctgttccatctgctgtcagtgttgtatgcatggcggtacgtttcatttctattttctcctaatgctacaagcatgcacatcaatagcaaataccatctcatatttatataatgagtgctggagttcgtgaatgtctaatttaaggcgttctattgtaacagcttggagggagtgctcttgcagttttttggaggaacagagggcttccagcaaatgacaaagacgatttcaaggaatgaaacaccaacaccctccagtttctagtcattacctagtgttgttttttagttcagtggagttatcacagcatttttcttgttacccatattttagcaagttgattatcagtaggacttgcctacttggtaggtctgttgtattgcactcttatcttccaaataagctgcaggtgcttctctgcaaagcactcaatttatagtccgttgccaagtgaatgcattgtaatattatgcgcggtgagtaaatagatttccaagaattgctattccaatctattgaaaggtcaataagctttgtatgtattcttgctgaatgcagtttttcctttaagaaaatgggaaaagagtgaagttcaccatcagtccttaaacttgtcatgatgtgtcatctagttcttttaactttgaaaatatatagatctaagttcttattttaaatgtgtcatcccgatccaaagttgccatgtcctctttgttatcttacgtggagccaatgtggctgccacctcccctcctctctcttctttcccactctcccataagtggcccacattttttttcctttttctctttttatcagagtatgcagattagatcagatcagcaagtttagagatctaaaacagcattttcagagtatagggatctggataacagtttagagaactttactatttattatgtgcgtccactaagatttagtaatgcttggccttgttttcggttaataagaagattgaaggaggccttgttcggttaatcaaagaagattgaaggagatttaacaggagtaattccatacttatttaggttgaagttaatccctctcaatcttctctaattgcttcctcctaatgattaaccgaagtcctagaagtatctctatggtagttgcatgtttactttgctcaagatctgataggtcattaggttatcggatcaaatcctagtcgttctttttctttccttcttttattaattatttcctcttttgtacgtcgttttcgaatatatatacgactaaacttagaaatgtttggacactacatattcacaaatactccataaaattattgctatgtgaaagtaacaatatgatagattcatatgaaaaataaggaagattaaaaacattatgattcggtagctttttgcggatttattatgttgggagtgtctaagatttcaggtgcctgaaatttttaataatttcaataacttttctcatcccttgatgacaatctagtggttctcaccattcccttattacttatacttatcagtccctaatggttgaataataaattatagcaaatagaaaagtacaaaattatatgaattaagcctatagctcataaagatatactacaaaattacatgaaaaaaaagctcaaacttagatataaataaagtaaaaccatatactacctccatcccaaaatgtttgacgccgttgactttttaaaaatatttgaccgttcgtcttattcaaaaaatttaagtaattgttaattctttttctatcatttgatttattgttaaatatatttttatgtatacatatagttttacacatatcacaaaagtttttgaataaaacgacggtcaaacatgtttaaaaaagtcaacggtgtcaaacatttagggaaggagggagtatatagtagcaaactgcagttaaagtaaacaaaaaaaaatgcaaattgtgtagcattgcaatttcaggcttcgcaatgcaagtttaggtgactgaaacgtctaaaacctaacaaatctctattatattgttagaagagttgaagatcaaaagtacagaactgagatcattcacaatgtcaaaagagactacaggagttaatatataagagagagatatgttcatttatttaattgagcgtaaaacttgtacattgcgtataaaatcacgggcttcttagaggtaaacagagagcttctctaaaagctcatccaacaatattcgttttgacatctaccttctgtccaatctaccatgcacctatacgttttaacttgtgtcataactcataacatatatatactgatgggcttttagagaggccctcaggttaccttaagaagcccataattttatacacgatcgtagttttatgataaactgtatcaatatttatacgatattatatcaatatttatggttaacgtggaagctataaaatattcaattagtataggcatgaatatttcgtatcaactttttaagaatgatagctagatttatcttcaaattagtttttgaatattataattttactatataattgatgtgtgtcatacacgtattaatgatcaaattagtatcttagttagtgactgtgtcgttataaaatgctactcctacttgcgacaggagacagtactaggagacaattaagcctacagtcacactcctccaatcggagctcgatcgggactccggaggacgcggtacatttcgatttaaaggcagggagaagtcgatgtaaaactacagcgtttatgtaccctgcagcatcggcatagctcctgtgtatcttcctgccgtcctcgtagctgcttagtactgccaaagcacgcatgaattgaatagaactgccacggcgcagcgtcgtcatgcatcttgcacatgatgtcactggcaactgtgcacgacgtacgtgaggtcactggcaactataaaaaattgagtctcgctccggtactggcacgatcgcgtacggagtacactccagtgctcctcggcataacgcgcgatgtcagtcaatgcaatgcaagcacctcatgtcgatcagctccatggccggatcggccggatctccggggatcgaagaacgtacgcccgtcgatcgcacgacggacaactcgagaagcacacgcgacgcgaccgctagcgtctagcgagtgatatttgcatgcatgcaatgcatatatgaacggcgtggcacggcatgcagctagctgtagtagcgtggatgtggcatcttttctctttttcactccggttttgacgacgggagagccacgcctatcatggtgccatcattagcccgcgtccacgcaacgtcaaatcgacacgttgctgatcttgaccctacggaggttgaagcagctagcagagtggcgatatcagattgcgacgtacccgcctctggctcatggaggcatataagagcaagcaggctataagctgtctaaacggatgagagaaaaaaggagagagaggagaagcggactgtagacttacagctggcttggacataagaacctctgtgagagagataagtgggtcctatattaattgtaaagagctaactattatatgggtaggctgagagaatgataaaaagaatcttatagccaacaggtcggctgtattattagccttactctgagcagaaagatatccggagcgtatttcccgttgatctcaacgttgggcggtggctctctatatgatgccttgatcactttgatttgtcaatgcatgtttgcaaatcgcaaccgatcgatactaatgcggctagatcggaccctacactaatcggtcctttagtggcgaacgttaacggtcccaagctccctcagacaacccaaatgtaaactgtaagtgctgtgactgtgagtaaacaaaaaaaaaaaaaggtacacaggcgccctgcaccttgctgcgcgttccatccgttttgccaggctgtgcgtacgcagagagagcgagcagaggggatactacaggtcggtagatgcatacgaatggatggctcgcctttcccgtcacgcgttcctcggcgggaaacgctcgtctcgtcacgcgagcggggagagagagaggatgcgaatgcgatggaatatcccggtaattgtgtggagccgtcgatccatccatccgttctccgttctgcgctcgctcgcgccgcggcctcggcgctcgagagagtatgctgcctgcctgcctgccaactgccgtcgtcacgcgcgtgcatgccatgccatcccgcctgcgaggctgcgaccgacgtgcagcaatgcacggtgcaaaaacgcccccgcccgcccgcctgtcacgtgacctcaccgcggcgccccacgcgacgaagcgcagaacaccggccccaccgagcgcatgcagctagtactacggctttgtgtgcctcgcaatttgcgtgctcgcatgcggccggagtagctgctagccgtatgcccgtatgtagcgtggaccatcgcgcgcgccccgccggcggagatgacctgcggctgacgccacgccttcctcgtctctgcactccacgcacctcgtctctgcgtgtacgtcgtactcctacatctgtccgccccgtcacgtcccaacgaacggtgaatgattgagacgatgatgatatctttttcttctccatttctctatactccgtggagtagctcgcaacaggggagagcagggcacggagattgcgtgcgtaacagcgtaaggaagggtcgtcgctcctttgccgttcttggcaagtactagtactacacttgagtgtggagggtctctcgactcttgagtgaccaatagccttttcaccgaacgattccgcgaatccccccggtgcacggagcctgctggatgacgttatacatacgtgtgtgtacaacacggaatcggattttaactgtggcaacaaatgcgtcgtgagcagtcttatgttgggtgaagaagaaccaaacaaaacacaaacttgcatgcccagcttagagagagtacccctacgtgccattttctcccagcgcgagaggcgcttccataactacagtgccaaagatggactcaccctggacctacgtagagtacctcctttgttgcatgcatgcatgtggtagagactggctcaccccacgattgctcgatcgcaatcactcaatctcaattgccagaagattcgggatcctgtactgtgagcatgcatgcatgatctatcgcaggagcatcaactgcattgcattgtttagtccggtctcttcttgcatcgctcgttgctcaacaaatgcttcactgtggcgcacacagtcgcacactacggtccaagctactagttcaatagctaggctgatccatcttccaactaccccatggtccaagcctaaagcctacaaacaatatactcgatatagggatcaatattaatcgagcctcaaaaaaatttcatatttagggagtgaaagaataaggcgagagagagagagagagagagagagagagagagagagagagagagctagagctagctggtatttgcatgctttgtggcgatcgagagaccattggatatatatatatatatatatataaaatgcttctgaggtggtaccgttccattggatttttcttccatttgcggtaagctggcgtaacacctcttcgatggtctggaccagagtaactactcccacaatactacaccaccctacgtgccaggccagctagcctttatctgctactacgtttttacttatcgggcactgcatcacttgcttggaattttaattgcccctacctcgaaagagaatttttaggttctaaaatgagtactatcccaatcgatgtaaaagttcacatgcacgcagttaccctctttttgacttgtctgacttatttttcacctttttttttcgatttggggtctccaattcacccacttaattttggtactctttgcagtaggattattctaccacctcctggacaattcactaattggaagtaggaatatatgcaaactgttatgtgaaatgaaggtgggacagctaaaacatataaaaacaaaatggacggattgagtttttttgaatgaaaatggagagaaacccataactgtttcgaattgaaaaaccatcactttctaggacacaattagattgaccaaactttcacggaactccaagttagccatctctcttgtggctgttccaatcgtcgcggcaatcctcatttcattttgtataacggtcaacgactcgatcctagccccacccgttagtgctcaaatcgtacaaactgccatggtattgagacataccgttcgcctctcatttggcccttaccagtcagcacccctattgtatggtggccctgtctcccattgtgccacaacccacacggccatatatataccaccgtacgttgaacacgtaccatcgatcgatcagccatttgttgcaactcttatccgacggtttggaaatagaacttggcgatcgaacaacgtaacggagcgcacgagacatataacggcgcggtgttggtggcagacgtacgccgagaagaagcgccgagccgagcgtgatcgatcgatcgatggcagtggccgtggccgggtggtccacgtacgccactccgcgcgattaggacgtacacgccgggggggcccacggcgcagtgggcagagaatcatcaatgattgagagcaaatcgagagacggggcccacgcgcgtactggtgttggtacacatgcatgctgccctagacccagggaacttgttgccaaggcacggcgcatggagctcaactagcgagcgtagcatgcgtgcgtatgtacgtacgtacgtgaccagactcaccagactgtggtggtcacgtacccatctatccatgatcgatcgatcgatcgggcaggcatgcgtgcttcgagttgggagggagtgtgcatgctcacggtcacggctttgtctcttgcgctccggccacattcctacacttgtctgcttatggaagctatggttcctacgttatgtatgcatgcatcctgtaggcatacttttggttaaagggttgggatgagtcaggttagattaaacctatttttttagtgtgcttgtttgagaataggtgagataggatggtctctgacaggaaatattctcctaaaattcgggttagtatggtcccttaaaaatgagtaaatttcataaaactatatatactttgcacgatttatcataaaactacagatttaagaacttatttcacaaaacttcagattcaatgtctttgtttatcacaaaactacatgcactttgcataatatatcataaaactactgatttaagaatttgtttcacaaaactacaaatttaatatcttcatttatcataaaactacaggtttagtgtcttcattatcacaaaactacatgttttagcattgttaaacctgtgataatggagacactaaatatgtagttttgtgataattaaattaatacattaaatgcgtagttctgtgataaacgaatacactaaatctatagtgttgtgaaacaagttcttcaatctgtagttttgtgatagattgtataaaatacatgtagttttgtgataaacagacatactaaatctgtagttttgtaaaacaaactcttaaatctgtagttttgtaacaaattgtgcaaaatacatgtagttttgtgaaatttactcaaaaattggcgaaccaatccaacccactttttttctcactgacacatgagccattacttcaaaagtgggatcatcccatcccttatgccaaactaataatagggatgagtccaatccatcccaccttatccccaaaccaaacacatgctaggagtaattgctgccgcaaataaaaacataggaaaagcaaaggaaaattcaacgaaggaggatcataaggtatatcgtataaactatacctcaataaaaagtttatcgcttttaaactgtggctgataagctagccgtgaaaaataaaatgaatgtagcaactaaaaataatttacggatgcaatttttatatgatattaaccgatgttttctgaaatatatgttagaaaataaaccatgatgaaaacggctcaaaataaactctaaacttaaggggggttttttttctgcaactggtaaatcaacaagcatagaactattagagttataacttcaattcagtaacggcaagacatacacatctatatacttgcaagtgcatcacttatattccgtgtttactgcattgggacacccgatcttccgttaggtgaagaaactattgatttagcggaaacttgacaaacataatttggcttccgatcaaaatgatctaaaccctgcaatcgcagcatcatgtctcctctagttatcaaccgtgtcgaaacctgatggatctcgccgagaaggctaattcctatgcaaatctcgaagaacacaaattagaactagaaagataacaactttattacagatgaatgattaattaagaacacaaagttggggttccacaaatcgatctagcggcgaaactgctatgacagaaataatctaaacaaaacctgaccttaactcaacgacgactattgaatatatatatataggttttagagtcgaccttggacccctgagcgcatccctattggactacaacacgatacatgactcaatgggcccaaagacgatgatgcaatacccgaatagattctggacgtcttcttgttttgtgattcccattgacttgtaaggaactttacatgagactagatccattggaaatgtgatcttgttacctttccataccgttgatgcgaaacacggcggcatgggagatctgcttaactccagtgcaggtccaaggctagccttgtgtgtgtcaagagcgtgccagctgatttgatcctgcaatcagcaagaaagataaaagcagagttagtcagctgatagcgtatcgttagtggtctaagccgatgtagttagaccaaatcgcctatggaccggatagattaaagaataaaagaccctaaacatgtctcgtctgctatagtgttgttgttaacaacggaattttgcatcagattcggagaagaaggtagaagattgaagcgaatttggtgtgaaatcgagttggatttggagtcggactacacatcggctggataccgtatcagctagaaacagagtgcgagttgataaaggttgatgaggcagatggctgatacagccgatatggtatgatttgggctcggtctgggcctagattggaataaccatatttgccaactagagatggagcttgattaaggcaattgtatctattaattggatagttgagtcaattcaactttggcgcatcgccaccctttttgtctttactttccaacgagttcgctttgcaagaggtaacacgtctcgatggcctgtgatattggggctattatgtcgttttagaaattttagtcctcgtatcatgaccattttttttgaccgggaaatagtgggggaagccccacggtacttttcattaatttaaaaggaactgtacaaagatttataaggtgtcaatccatgattgaaaggggctcgtatcatgaccattgttatcatatgtctatgttaatctagtcttagaatatcgatttagttctatcggctgcttctcgctttagattttctgctggtatcggctaaatcgacttgctagattagattaatttagacatctaccatcttgaaaatcagtcaacggcttgattgtctagatattgtgtttcttttcatacttagtgctgcatcaatgcattttcgacctagtaagtcgtgtttagaaccatgatccatagcaagcttcttgatcactaataggggtagtatcggggttttagccgatcttacctaatatacatgtttctttcaggtggcaagcaagccatccatattgtattgagcactttgtgcttgactgcttgaagaaagaactgcattacgcatctaccctatccatcctataaaataacatcctactactagatatatcacatcctagtacaatgaatctgaatatgtctttatccagattcgttctattaagatatgtcgcgtccagttctagatttgttttttttaagatggatggagtagttgttgacggctgttaagtaccaagttaacaccgtcaatacctgcataaaaccacatatataaaacatccaacatagtggtaggatttatttctaacaatttccacgagtgttggtgtatatttgtacgcaggtgacgaaccaccaaagttgagacaaaagatacaaagaggaggtggtgaattaaacttccatattcaagcctatggagttttggacccacaaacctaatgaaacacattcaaatgggccaattgcaagtacatttgggctgaggggttctccaccaaagcccacgagaaaattcggagcaaaacgggccaacaagggtttggccgaaccacttggttcggtcgaacccgtagctgcgccgttcggccccaaacttcacaggccggcaattaccgacttgctatgacggtttctaccgactttacctgaataaccgtcattagctggacacatggcactaggaggatgaagatgctcattggatgcttggaggatctccactctctcaactcacctccacactataaatacccctctcctctccctcattcacacacaccaaagcatgagctgaattacaagaggctctagtgtattttattgtatattagaacagggagagagtaaagtaatggaagtcggaggaattccggagttatcggtaaccctctcttatctcttgtactttgtttattattctgctttaatagaaatatcattctgagtaattaaggtttacttagtgagaattacttcttggttagttcctaattagcatactggatcattgttcactatagtctatttatttatagtgattgctttagtgtttgatcggcactagagtagttattaattgcgtagacgcggtgtctgggtaattaatttccagtggttgctgcgtatcccacagtacgtttgaggtgggtgtagaggtggtgacagccctcaagagtacttaagtcctcactgtccggatacgtagtagagcgacatctgggaacagcgggttggcagtgcctgaagtattgcgttaggattaaacttaagctttccctggacactgcttctcattaggaaatcctctctgccctctgcccaccttagctttgtgtccttagatgaacctgacgaggagataatcacacacgttccttggattcgatacccttggaatactccgtaggggaagtgctacatcggtatatccgtgcacttatggatcttatctgtgatcgtaagaaataccaacagtagttacacttacagtgcttgatccaacggcttgcgagctgccacacacatccatgcggccatgcgcggtaactactccctccgtttcatattataatataagtcgtttgactttttttctaataaaatttctttaagtttaaccaagtttattaaaaaaatataatagtgtttttaacagaaacaaatatatttaatgttaaatttaatgaaacaaatttaatatattttagatgttgctaatttttttttacaaacttgatcaaacttaataaagtttgactagaaaaagtcaaatgacgtactacctctgtcaaaaaaaactatagttttacaccgtttatgtctaacgtttgaccattcgttttatttgaaaattttttatggttagcatttttattgttattaggtaataaaacataaataatattttatgtgtaactatttttgtaaaaaaatatattttttaaataagatggacaatcaaatattggatatggaaacttatatcagtatttaaaatgagacgaagacactgtaatataaaatataaaacggagcgagtagctcgtacgtgcagtgcagtgaatcctcgtcctagctagccatagtaaagtacaagtacgtagcaagatggactcgctgtcacctgcacactcaccaggctgatcaccataaataatatttccagcgagaaccttgactgtggctttcaaggtgatgatcctcagacgtacagtacaggtcgatcacttggagttgagtcgtacccgtccatcgacgtcttcgcagttacaccattaattgctctgtcgcaattggacctctaatccacaccattgaagagtggatctgtgctacatcctgcgcctagagcgcgtcacggcaataaggtgcaagagtagagcaccagtgcacggctcgccgctcgccgctcgctgctgcctgtctctgtgcccatttaattcgatccccctaggctcctctaacctcttcgcgtctctgtgtacacgtcacatttcccctgctgcacagcacgactactcatcttttcaaaacagatacggtttaggaggagctgaaattgtacgatttggactactaaatataaattttggtgtgcaaaaaacaacctagtttcatatatttatatttatgtccctatataaaatcatttgccattcaaatagcaaacccgaatcccaacgaaatttgaaggaagaaggcaaaactcttgcatttttctttttttttacagtaacacaacaggggaggcctccctgttaaagagattttattaaaaaaaattaaaggtcaaaaaaagttacaacgaaagagtccaatctttagcaacatctctatttatttcatttagcctaaacaagagaagaatgaggtctcccttgaggagttgcctccacgaagataatgaaagaggtttatggaaaaaataaatcaattttttttgcttccaaatgttccatgcatctgtaagaaattgctccataaaacatcttcgattataaatggctttggcttccaatatcatgctctgaagagcaatggaggtattccatactatacccaatctgttccagcaatcaacaatcaatttttcgttttgttgcatttttcttcaaattgcaacgaaatgaacaatgaaaaaaaagaattatgtaaaaggaaatcgacacgtaagcactcaaaatttgattgtatatgtatcttccaatagagaagagaaatgtggtaatatggtatggatgcaataattattccaatacatattccacaccctagtgtgcctacacccactttgaaatttgaacttgtgctctttgggaaattataagaaacatggtatacatgtaaagaagcagatactgagtttttattaaagttaaataaaacaaagacaatttttttctagtacattttttatttttagatactttccatgtaaacattttatggcatgcattacatgtagtatatttatttagaatttttttagtgtgcattgcatgagcaaactgagaataagtatagctagctagctagaaccattgttcacaaaaccattcgtaaattaaaacgtgagttacaaatcgctcgttcaatcagtcaatttttttaaaaaaactaatactaaatttgaattttttaatatactttattttaattccagccgttctcactagttctccaatggtttcaacgaaaagaaaaaattaaagctaattaaggagatctggtaaaggcttttagaaatcagaacattggctaaaactttgctacacaatctctgtgttctaatatacaacgcattattgttttccataaagtctacatttgaaaaaatggactaacaattaaataaaaatatgtgtttagtgccatgcaagtagcatttttgtatttgtatttgaaaacattttttatgatgttgattttgtagtagatggtaatatattacgaaagagattaatgatcaaagtataatgttggaacaatatgaaaggtttaatataaaaggtttattataagcctagccacttattagcgactaaaataatttatggtaaaactattatataaatgtttttagcaactacctatgcttaaaaaataaactaaaattcaaaatttaactatgacagatgagaatacaaatcatgtgttgtttggtttgtgcaagcatatcaagggggagaaatcagttatatactacctctgtgacaggaagatcgcagttttgtttatatatatataacgtttgactgtccgttttatttgaaaattttttataattagtatttttattgttattagctaataaaacatgaacaatactttatgtgtactatttttctttatttttttataaattttttagataagatgaatagtcaaatgctaaacacgaaaacccacagctgtattttaaaatgagacggagatgtaatcgatcactcccaatccatatgtaagtgacacaggcatcccaatgcgcatactatatgtggcaaggcattcttggtgctgggctagtggccctctctggattatgttggattttcaatccgctcggcttgcgtgattaagagggcacaagtggtcttccaaatttgcatcccaaagacaaggacctagctcccacctacaaaagcgtatactagtgtggaccaaaaccccttaccacggggcacgggccctcaccaagtttcattcttcgtacgaaactactccatgaattcgcattgcagggctccaaaaaaaacaagcgaaatcctacagcagcagtattgctcgcgctgcacctctactctagtctgccaccggcgaagcgcgccgctcgagccttctctccaaaaacccctataaaaccaccgcttcgcacagtaaaacctccacctagttggcagtaaaaaaagcgccgctacctacacacacaaccgctctgcacaaggggccatggacaacaagccggcgcaagaacgccgcgagacgtgggtcccgggcgccgtcatcgtcggcgcgggcccgtcggggctcgccgcggcggcgtgcctcgcggcgcggggcgttccggcgacggtgcttgagcggtccgactcgctggcgtccacgtggcgccaccgcatgtacgaccgcctcgctctccacctgcccaagcgcttctgcgagctgccgctcctcccgttcccggaggagtacccgacgtacccgtccaaggaccagttcgtggcgtacatggaggcgtacgccgcggcggcgggcgtcgcgccgcgcttcggcgccaccgtcgaggaggccgcgttcgacgcggccgtcggcgcatggagggtgcgtctcgacggcggggaggtgctcatggcgcggtggctcgtcgtcgcgacgggggagaacgccgagccgcgggtgccggactttcccggcatgcagaagttcgccgggtgtgccatgcatacttccgagtacaagtccggcgagcagtttgccggtaagaaggtgttggtcgtgggatgcgggaattctggcatggaagtgagcttggatttgtgccggcatggcgcgaagccctccatggtggtgcgcaacacggtaagaaactagttaaactgagcttatgctttagaacctatctatcatgctctgtttttcccctgttttttttgtctgtatttgatttatctttctgtgtgtcacatcttattgtcattggacatattattgtcatcttaaatccgttttcattgtgcatggctgtattggatcatattcaggaaggagaaattagacctgttaacatcttccattccacacaactttatatgtcgggtgtcttgtcctatcaacagccgtttctttcttccattttgcctccccctgccctccgataattacgcgtgtcattttcattacattattatgatgacgggttacacaaatctaagcgccgtggtgatgtttcgtccaggtgcatgtcctaccaagggaaatgttcggtctatccacgttcggcatcgccatggcgctgctgcgatggctaccggttcagctcgtcgaccggttccttctcacggcggctcacctcatcctcggtaacacggggcagttcggcctaaggcggcccaaaacagggcccatcgagctcaagaacctcaccggcaggacacccgtactggacgttgggacgctagaccacatcaaatccggcaaaattaaggttagtgccaaccattcagctagcctagctcctttcaagaaccagtagtagaaactgagaccagtcaaactgtcgagctgtacatgtgagctgctgggcgtctacttcctaatgtggcacatcagctattcgcacatgcagcatgtacatttctcttgtggaaaatggttctcatatggagattcatttattttatccctgtgggttttctcctgtgctttgattgatgaggcgctgatgggaatcatgcatcactaggtagtgggagcagtgaaggagatgacgaggcaaggggtcaggttcacggatggcaaggaggagcaattcgacacaataatcctcgccacaggctacaggagcaacgtgccatcttggctcaaggtaaagcagagtgtgactcactcttgttcgttttatttttctttctgtccgcactgcactatactactactagtgatatatatctcgagatgatacggattatatggtcaactgtcaagcccaaggatgttaattatatgtctatatgtacgtgtgctttatgtgttgtaggatgccggtgacttgttcacgagggagggcatttccaaggtccccttccctaacagctggagagggcggaatggtctctacaccgtcggattcactcagcgggggctcctcggcacgtcatcggacgccctcaacgtcgccaaagacatacattgccaatggagagaaagggaccgatctgctattaatgtacttgaaataagcaactcttccttttgatttgactggaaatgtacagtgttttgattaggaatattgtattgtgtgcatataacaccatgttctatctcccttttcaacaaagactgataatcttgctctgccttatgtcgattacttgcctattgagcatcttttgggcaaactgttattatgacaagaatttagaatttatatcaatactcctttaaatgggcgtaatggtagccaccaacttcctattttctttgaaaagaaaaaaaaatacagtgtgaaaaaggaaaaataatgattaagtgggttactaataattttcttgaattaaaaccctgtcgcaatacacggaaagacaacatgctagttagcatactgttgttaacgccgaatatacttttgtgcatatatggtcagcgggtgaaaagcatcacatatttgtgctgatctgataaaaacccatttagacaaatatggttctgatccaacccatcttgctcaccgaggttcggcgttgggccgcaagcccacaatccaggagatctacaactttataattaatatattttttcatttcagatcgtttaataatccaaatattccttacaaaatctctaatctacgttacaaacgacttccaatatagacaaacttatacaaatgttgtagatcttgacgagatctacaactttgttgtttaccagcttttatttaggctgtgttcggaatcggacgttcccagcgtgcacagtaagtaccgaaaacttagcggtctattagcgcatgattaattaagaattagctattttgtttaaaaaatggattaatataattttttaagcaactttcgtatagaaactttttgcaaaaagtatacattttaatagtttgaaaagcgtgcgcgcggaatacgatggagaggggctgggaaccttcagttccaaacacagccttaaaattgtttagagtatcaaataagcattattagtttttttagcaattaaaaccgacaagaagatctaaatgcaaaaaaaaaaaaaacatgtagaacccttctcactaggggtggcagcagggccgggttggacagaaacgctcccccctcctcacattcctccccaccccgcattgcaaaccgggtaacccaatgcacccgagcccctgtgaggacccagcgggagagcagccctcgcatttggcgacgttgacggcttgggggctacagcgaggagtcgaacgttagaggcaccgatgacagctgagggcggcgagccgacgatgaaagctctaggaggcgatgacggatagaagcaggtgaactttagcgcgtcgccatctagttggggatgcagcaactggcgagactaaggggacaaggcaaggttggcatggatgaagacaatggagtcgggacagagtcacgagatcggagaagactgcaattcgcacggtgacacggagcagagatgtgtgacgatgtgcggcggctgtggaatagggaacaaaactcagggttttttttttccaatatatccaaactctttctctattgggcctgttgtgccaatatgttataggtgggttgtgggcttaaattctcagaattggctacttttagaagagtaattcacagccttgagccctgtcaggtcttccgttggtaacttagcatccctgcctttttcttttctccgttcttttatttttcggggccccacccccctgcccccaccccataagagtggtcccatcgcgtcctcagccctaacgagaaaattaccatccctacttctcgcactctagaagggtcaatttttttttaaaaaaacacccttccgaagggcgcaaggggaatacatatgtaaatttataaaagagaaaattatttgttaaatattttagctaaagagtaaaaagaattcttcaagctcaaccgcattaaccagccgaaagaactgaccgctgaatggcgactaacacaaatcatgagcattgtcttgatcatgcaattttgtacgcaaaatattagttagtagaaaaaacaaaaaaaagaagttgtcgtgcggtcgtggccgctcacgcactggtatgtggcaacatgtattttggtgccacaactctggaacaatacataaagaaaaaaaacctgtaccaattaatggaacattggcgatgattctaactaagaaaacgtgagggctaaccacaatcgtatttagctttattttttaaaaatatgtaagtaggatggtgcaaattaattaccttttgcattcaaacaatgcgaatttgcactaagaccttaaagtttgatggactagtatactctcgcaaggttttccccagattagcggcgaaaacggggcgagtatttcccgatcacccgctcgaccagaaaattatgggaagaatatatgggagagaaaatgggatacccgatattttcaggtttaaacctgaatccgtaaaaaatatgggttaggatacgagaaaagtttgatccgcctgtatgttctatattataaaacatatgtgaaaatctattataaattcacctataaacatgataaaagattagttaatcactatttttatgatcttacgtgtaatattatatactttgttccttgatgtatctttttttaacactttaattgcattcttatagtaaatatctattgaattagatatacaaataaatatccgttcccgaatcagatttgaagaaaaaattaatatgggatataatacaggatgagtgatatattattcaacattacctgtacccggttccgaaattaaaggaagatatgggaatgctatgatctgctcgtaccaggcccgttttcacccctaccccagatgaaatgttctacttttttaagtttttttatccgtactccataaaagacaatgcatcatttgcaatggtgactatgtagatatatagacttgataatcttaaaaaaagtaaatttcataaaaccctacctacataatggattttggcggttataagacagcgctacttcggatagataatggatatatagacttgatatctatccattatctattcaggttgcacacaatcacatatatttttgctatgtggcacataacctcagatattagggtatgtttcacaaaaccaaactattgatctttttaacttttatctaccatatttttaagttttacaatcacatcttaaaatttatgggcattgtatccatcatataaatcctacacccactttttaaaaattttgatataagagtacgtcaaaagtgttaacggtttggtttttatgaaactttagtatcataatacccaaagttacgtgacacgtgattggatcataataggtggggttttattaaatttactcaaaaaattatttgcaatggtaacaataccagtaatagaattaatctaaatcatcataaacatatattgtcaatacatttttctatagagaagtatttgaattttgacatattgtaaactatacagagaaattaggagcagatctagcatggaggcggcggggtctcgagcccctactactatcacaagtatcatgggagtttccatggatccccactaaaactttttgttatatagatggaaagggggaggtagttttatttagttttatttggtttcctacagatagcacatacggtactgcctggcagtggtaaaaaaggtccggctaatggacaaagtctcgtaactcccgcgaggaaaaaacacaaaatcgtttgcatggattgccgaacttccccgaccttgcagcacacgagtggaagcacgcccgggagacatcctccggacgtgctggcttcatctcaaccgccaactccagttccccgacgtgcatgtcgacagccatggcttcacgcagccgctgaggcagggacacgccttctcgcgacatggcgacgttcaggtcgaccgctgacaacttgtccacgcagaaggccggcacctcaccccatcggccgaccacgacgcggttgtagtacagcgctacgtcggcggcctgcagaatcgccgtacgtccttgcggttgtccacgtggacggtgagttggaggccggcgaggagatggtcgtcgggccgcgcagcgggtcgagcccctcgacgccagtgagctgaacggtgaaacggggaggaaataagttcatctgaggtccctaaacttatccacgaattcgattttcatccttcaaaaaaaaaaacagatacaacgggtccctcaactatgaaaatcgatactaagtccctcggcggtttggacggcggttttcactgacgtggtgcctacgtggctaatttgactcaatcttcatctgacgtggcatttcgatccgaaaaaatattaaaccctgtgggacctacatgttagtttcacacaattaattaaaaaatagaggccccacataggccccgcatgtcattcttacccctacctcctctttctcctccatccccatctcccctctccggccacggtcacagcggtgcaggggacaacgacctcaagaaggcagacaaggccggtcttgactcttgacgcccttcccatgtcctccgccactcacctcggcggtacgctcggccggtggagagaagaagcgcagtggaggtggcccaagcggtgagagtggagatcggagggagttgggggcgccgccggcagattgctaccgctctgccccaccggcttcgcgcgccgccaccgccccactccaccccgtcgctctgccgggctccccgacggctgcgcccgctgcgcaccagaagacgacgatgacgaggctggcgccctccgcttggctccacagccccgctggctttggacgccgcccaaaacaatggcgttaatcatgttaggattccacattcagagagtgagctggagcacaacattgatttttgtgcagagatcgatggatcgattgattctgtcgccaacgactccaccaattctgtccagggtaagagcaggtacaatagcatattattaaccagctataaatatattttaatgagatgatgagctgcagaccaatctgtttattgacaaccacaaaactaaaggagttgttttgcagataatgaacttgaaaaccatttggatcaccacccaaacaagcacaaagtgctaaagccaccgaatcaacattcaaacgaaacttgaggtgggaaaaacataccaccaacttaaaagaagacgatctagcgaaccttggaatgaaatgcacaggggaagagaatcgaggcctgatttcttttgcaaactccaaacctggagagaaatcccagccatcgacaaaagagagatccgccatgaagaatcatgcgaagctcagaatcgccctcccgatcgccagtccgaacattccggatcgcatacccgtaaattttagtttggatttcttccttatcctttccgctagttgaccgttaaattcttatgaaaaagccaattttaccatttcctataaagaaacataataaattaatggagtatattgtcggagcgtagaaatttgttagctgggctattatatttatgtgttagctatcaccgtattatttgcaataaatatgcttttagatataacataaaaattaatacttatttattaattagttattaaaggttgtttatgaagcatataaatatatttgtcttataaaaaaaatctgttgtattactatcaaaacacatggtgcataaaaaacttttattaaataataaataagtattaattttttatatcatatctaaaagtatatttgtcacaaataatatggtgcataacgaactcataaatataatagtcccacccaataaatttctacactctaacaatgtagtccattaatttattatgtttcttcatagcaaagggcaaaatagactttttcataagaatttaacggtcaactagcggaaagggtatgaaagagatccaaactaaaattcatgggtatgtgagggaatgagcaaagtttaagggtgtagacaactgttaagtaccaaattaacaccgtcaataccagcataaaaccataaaagtaaaacatccaatgtagtggtagggtttatttctaaccatttccacgagtgttggtgtatatttggatgcaggtgacgagccaccaaagttgagacaaaagatacatgatgaggtgaattaaactcccatattcaagcgtaatgaaacacattcaaatgggccaattgcaagtacatttgggctgaggggttctccaccagagcccacgagaaaattcggagcaaaataggccagcaagggtttggcgaacccgtagttgtgccattcgaccccatacttcacaggtcggcaattaccgacttgctatgacggtttctaccgactttacctgaacaaccgtcatcagctggacacatagcaagatgagagtgaagatgccatttagatgcttagcatctccacaatcccaaggcatctctccacctataaatacccatctctccctcattcacaacacacaccaagatgtagagctgaattacaagaggctctaagtatactttaggttctttatatgttctatagtatacttaaaatagggagagagtaaagtaaaagaagttggaggaatcccggagttgtcggtagtcctctcattattcttgtactttgttaattaccctggttcaaattaagatttgtttagtgagaattaattcttggttgtccacccggacgttgtcaagtcgagttgcgcattgagaatattggtgccgctcaatacttttgctaaaacctgcatatagtatgtttagaacaaaaatccactctaacccaacacctgaaacattggtatgcttcaagaccataaaatttttatgtaaaatgatactatatatgatctgatagtctccaacacaacacaccgtgtatgtatcactagttatagtgacaagtgagtaactgacaactactccatgcgattgcaagaccaaatgaggtgcaaaccgtgtatgtatctactggaaggtcagagcatctatagtagtaatacctgaggaatgttaaaggggcagattgcaatcaaccacacatagggggaggaggtgatcgatcctctttgtagctctcggggacaaagcacgacactggcataacatcgaacgggtcgcgagtgaggaggtgatcgacccaccaggactccactgtcatgagaccacgctgtggctgtcccatgggcgacctgggaggggtagtcgatatcctgctcagcacacccccctcttcgacgagaaacagagtagcgtgccgcgtcgctgccgatgatggggttgaactcggggaccaggtatctgccgccgccgggggcgatggccaagctgaggttatctgtgtgggcgatggtcatctcggggggccaggaggcggagagcgctcgcagaaatggaaaggtggagcgtgggaaccatgtgaagtagcccttaagtagggattccacagaacgagcccgcgccccaacttgtcgatgatgagcgggcctgtgtggcggtgctgcgaggtgaagaagaggagacagggggatgtcggcggcgaggacggaggggaagttgtgtattgtggtcggggttggcgcattgtggggccacgacgaagatggcgacccatggcggcgtggagggtgtgagggagagctctgcactgccgagctcggcgtcggttttgtagcggcgagcatggcccacggcgctgccggcgaggatcccattggaggcgtgtggggttttggtggaagaaagtggagaggccagggtttgatgtctgtactattttgaaatcaagatgcgcaggcgtagcggagcaggcagagttaggcaaggcccccgcaaccgcaactccgcaagcctcaattttgcccatttcggccctttgcataaatttattttatgaattattccttcgaaaaacttttcttgttcggtttagaggggactgaaaagaattggagagtattgaggggaaataattccacatctaaaataaatctccttcaatccgtccctcacagggattaatcgaacatgtaaaccctcacagggattaatcgaacacgcccttacatgggaggaaatttgtgtagaactagtgggattcattacaaatgaaaaaactcatataaaagcccgttaagtgcagaaattggtttgaaggaattttgaatgatagaaaatattccttcatatctcggaggaattctaacatgtggtctcatctcatgtttacacatatctttgagaactctaaaataatatataaatcttactccctccatttcataatataagacacaactattttttttatattccataatactccctccatccacaagaattagatatatttcacatttgagtttttccaaataagttgtttctatttatagtctttatacatccaagacttagggtgtgttcgggagtgagggttaggaacccaagttgcctagcacgcaaaacgaagcagcatttagtgcatgattgattaagtattagctaaaataaatttgaaaaatcgattgatatgattttctaaagtaactttcatatagtttttttcgaaaaaaatgtaatgtttaacagattaaaaaacgtgcgcacggaaaacgatgaaggtgagttgggaaagtagagagaagaactcagccttaaattgagaggtaaattatatgtttgattaaaacccaacaagccatgtaaatattcattggttccatgtttgtattcattctttgatctttattacatgcaagatgagttaatttctcattgatcttggtgacaaaagtaataggtgtaactttttttgaaaggaatgagtataaggcatgcatgcatgcatgcatacaattaactaagacctcttctccattaaattattactcatttttttaaaatcatctaccctcgagatctctaattctatttaatgcatgcattacatttattaggatgatccaaactatgagatgataagaattgtttcttggtctctaggttagagcaatttgaatagtatagccaactacaggctccaaatcatctatagttattttaatagccatggagtaattcatacccggtatgttgacctacaagtagtgaaactactaggtaggtccgtcggtttggcacgcaaactaagaccaaagcaatttatgtgtacttaatgcaactttgcaagcaaaacaatcaagatttaaattataagagcaatatggtcaaggcctcaagggtgacttttcttgctcaaggtgttcacgacacttctcgaaatctgcactcgaacataattccgataaagtagtgaaaatattcaaaatcatacacaaagaccaataagaagaccttatttaggactaataatagtgccaatagatagatcacgattaggggtgaaaatggtcggaaacgatcggaatcagtagcatctcttcagaaatgatgctcgatcggccggtaattgatcatatttatcatttaaactactcattatcgatattaatacgatgaaaaaagaattgtgaaaaaaaaaaatttaaaaatagccaaaaaaggttacggtcggaaacggtactcatatacggaaacggcgctcggtcgataaggaatttccgccaccattttcacccctaatcacgattttagaggattactggaagtggaatgaagtcaatcggagctacgtatatgaatttctagagattaatttattttgaggaacaacagaaatgatttttggatttggaaaataaatattccaaaggaatattcatttcgggctgacaggtgggacctgatgtgagagggattgaggcttatgcctctagggttcctgtagacttttgacttacattgaccaaaggatgtaggaatcgataccgttaacttttgacatacattaaccattcgtcttcttaaaatatagaaaacaatataaaccatgctcaaagtatctttaataataaaataaatcatacaaaaataaattataattacataaatctattatatactaaaagtcatttaagcttcctacaaatactcttaggatgcgctctaaaaaattagagaaaatccaagcaattctgagaaaaaaaaagcaaaacatcttgcctttaattttaatttaatacagtggacccattttttaaaccattggattacatctattaaaaataaaccacctaatctctcgtctgtacatacaacagaaaaaatatgtaattattcaacagagagaaaaatctcttgtgttatgtacatacgaaaaaagaatcaccgaagaaaaactacgtacgtatgattgggaaaaaaaacacgattaatccttcacccctaatcctcacattaaatatattttgattaaaaacatgtcacatagaactaaagtctatccttttttcatttcattctcatcctaatagtgttacaatattagtgtccaaatgaattaaaaataatagattattccataatatattaacccatgcatgaaccatcaacaggtaaattagatctataatacagaggaaaaaatatcaacacccatattaacccatatgtttttgaaggattattggtcgaacaaatattgttttcacgtgattctcgccaccgaatctattagattttttaaggcagattgtaattaatgtggacaatgtgatcaaatgaagtgtcaaatttttcttaaaaaccatatcaactactatgttttgatttaaaaataatgacatgtaggatcacattctagccttttacatgttgtccaaataattataaaaagaacatagattataacatatattactaataagttataagtgctcaaagttggaaccttaatagtactctaagctgagattaaactttttaattttggctataaatgactttaaaatagagttaatttaatccatgatattgcaaacatgttatttcagataaatgctattacaatttgtctatttgtagttgtgccattgaaattttacaaaattagaaccgtgccactgtcgtcacgtttgtacgatcaaacacaagtaaccaagtctaccagagggggtgaatggtagataccgtagattacgtcagcggaagtcaaataatcgaatcttgacagatcaaaacacaccccaacctcaaaagccaatgaaacacatgtaatccagtctatccgacctactagagtcagtctgaccgagcctggctggtctgaccgcaggtcactcggcggtctgaccgtcagccctaaaaacagcacgacagcgtttctgtaaaaacacgatttctcttaaaccaaccgttggatcgagttgcaaacttgatagaataaactagacaaactaaggaaaaactccactggagggatttgaaaaataataaacggtttaagagaaaacaccctcgaaagtcagttgtctcagagtttcagcaaatctgaaccctaaaactgaagcaaattcaaatctaacaataagccaagtttgtgaaattagatagggtttcgtgagaaacttgtaaggggtgcattgttaaatatatgatccgaattttgggcccacaatatatttggataagttttctaatagaacttgactattatgattagtttcctagtttgactcataagtctttccccactaggactgttagatttatactatatatattccttgtaagccacacggggagggtgcgatagcccaatgtatcccatgcgtatgtatccaactcctcaatagtgatcattgccggtcaacgcccatggtttttcccgcaagggttttccatgtaaaatttgtgtttcggtttcgggttgttttattgtatatctgtggatagttcatgtttatggcttctagatggatactatgcgtatgtaatactgtagttttctaataatgagtcacgttggagatagtttggaatcggaatatggtttctttgtttgattcatgtgtaggtgtctaaatgcctcgggagagtattgccggtgatgaatcgggagtcaacttggagataaggtgacgtccggatggtcagatatcatgcgggattcttaggctaaagatcaatgcacgtgattggtgaatattccatatggcatatgatggagatattgtgtgcgtatgggatgtggagtcgaatttggaaggagtccaaatttggtataattggagtttgtaaagttggtttcttgtactggaaggtttcctaggtggattaggacttcttgtatgagtttggttcgtggctttaggcagcctacctcatgtataaatagagagggagggtgtggattcccggtatcactttagagagcattgagttgagagattaattagggtttcgagtttggtcgagatttttgtgaggtgtgctgctgttgcactttgtaaacatagagagaagtaataaagttgtcatctactttgagatatcttcaatttgtgtttgcacgggttcggcggtccaaccggcgggataccggcggtcaggccggcggcattgcagcggtcagaccagcggcgacaacaggcatcggcgacaagttttggcggttagaccgggagatcaataccggtcagaccggcggctatggttcggtcagactggttaatctactccggttagaccgcaattcatcgattcaagggtaacttttatttccgctaaaagttttggtttttgggtacaccaaccattcacccgtctctggttggcttagttcctgctgttcggtcatgcaacgttctccatccatttcctcatttgcacgggggcccacttatcagattcctcttcttccttccccatctcagcgtcatggcgaggagagagctcctagaagtagttctgtgcgttgttgtggtggaacccctggtcctgttgccccaagagggaaagcgagagctagagcgaggtgagcgggtcatcgtcgacgtccccggcactaatggcatagaagccgcgagggcgtggaacacctgcgcacttccgcaccccatggataaaaggcagtctcggttctggttggtttttttaataggtgacgattttttaaaagaatcggcactatatctatattataggtgtcaattctttttacaaaccggcatctacagtattggtatcggttttttatctagaaccgacacctataatgtaagcaagcataggtgccgattattttaaaaaaccgacgtctatagtattagtaccggtttttttaaaaaccgacacctatattgtttaaaagtgtcggttctgtattttttcattgaggcagaagtgggagaaggtttaaaaccagcacatgtgagccgacaccaatgaaggtttttgttagctgaacggaaggcccatgcacaaatatccaatacggcatgagttgtggatatacacgttgcctagcaccatgccaatcggacggcataaaaatttgattgaatcagccataaaatctgtcgactgatttttagcaacaccatacttttatactcttcttgcgtgtttatatattttcttaaataaatgagcggtgaaaagtttaggatataatacgaaattatttgaagacagagtgagtactaattacagcaacccgtgcagtggtacatcatgtgaaaaaaatagaaatgctagatgttgtatacagatcgctcggtctcggtgactcaagagaatttagaaccaagagaccagcctttgtcaccctatggatctggcatgcggaatggacaccagagccatctgtaggtggttttgtaaggaagaacgtcgtcattcataaacaagtcggcgacgagtcgcatgtcgatctgcacctctagctctgccaaggattcgccacttgccatatgttcgtgcacgtcctgtgccagcccaaccagctcgcttgacgtggctcctgttactgtgtcacgagtcatcttcttcaagcagaagctgccggggatggaaccccggccaagcggggtccctgcatgccagacggagaactgccactctgaggtatacgcgtaagtttatatacgcatatgcaaactttgtatacgtgtattttttggattttatatatatgtaatactaattttttattcacgtatacaaagtttgtataaagttgtttatatacgtgcattttttggatttttatacgtacatataccaattattttttatacgcgtatacaaagtttgtatacacgtatttttttagatgtttatacatacacacaaactttatatacatgtgtatatatttttttacattaaaatagggtaagacttattctatacccccagtccactcctccccgtccctccctctcgctccccctccctcttctctcgctccccctccctcctctgatctctctctcttttttttattttttttctgttttttttggctcgctgaaacattttttccctcttttctagaaaaataaaaaataaactgccaaatttaagacttgaacccatgacctcatagttcaaagcacattcgtctaaccaattcatctaatgatgctatttatttcaaaaattttgtgagaaagtaatatgattatcaattcctatatatttcactattgaaactcatagcatgttactatgctccaataataacattgttgtaaaagtacagtaacacgtgatgttactgtataacacataggacattattgcacttatggcagtaatatcatagtgaaattgtagtagaccaggaatcgaaacaaaaatatatgggttaaagcctcacatgctaaccatatatttgttactgcacaaaagtagaagtgttagtacataataggtacatgttaccactttcaagtagctgtgttactgcacgataattgtagttttactatgtcatttttacaagatgaagatcgaataggtgggctataggtaaagtctgtaggtggctttgagcgaggtatgattgatgtaagagtgttttgaacaattttatacatttggtaaaactatgttactgcatgtatatacacatgttactacaaattacatactatgttactgcatatggagtgttaaagttcaaaatgccaatatttgaaaagcaatatctcacaagttatgtattattttttaaaaccgttttcacaatgatgctatagtgttactgcatgtggaggtttaaacttcaaaatgcatctacgtactcccctcctcaagaaaccgttcttcctccctcttttcaagaaaaccgatctcctccctccaatatagtgttactgcatgtatatgacgttactgcacttttgacaataatattatggtgaattacagtaaatcaggattgaaacaaaaatatataggttaaaagtctttgatgctaaccatatacttattaatgtacaaaagtaaaagtgttactgcacggaaggtacacgttaccacgtgtttatgcagtaacactacccaaaaatacagtaaaacgcattgtattaacatcgtgatatgattgtagtacatacaacagacaagtagtaacataatagtatacatacaacagacaagtagtaacataatagtatagtattaccgcttatggagagacaaattgcaaaaaagtcaagctttgaagaacaatatctcccaagtgatgtaaggttttttaaaaccgtttgcactatgatgctagaataaaagagcttatcaaaagtagatccgtcatgactatatttcaactatactttaacgctgttactacacgtaagacacaatattactacacagtggtcgtcgtattactgcactgtcttgggacgagagctgagaagaggtgggtggtggggggagttagtaggcgggtttgaccggtgggaggggcctttgaccaaggtgggaggtgggttttgggccttggtaaggagggggaagtgggtgtgacccttgggagggaggggggtatagaataggttatatatatatatatatatatatatatagacacacactagcaatgatgcccgtgcgttgcaacgggtaaaggtaattttaatcatgtatactggttgaaaaaaatataaaggaatcataatcataataataatactaatgaaataaaattgcagtgacctttggtcaaaaagataaaaatatataattaattttccattaattccattggctaaaaataatataatacgaagtagaaaaagttattctcaaattttagcaattttcaaaaagcttaaatagagcaaactaattatataaatgaaaacaaatttaatcacctaaataaaacaattagacctgtaaatgaaaatctgttgccagttcagttaaacatgagcctgcgggtgtgtgtggggtatatatctctcactcgtatgtcgtggtcttttttttgacatagaaaaaatgcccgtgcattgcgacgggtaattaaaattataacaaatataaaaatattatatgattaaggtttagttttacatgatatgagcactttaagaaaatatatttataatgaaataaaaaagttcagctgaagtgacctaacgtgaacttgttacatacggagcgtacacgtggtccatgaggtggcccaataatgtgggcatcctgggattagaatcggggaggaacaacttaagcgacctaaagtgaacgtattccgtgtgggcggcctgggaatggcgttcggcctaacgcgggagaagccagagccgtccgatctgatagacgatcatctcgacctatataaaagttcaacagcccaaaccctaaccctaaaatcatttcccctccctccccccctctctcaaaacaatgtggcggtggcccgacataccgacatccctacgacggcggtggcggttcagcagcgacggcgacaccctcctcttccagcgtcggtgtttcttagtgttcttgaatctgatcttgtattcttgttgtagtgttctgtttagaatttaggtccaaatttgatgtggtctctcatttttttcttttttttttcttttttgccatcggagagggattaaagcgggatcgatcacacgtgcgatggaattttttttatggacgaaaactataacccataagccatataatttttttaattaggtatatatagatattgaatcggactttccttttttttcattttttcgcccttttttcgttactacggatgtcagaaacatctttaatttgttttaccgtgtcacatatatcgattttttttgcccggtttctttttcacgtttttttcacggatagacgacggaaacacttttttatttttaagttgtacatatagagatagagatagagaaagagaaacggaaaacttttttcgcaacttttttttttggaatcggacagaaaaaaaattttacgcttgttttttaccgcgtcgatggagtcggattcgatttgtttttttaccacaccgtgtcacatataataggattcggttttctttggaatcggacagataccttttttctttttggcccttttctttaccgcgtcgatagagtcggattcgttttgatttttttcctttattttttttgccttttttaccctgtagaccgagtcagattcgtttctttttttttcttttttttgcctcaacttttttggatcggacttattatttttttttcttttttcccggtttttttcccttcttttgccttttttatcggagtttttttttcacacggttttttttcgccagcggatttttttcatttgtttcgtcctttttttatcggacatagtttttttttcgtccggttttttcgcccggttttttctcccacggttttttaacgaacgatggaagcacctcttttttctaaaagtagtatatatatatatatatatatatatatatatatatatatataactatacgtatacgtatatatgtatatgcatgtgccgtagagaagagagactaagaaaggaaaagtggccgcgcgcggcgcggggggcgcgactggtcgctaaccagcgccccccccccccaccctctcatcccttcctcctccccttattctatttcctactacactataaatttaaaaaagataaaaaaaacaaagttgaaaaaaattatatatagaaatactatatataaaaaatatttgaattcaaattcaaatttgaaacgggtatgtaaacttttgaattatagattttaggtctatacactaatatttgaatttgaatcgggtatgtaaacttttgacttataaactttgggtctataaactttaggtgtataaactttagatgtatagaaatactaaatataaaaaatatttgaattcaaattcaaatttgaatcggatatgacggagctcgtggctcctcaccgggagaccgcacaggcccccctttgccagttcgtccgggggcttagggtgaaatcccaagctctcgctgtatgtagaaagatcgcgagccaggaagaaacgcgagacacgggcaatgtatacaggttcgggccgctgggaagcgtaataccctactcctgtgtttttgtggatctgtgtatggacaagttacaaagtgtcatccagccctcagtcccctccctaggtgggcaaggtcctccttttatatctcaaggggataccacatgcacctttccctttccaaaccggactgttcttctcttcataaatggacggagatcggtacgattgctgtccgagtgcccttctgacgagacggcccatacctacccccacttccgccggaaacaggtgcgacgtgggattatggctgtctgtggatgacgcgaccagtgtcagaccggtcacagatcagtcatccttgtctaccacgcgtcagcttagcaacgtgcatgtttgcccttcttcatgtaacatcttgcatgtaatggttgggatgaagcctggtataaatctaaccagggctaacgtgccatctctaagagataacccgctagctccggcttgagacaagtgcctagaggctttcgtcttgacgggatggggcaaggcgtgcgtcagaccgccagtcgccacctaacccgtgatctgaccggtctgtgaccagtcacagaccggataaaagaacgcgctgcactgcgctgcatgcagtgtgacacgcttgaccagaccacaataaatgcggttaggtgagcactgccgtgttcacctatcccatatatgtggcgcaaactccctcaaggggtcggggtgcctcggccctcggggccggggcaggagcaacccgaccccccctcgggggggaaatcaggaggagggcggacacctcaccctcgggcccgacgtccccgaaggtgccaggccacgtgggcgattgtgtctgcctcaagcctctggtcacgatacccccggtcccatatcaccgacagtagcccccggcgttatgccagggcgatcgcccttctcaagggaagcggtcgggcgtaatgccactcctaaagcctggtgacaggtgggaccggtttccatggttgcgcagaaacccaacggtctcaaaccatgcacatatggtaacttggctgtccataatgggcggtctcttcaagactgccacatcacttaagcagcgcacgaatctgggtgagctgatttgcttcgcctggagatatggtaacgtcgcttcggccggcgagcgtaattaacgcgcgcacgatacgatctatctcgactgccacaaccgcatatccacctcatgcgccgcaagcgggcgaatgggattagtggaagcgagggcacgagaaacgagggagcgagatagtgagaaacgagggagcgagatagtgggcgcgagaaacgaggagccgggcccagcgatggcaagggtataaaaacaccgaggaaaagttttgctcccttcctttcgccattatccctcttgccttcgccgcttgagccctccctctttctctgctgcgccctaccttcgccacacgcgctcgctttcaatcacctcttcctccggcgccatggcacggggctccgctctgctcgatggtagcgttctaccgccttcccgcatcgtgagcgagaggcacgccgggctgccgcgccgcttcatgccggaatccgccaccggtcgggagatagtgatgctgggcgggggacgcccggcaccagactacccggggcggtccgtcttcttcctccccttcgcaatggcggggctggttccgccattttcttgcttctttatggacgttctggagttctacgatctccagatggcgcacctcacccccaatgcggtgatgacattggccatcttcgcgcacctgtgcgagatgttcattggggtgcgcccatctcttcggctgttccggtggttcttcaccgtgcagtcggtgtcgccaccgtcggtggttggtggttgctacttccagccgcgggggccggtgctgaaccgctacatcccctgcgccctccgcaagaagtgggacgactggaagagcgactggttctacacccccctcgccaacgaagcgcgcctccgacttccaagccagcccccggcgcaggtctccagctggcgggcgccggtagatctgggggatgactatgacgccgtcctcgaccgcctggcgggcctgcgctcccaggggctcacaggggccatggtgtacggcgactacctccgtcgccggattgcgccgctccagcggcgcgcccggagcgcttgggagtacactgggtccgaagactacatgcggacccaccagggagccagatgggattgggctcccgaggacttcaagatcgtggtccaaagggtgctgaatctcagctccgtggaggcgtctcttattcctcgaggaatcctccccctctgcagcgatcccgaccgcgcctctattctgaccattatgataggggtcggggcctcagaggaggaaactcctaagggccacgacggcgcgggcgagagccgccggggggatcaatctaccccaggagggggtcgtgcttctgggcctcgcgtcgggggctcggggagcagccgccctgccgacgcccaggggaagaggaagctgggaggaacacctcccccatctcctccccgagggggcggggcggcgcgtgccagcaatctgcgcccggagggggccgcgccgtcatcgcaacccgagggggagcgcaagaagaagcggctccgcaagatgggggagacggaaccatcccggggaaacctgatttcccctccaaggtggtcatttaaccgaccccctcgcaggttcgtcccactctccttgcgaccgtctttctcctatcccaaaagcaaattttctcttacccatcttgttcgtcttctggttttttcttctgcttcagcgatgtcccgtcgcgttcctcccgccaccccaagtccggccagtccgaggccgaagatccggcggccgcagaggaacggaggcgagaaaatgaccggcgagaggccgcagatcgccttcgggaagctgaagaggccgcccgggaggccgctcgggttcgtcaagcggaggaaaccgctcgggaggaggccgcccgggctcgccaggctgaggcgatggcgtcttccgaggcagctcacgacaaagctgctggcgtgtcgcttgggcccactccctcgggcgacgctcaagcgacggcctccggggcggctcgtgacgaggccgcgggcgcatcgcctgggcccacttctccgggcgacgcccaggaccaaacgggtccgggggacatccccgagcccagcgcatcctccggcgggccgagccgcgtcgcgttctctccaaggcggctcttctcctcgtcttctgtcgccccgctgagcgccgagccccttctgcaggccttggccgccgcaaacactgcggtgctagatgggttcagcgcccaagtggaggccctgcgagcggaacgagcggagctcgaggccgcatgggcgcgtgtcgaggagggacggcgctcggtggacgtcatggtggaggtgggccgtaaggctcaccgccgtcatgtctcggagcttgaagcccgcaaagcggtgctggcggagatcgcccgagaggtggaggaggagcgggaggccgccctcatcgccaccaccgcgatggtcgaggcgcaggacaccctccgccttcaacacgcaaactgggaggcggagctaaagaaaaagctcgacgctgcccaaggggtccttgacaccgccgctgcccgagagcggcgggcaacggagactgaagcggcatcccggcggcgcgaggaggtccttgaggcccgtgccatggcactggaagaacacgccggcgccgtggagaggggcttggcggaccgcgaggccgccgtcgccatccgggaggcaacgctagcggtgcatgaggccgcctgcgccgaagaggagtccgcgctccgcctccgcgaggacgcactcgctgagcgggagcgagctctcgaggaggccgaggccgcggcgcaacggctggcggacagcctgtccctccgcgaggcagcgcaagaggagcaggcgcgccgcaatctggaatgcgtccgcgccgagagagccgcactggagcagcgggctgctgacctcgaggcgcgggaaaaagagctggccgcaagggcgcccatcggtagggcggctgcgggcgaaagcgacttagccgcccgcctcgcagctgccgaacacaccgtcgccgacatgcagcgcgccctcgactcatccgccggggaggccgaggccctccgcttggcgggcgagatagggcccggcactctttgggatgcggtctcccgcctggatcgcgccggtcgacaagcgggcctctggaaaggccaaacaatgctgcactccaccaatctggaaggcctcgctccgcgcctcacgaagatggcctgggctctccaacaactccccgaggagctcgagaagaccatcaagtcatcctcgagggacctcgcccaaggagcggtcgaactcgtattagcgagttaccaggccagggaccccaacttctctccatggatggcgttggatgagttccctcccgggaccgaggacgacgcgcgcgcgcgggtccgggacgccgccgaccacatcgtcaacagcttcgagggctcggcccctcggctcgcgttcgcccccaactccgacgaggagggcgacgccagcggtgcagacgacgatggcgacgaggccggcgacccgggcgcattggaatgagcccccaggcccccgccaatctccaattttttctttttctttcttctaaggccttcatgcctcttttttgtatagatcaacttaatctggaaaaaatgatgaaaaaattcttcgtgtcaattttattttgctatgcgtatgagatgaggatgatctgtgccgtggtcctcttttgtgtcttagcttgatttaagggctcgtgcccaagtcccagtcctctaatggctcgggtcggggctagtgcctggggagatccacatgtcgaggctggccagcccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgaccttatttcaagtcaagattcttcaaaaggaaaaaacggcacagacacaacctttaggaaattgaaactgcttttattgaaatgctgaaataagagaaataagaatgtgcatgcgtggtagcccccggccaatcctgcacacccgaggggggtgcggggttggcccgagccaagacctgacactcgacccccccctcaggggtagaagcgacgaaggtgttcgatgttccacgggttaggcagctccgtgccgtcgcccgtggccagccgtacggagcccggccgggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagcttcgcagtacatggtggcccgaggagacctcagggtgagctcggatgggagaaccgcttctgcgccatagacgaggaagaaaggcgtttccccggttgctcggcttggtgtggttcggtttgcccagagcaccgctggcaactcctcgatccacgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggtatgatctgcagggcctgggccggctgatggatttgcttggcgtgaaactgacacgctctgcatcggcggaccagatcgactgcatcattgagagctgtcggccaatagaatccttgacgaaaggccttgccaaccagtgtgcgcgaggcagaatgggctccgcactcgccttcatggatatcggcaagaagctcaacgccttgttcccgaggaatgcacttcaggaggattccattagccgcgcgccgatagagggtcccttctaccagcacgtagcgtttggaaatgcgttggatgtgttcactcccttcgcggtcctcgggtagagtcttatctgtgaggtatgcttggatctcagagatccatgcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaatcatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaaatcgagacggaccaagtatctgaggatgtctccgttcggagaggtcaacgtgacccccgcaccggcgccctggagagacagagaaccgtcgaactgcatcacccagtgggcggtgtgaggcagccgtgaggggtccgtgctggcctcgggaattgagacggtctctggagtcggggtccactctgccacaaaatcggcgagggcctggctcttgatagcgtggcgtggttcaaagtgcagatcgaactcagaaagctcgattgcccattttaccacccgtcctgtaccctctcgattacgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacccttcggtggggccgatcctcttcgctaggggccgtatccccggggcgttcttcgtccaaatggcctctcggggcgcactcgtcttctgtgccgatgacctcggggtcggaggatgacaggagcggccttcccacagtggcctcggggccgtcctgagggtcgggggctcctggcgtcgtcggacaagcgggcaaagggacaactccggtcgtcaggggcctcaggcctccgttcggctcgggggcctctcctccctgctctctcccgggtcgagtcagcacagggttagcctcggggccaaagggcgataggtgcggccttcccgcagtggcctcggggccttcctgagggtcgggggcacccagcaccgtctgacaagcgggtagagggccgactccggtcgtcaggggccttaggccgccgttcgactcgggggcctctcctccctgcttgctcccgggccaagtcggcacagggtgggggtgcgcggaatgaggattgtcctcatcgcgctccacaaccaacgctgcactaactacttggggggtcgccgctaagtaaagtagcaggggctcatttggctccggggcaacgagaaccggaggagagctgagatacgccttcaactgagcgagggcattttcagcttcctccgtccaagtaaacggccccgagcgcttgaggagcttaaataagggtagcgccttctctcccagcctcgatatgaaacgacttagggcggccatgcaaccggtgacgcactgcacatccctaagtttgctgggggggcgcatccgctctatagctcgtatcttctcggggttggcctcgatgcctcgggcagagaccaagaacccgagaagcttgcccgcaggtacaccaaacacgcacttatcggggttcagttttatgcgggcggagcggaggttttcaaaagtttccgctagatctgagagtaaagtctcttggttgcgcgtctttacaaccaagtcatcaacataagcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaagggtccttaggacatgccttgttaaggtcggtgtagtcgatacacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggcctcgcgcccggccgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatggaccgtcgcccagggcaacctccttgaccgggacctcgtcgcatgtgacaatccgccgcctcggggcggtgggggcggaggtgccaagcctctcgtcaccaccctcgggcttggacgcagcagcgaggtggtccgcgcgctgctccatgcaagcgagcgcgactttcaggtcgccatggacagagatggggccgccggggcccgacatcttcatctggaggtaggcgtagtggaccgccgccatgaacttcaccaacgcgggcctccccaggaccgcattgtagggcagactgaggtccgccacatcgaagttcacccgctccgtgcggaaattggcggatccaccgaaggtgaccggcaggtcgatgtgacctaacggccatgtgtgccccggcgtcacaccgataatcggttgagacggccggagcaccatccccggagccttgatggcatcataggccgcgggggaaaggatgttgagggcggctcccccatcaatgaggactcgccccaacttcacattgcaaacggtgggggaaaccaccatcgcaatctgccctccccgggcaacgcacggtgggtggtcggtctggtcaaaggtgagggcaacctccgaccaccgcgcccgacgcgtcgcctcatgagtaggggccgcggcgagaagctctcgcttcatagccttgaagctccggcgagagatgtgagcacacgctcccccatcgacagtggcaatggtggccccaggttcttggaaacctaggtcatcatcaccgtcatcgatgtcaacagcgggggccttctgtttggcctcacttcgccgtttgccggaaggaaccgccggggacttaccttcccggcgctcctgcctcctgtcctcctcccacttcctcgttcgctctgccaaatttttgactgcatggcagtccgcgagatcatggagggaggtgttgtggacggagcaccacttgccggctgagcgctccctgctgggagtaccagcctctttctttttgtcgctcgcaggcctcccctttcgggtggcccgtggagcgccctcgacggcgaggacatgaccctcgtcgccggaatggaccgacctcttcttcctcctcctgtcacgccgccctgtttgagcggcggatccgggggcggccgaagctgccacaccggaaccggaggggttccaggtccaagcctcctccttacgagccactcggtccgcgagctgaaaaagctctgcggtagtctggggctctttggaagcgatcttttcgagcatgcggttgtgccgcacaccccccctgaacgcgtagatcaccgcgtgtgcagggatgcatggtatggtattgcggacttggcagaaccgctgaatgtacgagcgaagtgactcatcatcccctcgctgtactgcgtgcaagtccgcttcttcgcctgggcgcggatatgtgccttgaaagttcatggtgaactgttggcacaaatcttcccaggagtggaccgacgcgggtggcaggttcattagccaaccccgcgcctgtcccttcaggaccatgggaaagaaattcgccataaccctgtcgtcacccccagcggcctcaatcccggtcgtgtagacctggagaaactcggtggggttgacgctcccatcatacttctcggtgatggtgggccggaaccttgggggccaacggacattccgaagactcgccacaaaggctctacagccgacaccaccagccgggggcacggagggctggtcctcacgtccatgtcgaggcgacactctggacgaagaggcgccctccgttgcgcggggagtacgccggttattacgccggcgctcgatgtcgaggcgggcatccggctctccatgctgatcctcccgagtcgggggtgtcgacgagggagtggcagccgaatgacgtgcaaccgccgccgctcgccgcgccctccgccttgatgacacggagccggtggtggcggcgccggaggtcttggtggtggcggaccgtccaccagcacccaggcgctgctgtgccgtcatgaccaagttggccacgtcgtccagccatcgctgggctggagactccgggtcaggaacgacgggcgggtgacgtaggagcgcgccagcagcctgaagcgcgccctgaggcgtgctgccgtcgccgtagacgaggaggcgacgctccccatctcgccgttctcctgcatcacccgcgaccggtgatgctatggatttatcaaccctctcgagcgcctccccctgcttaggactttggtgtggaggaggtgggggagtacgagctcgacggcgtgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctggcgcgccagatgacggagctcgtggctcctcaccgggagactgcgcaggcccccctttgccagttcgtccgggggcttagggtgaaatcccaagctctcgctgtatgtagaaagatcgcgagccaggaagaaacgcgagacacgggcaatgtatacaggttcgggccgctgggaagcgtaataccctactcctgtgtttttgtggatctgtgtatggacaagttacaaagtgtcatccagccctcagtcccctccctaggtgggcaaggtcctccttttatatctcaaggggataccacatgcacctttccctttccaaaccggactgttcttctcttcataaatggacggagatcggtacgattgctgtccgagtgcccttctgacgagacggcccatacctacccccacttccgccggaaacaggtgcgacgtgggattatggctgtctgtggatgacgcgaccagtgtcagaccggtcacagatcagtcatccttgtctaccacgcgtcagcttagcaacgtgcatgtttgcccttcttcatgtaacatcttgcatgtaatggttgggatgaagcctggtataaatctaaccagggctaacgtgccatctctaagagataacccgctagctccggcttgagacaagtgcctagaggctttcgtcttgacgggatggggcaaggcgtgcgtcagaccgccagtcgccacctaacccgtgatctgaccggtctgtgaccagtcacagaccggataaaagaacgcgctgcactgcgctgcatgcagtgtgacacgcttgaccagaccacaataaatgcggttaggtgagcactgtcgtgttcacctatcccatatatgtggcgcaaactccctcaaggggtcggggtgcctcggccctcggggccggggcaggagcaacccgaccccccctcgggggggaaatcaggaggagggcggacacctcaccctcgggcccgacgtccccgaaggtgccaggccacgtgggcgattgtgtctgcctcaagcctctggtcacgatacccccggtcccatatcaccgacaggatataattcaaattcaaatttgaatcgggtatttaaacttttgacttataaactttgggtctataaactttagatgtatagaaatactatatataaaaaatatttaaattcaaattcaaattcaaatttgaatccgatacaattcaaatttgaatcgggtatataaacttttgacttataaacttgggtctataaactttaggtgtataaactttagatgtatagaaatactatatataaaaaatatttggatttaaatttaaatttaaatcagatatataaacttttgatttaagggcctgtaaactttagatgtgtaaacttgaagtgtacaaactttaggtgcataaatttactaaaatagaaaagtaatgtggtgctaaaaaaaaccacgtggagggtggaggaaaagagggaggagacccgatcgcccctggcgatcaatcgtacatatatgcccgcagcttgagaatctgtctatatatgcggggtgactgttgtagtttgcgagttggaaatggatgtgtgaacgttttagccgcgcgatcgaatcggatccgtcctgaacaagctgtaactgattactaacggaattccattagtttaagtggtgcgagccgaaaccgaatctgtccccaacttcccatgcatgcgaaatcgatggcaaataaaaacgccgggcggcgtacgtgagccaaagctgagcgccggagtcaagttgagcaatggcgaggttggtacgcctcatccatgcaaagtacatttttgtttttatagttgatcagctttggcataatcacattgtaacgaacgaatttaagatgtactccctccgtccaaaaaaaaaaagcaaatcctgggtttccgtgtccaactttaactgtccgtcttatatgaattttttttataattcgtattttcattgttgttagatgataaaacatgattaatattttatgcgtgacttgtcttttaattttttttaaataagacggacggtcaaacgttgggcacagaaaccagggtttatctttttttgggacggagggagtactcatttcggcacagagatagtatttttaatgagaatggattctaatttctcaatgtgttgtccccacgtttaaccttttttttctcaaaatccgatgcaaataattgtgaaaattcttaaataaattggtaatgtagagtatatacatatctatcagttttccaaaaatcaagttaaaattcaacctacacaaaaagagaaaaagaaaagataaattcaggtatgagcaatgcgctactagctactattaatacgttgaatttgtttatttatatctcaaaactaggtaacccacgtatatgcgcggacctcttctttaatgtgattaaaatttattatgaatgtttatgtgtggcagaatttttattaaaaattttgtactatattttaaactaaaatttcatttagtgtgctttgaacgctgatcataattttcttctaattatccataattaaaagaaaattatgaccagcgttcaaagcacattaaataagattaatgagatatttttggatattttgagttttgaatttagcagttaggagaaaatattcaaaacaatggatggggttccctcttagaaaattttgggtatttcgagtcctagaaggatatcttaccccaaaaatttgccaaaaatgtcaaattctttgtttgattctatttgaaattttagatatttttgttccgaaagtccttctaaaattttttattgtttctatttagaaagggtttttaaatccaacaacatttgttcaatcttcaatttaggccacgtccatttttgtaaaaaaaattggagacttccactctataaatcatccttgaaatgatatgatctttgtaatttggcacaaaaatataagtaggttgaacatacaacctggcatggggcaaaagcatccgtctaaatttctctctccaatcaagtaagaaatattaaaataattaccatagtatttttcattagcaaattaccactaaattgtagttgctcataacaaatacatgtttttaaattgttttatggtaaatgtcaggaatttacaattaactgtagcatgttctagcaaaatgaaaaaaaatggatatggtctttaattaaattccatgtggaagtgacttgatagattgatgaggccacctcatggttgttttactgctaagattcctggtgcaactcatacttggtacgatcggtatgatgttcaactaaccatacttttattttgaaccagttgtctataaaaaattaacactataaggaatacacgttatggaaaaaatatatcatttaaatatttttctctaatttcttagtgacatcatcttaagatcatttatcatgtgtgtaatttagatgctattatcatcttaagatcatttatttatctattaaaaagatcatttatttataaaaatataatggtcaatttgtataggtaaatggccgcatatacatgttgagagaaattaattaagttggtagaaaatcatcagatatttaatgtcatacaggtaatacggaggtcttttttggtcttcctttttttccccattaggatagtgttaattttaattgttatggagttgaaaagaaaagagaaaaggaacggacggcggatgctgcataggggcagggatggagggaggttttggatattttttaaaaaaaagattgatgtaatgatctaaaataatatgtctaggatattttctctaatttgagagaatgacgttacagtttggaagtcacagtccaaagctaacatggtcaacatgtggctgccaacttggaccggcaagccaaccccgagccaccgaggcacagcgttggcgggccaggcaagccgtaggcagcccccgtggcctggcatgcttcagccctttcatccttccctaatggacaggaaataggaataagttcacaagaggtccctcaacttaacaacgagattttttaaggtcccttaaccacaaaaccagaaatgtttacccctaaactcatataaaccgtgcactcaaggtcctatggcagtatatataggtggtttcgctgacgtggcatcctagtcagcaaaaatattaaaaaaaagtatgtggggtccacatgtcagttgtacatatcttttcttcttgttttcttctcctcttctgtattctctcttcgctcttctcttattcaggccggcagagagcggagagccggcgggcaagcgcggatgtgggcggcgggctactctccgaccaccgcgcgcccttgttctccctcctccgccgctgggacgacgagcttcggaccaagatcaagaaccacctcctcgcgctcggatggaccatcacctccaagcccaacctccctggcctcgcgcccaggctccactacgtctcccccgccagaagcaagtcctactactccctccgccgcctcatccagaccatccacctccaccaccaccatgctgctacccaatcctaatctcaatctcaatctgagtcttgggcccctcttcttgaggaatcggatgacgaccaataccaacaagaagcagatgaagatgccatcgcggggtacattgccttcatggaggagcagaatgccaggcgcggccgcgggcagggaaatgatgaggagcagaggtccatggccaaggagcttcggatcaaggctaaggaccagctcaggtcgttgtggtggacattctcgatgaaggtcaagtacaacggtcgcgaggaactgtgctacacagagccgcgtggccgctcccacatctccctcatcaccgcctgcaaagcctaccttcttcaccacacgccctcgacaacaatgcagacttcaagcataaacaaaaaaaaagagatggtgaaatgcagacttcaccacatgcatgtgcggcggctgcaacaataagagggccgcagcagagtacacggtggccgagttcgctgtgcacggcgacggtgatggtccctccacctccggccacctccgccgcccgcggcctgccgactccccctcccccccaccgctcccgccgccgacgacgccctccccttctttgcgtcgccgccaccggcagtcgaacctctcgtgacccgtgggtcgtggctccgcgcacgcccgccgctctgtcgtccgcagcccgccgccgcgctcgcccaccgccgctccgccggtgaagagaaaagtgaagaggagaagaagaaaagcgaagaggaggagaagaaaacatctatgaagctgacatatgggcctcatatattttttttaatttttttttctaactaggatgccacgtcggcgaaaccacccacgtatgttgtcatgggaccttaagtgcacggtttgtgtaagtttaggggtacatatttctgtttttgtggttaaaggatttaaaaaaatctgttgttaagttaagggaccttcgtgagcttattcccaggaaatatcaacccacaaatccgaggcctctccctctctccttcgctccaaggcctaggtcgatggaccggcccaacttcccaagctcactggcgctttttccctcagttgagtctacagtgcctcccgtatcccatttcaacttaccttttggcccacctgtcatagaataataaattgtgttcctctgtttacaattgacatctcaacatcatttttaaaaatttgagatttcaactttttttaaaaagaaaaaatggactgtttacattaagatttaaagttcttgcaagctgtcataaaaattaaaaatatttttaaactttggtaatgataatgatgttaaaaataaagttttagcttaaaatacaacttgtataaatagtaaaataaagagaaaaaaatattaaggtgcaaagtgaaccatttacaacttgtataaataccttttgttttttggtataatagtactccctccgtccctaaatgtttgacgccgttgacttttttaaacatgtttgaccgttcgtcttattcaaaaaatttaagtaattattaattcttttcctatcatttgattcattgttaaatataattttatatatacatatagttttacatattttacaagagtttttgaataagacgaacgatcaaacatatttaaaaaagccaacggcgtcaaacatttaagatgtttaaggacagagggagtagttggtttgaaagtttgggcgattatgtggagttactccattcagaaattcaatcactcgtggctatccgctatgcatgttgatactatatatattcgctcgaacaattcacaccacactcaaaatctcaaatcaacagatgttctcaagatttcgatcaagcatctccagccccatcttcattggcctcgttggtcgattgccgccgtcccgcggcccagcgaccgagcagtcctctgatatcccactccaaatccctcaggcgtagcaacaggtacagcacgattccggagatgaagcccagcgcggcgctcgagcctgtgagcgacacgccggcgcagaccagcatgacgaacgactcctgcttgctccccatgtcgcgcgacgccatggcgagctcgatcccggagaagagcagcatgacgcccagtatcccgatcgggaactgccccaggatcgtcacgaacgagttgccgaacaccagcccgagcgccagcttgccgatggccaggaacaccacggacgcgccggtccggccgccgaaccggtactgccccgccagcccgcccgcgccgtggcagcacggcatggcgccgaaccagcaccccacgaaattcatgagccccacgctcaccgacacccgcgccggcgagagctcggcccgttccgggaacaggtccgacgacagcttgcacacggcgatcaccgagttcagcacggacagcgggagctgcggcacggcgccctcccagaacccgatcttgaaatcgtcccaggttatcttgaccagccccaacggcgccggcccaaagcggagatcctgcaggatggacggatcacgaacgaagcagagcaccaagccgagcgcgaacacgattagcgccgccgggacgcggctgcaggagcgacggcgacggctcgtgccgtccctgttgacgtcctcgtcgtcgccggagccggtggcgaggattatgaacagtagcgcggcgagcgcgaggacaaggccgtcgaggccgaggagggggcgcggcacggaggtggaagcagaggaggaacgggagaagtcctgcacgtagcggatgtacttgacggcggtgaaggcgaaggagaggccctgcgagagctggacgccgcgcacgacggggagcgggaggaggcggtagagggtggtcatgaggccggtgacgccgaggaagaggaggatggcggcgacggcgaggccagcggacatgatctgcgggatggtgaggtgcgcggaggagagcgcgacggcggcgatggacttcatgggctggacgggcatggggatgccgaagaggagcccggtggcgaagttgtagagcgcggtgaagatgagcgtggtgccgaggtcgaggtgggacgcgagcgacagcgccagcacgatggggatgtaggtgcccagatcgcccaccgcgccgcccagctccgaccacaccgacgtcttgagccgtatggtggacgggacgaacctgcggcggccgtcgccggcctcgccggagaggagcgggtcgccggcggaggatgccatgggtgggaaactcgaaagcaacgacttccttttgcctagcgatgttgttagcttgcacacgtttctgaccggtggaatgagcgaataaaaatactaatgtctctctcgaggcttaattaagatgcgatccagatttccgtagtggcagagtccagtgaactcaagtttgatccacactatccgtaattgggcgttaattcctacctaaccttaaatagtcgatgtcactgtcagggatggtatatgcttaaagattatggaggccagctactgcacgagataccacccaaagatctcagttcagattgggtaatttaccgtgtttaaatattcttgaaactgcgaagtgcgaaccatatggctttggcttttacttgaccaaaaacataatgatggtcaaatattatccattattttagaatatattctgaaactatgaaccttgattcaattgggctttagttgacggaaattacactcgcttatagccaaatattgccagttttatatcgagaataacttcttttttctttccaaactatctttactgtgtttttgttgtgacttttggcgtgatgtagggacgggacaaacaatatcatggatgatgcattctgcacgtacgtcttcgcaagatggatagcttccaacgagaataatggccgcgacaaggatgtcaagtgacattctggccttctgggtgacgacggggtatgaggatatttccctcttcggcccatgataaaggtggacacttcagcggacaacattgtttgcgtggtcacttggaaaccttttgtactaccatacaaatcacaaatgcttttgtaaagaaatgatgtagacacggtgaaaatatctttcacaaacctgcttatctcaaacgattccgcggtatccagtactcccttccgtttcacaatgtaagtcattctagtattttccacattcatattgatgctaataaatctagacatatatatctatttagattcattagtattaatataaatgtggaaaatggtagaatgacttatattgtgaaacggaggaagtaccattttgttacgaaaatatatctattgcggaataacttggcatctaaaaacttgctatattgttaacactacttgttgtaagtaatctgttgagtttctttctccttgtaatgaaataggtaatctatagcaatagtccattcaataatatatgtttatccggtttgaggattctggaaatgtggaaggctgttatcaatggcaaacccaacactaaattttagctatgacggattaatatactaggatgaggcgtattatactttcagttagtgaaatatttttttatgcgcaaactatactacaatcgtgctttccattggtgaaatatttttttatacacaaactatactacaattgtactacaatgaacaactataatggaaaattttgcatgtaatatttttaccaataaagtaattttcgtgagagtgttatacaggtgtgtttgctcgtatttctattattttctttagtccggctgtgcctttggtttagaacattagaaaattaggccgataaaggcattaaattagtgtccaactaacctattaatcaaattactagcatctgaaatcaacgcccaaatgtccaacgccaggtcgcaaactcaccttggttgtggggcatagctatggacagtgccttggcaatggccacgagaagatccgtcactggatgttattggagctaacggggtaaatcagactactccaatagttcagaaactggagtaattcggttagcaaattatatttctttaattaataacatggaaatagaaggggtcatatatgtagaacaagaaatacaagatttttcagaatcgatgcaaaaagcccctaaaaaggccaaaacgatcagccgagctctcctttccgcgctgtaactgcaatgcagcgttcaggctatcttctttcgggccttcccactatcctaactcacaagccgttggtagttcccttgatcgcttccaatagtcgcgggctgctagctccgtcaagcgtcaaccaaccgctgtttagtctgctcctcatgccatgcgttacctctacttccacggcaacgcaagccaggctcggcctatccgccaccacctcctcgcctacctcgacgcctgcgcctcgcgggcccacctggcggagctccacggccggctcgtccgggcccacctcacctccgacagcttcgtcgccggccggctcatcgccctcctcgcgtcccccgcggcgaggcatgacatgcggtacgcgcgcaaggtgttcgacggaatggcccaaccgaacgcgttcgtgtggaactgcatgattagagggtacagcagctgcgaagccccccgggatgcattggcggtgttcagggaaatgcgtcggaggggagtctctcctgataattacactatggcagcggtcgtgtcggcgagtgctgcctttgctggcttgaagtggcggtcaaatggggacgcaattcatgcgctggttcggaggattgggtttacatcggatgtgttcgtcatgtcaggtcttgttaattattatggtgcctttagaagtgttgaggaagcaagcaaggttttcgaggaaatgtatgagagggacgtggtgtcttggacgtcaatgatatcagcttgtgcacagtgtggtcactgggacaaagtgctaaagatgctttctgagatgcaagcagaaggaattattcctaacaaggtcacgattataagcctgctttctgcttgtggccaaacacaggctgttgatgaaggccggtgggtgtacaatcaggttggtaaatttggtatcgaggcagatgtggatatcaggaatgctctcataagcatgtacacgaaatgtggatgcttgtctgatgctttagaagcatttcaagccatgcctgcaagatatactaaatcatggaatacgttgatcgatggctttgtgcaaaatcatgagcacaaagaagcgctaagaatatttgaagagatgctgttgcatggcgtaactccagatggtataacgcttgtaagtgtcttatcagcatgtgctcaacttggtgagttgcggaaaggcatgcatgttcacagttatatcaaagataatgggatctgttgtgacaatatccttacaaattctttgatcaacatgtatgccaaatgtggtgatatggctgcagctgaaagggtttttcaaactatgacaaaaaaggatgttgtttcctggacagttatggtttgtggttatgtgaagggacatcaatttacaatggccttcaacctatttgaagaaatgaagattgcagaagtcgtggcacatgaaatggcactggttagtctactttctgcttgttcacagctgggagcacttgataaaggaagagagatacactcttatatagaagagatgaatgtagccaaagatttgtgcctagaaagtgccctggtggatatgtatgcaaaatgtggctgcattgacactgcttctgaaatatttagaaaaatgcagcataagcagaccctctcatggaatgccatgattggaggtcttgcaagcaatggttatggaaaagaagcagtggagctctttgatcaaatgctggagttacaggatccaaaaccggacggcattactcttaaggcagttcttggtgcctgtgcacatgtaggaatggttgatgaaggtctccgttacttctatttgatgtcaagccttggtgttgtccctgatactgagcactatggttgcatagtagacctcctggggagagctggtatgttagacgaggcatttcactttatcaagaagatgccaatagaacccaatcctgtaatttggggatcacttcttgctgcttgtagagttcatcacagaatggatctaggaaaggtaattggacagcatatcgttaacgtagctcctaatgatgtgggagtgcatgtgctcgtttcaaacttacatgctgaagaaagtcaatgggatgatgtcgaacatgttagaggactaatgggaagcagaggtatagagaagacacctggacacagttctgtccaggtataaaccttcagagttcagactatgtaaacttcacttgaatacatgatctaccattgagtaaaatatagaaagtttgcaggagcaaatgtaagtatgtaactattcagtttcagttttcttcaaaaaaaataaataaagaagtaaactattcagtttcagttttacaagatgtcaggcatggcatgaccaaacttcactatctacaggacatgatttctgtctcaatatcaaatgtctaaagcaggatctaaaagttctcaggttaacttctgctgttgagcatagtctatagcatggcctacagaatgtttggttgcattactgaactgtgctttacaaaccctgtgtgatactatctgttctggcgtcaaaggtcataccaacattttagttgcccactgaaggcttatgaaattgtgctaactggtactcatcagtctttatacttcatatgtttgcgaactcatctattgtcttttcctagctaccatttctaactgaatggctaactggtagattacttgcagggccacggctgtagccgggtaagacaataatgcctacatgtgggtatgctgcgtgcctgcgtgactgctgatctccgtgctgaatccttggccagccagccacaggtgaaaaagagaggcacaaatgtgcatttaagtagctgtagttactaacgtatatcgggagagaaacaacaacaaagccagtatttaatttctgcatccatataatcacattttctctactcttgcacactggtgatagttctgcttttaaaactgttgaaggcaaatttcagcaaatgttcagaatattggacgatagtaaatcagcactagccactaacccagtttttacatagagaactttttcagtatttgaagaatgattgaacgaagaagttcaaacatagagaacttattaattactacctccttttcaaaatgtgtgatgccgttgacttttcgcataacgtttgtccattcgtcttattaaaaaaaattgtataaatatcatttgtcttattgtgactcaattataacttatacttttacatatcaatggcatcatacattttgaaatgaaggagatatttgaagaatgactgaacgaagcagtttaatgtgaactcgcattttctagatggagtcatacgaagaaacaaaataatatacttagtagaaaatatggcccatttaattaactgtatttactgaagtgtactgtacctgtagagaaacaacagcaaagtcaggatttaccttctgcatccattttctctaatcttgcacactggccataattctacttttacctgttagagtgagaagtgctgctgaaggcaaaattacaggaaatgttcataatattggataatagctcgtcagtaccagtataaaacattttaggtttgtcctaagttaaactttttgatcaattctatagaaaaatatagcagcattccattattccatataataaaacaaatataatatcaaaatatattcaatggtgaacttatatgacaaaaccaaaatgtcttaatttctttgatgtagtttgaatggtgataattctacttttatctgtttagtggaaagcgctgcatgaggcgaattttagcaatgttaagaacattggacaatagtactgggaaatagctcacaaactagttttgacattctttttagatggagtttgaatgcagccatacgattcagatggattttaaatgcagtcatacgaaaaataagaaaatggatggaatttaaatgtggttatcggaaaaaatggagtttgaatgcagccatacgattcagatggattttaaatgcagtcatacgaaaaataagaaaatagatggaatttaaatgtggttatcggaaaaaggaaaaacatacgattcagatggattttaaatgcagtcatacgaaaaataagaaaatagatggaatttatatgtggttatcggaaaaaggaaaaggtatgattttaaatgcagtcatacgaaaaataagaaaatagatggaattttgtggttatcggaaaaaggaaaaagtatgattttaaatgcagtcatacgaaaaataagaaaatagatggaatttaaatgtggttatcggaaaaaggaaaaagtaagaaaatagatggaatttaaatgtggttatcggaaaaaggaaaaagtatggcccatgcaggtctcgaacctgcgaccttcgcgttattagcacgacgctctaaccagctgagctaataggccatctgatcaaaacgtctttaacacagtagaaataaatatgtactccctcgaaatgttgacattattgactttttagcgttcatcttattaaaaaaataagtaattattaattctttttctatcatttgattcattgttaaatatatttttatgtaggcatataattttacatatttcacaaaagtttttaaataaaatgaacggttaaacatgtgctaaaaagtcaacggcgtcgagcattttaaaacggaaggagtaattaatttctagcatgcctcatgattgcctaaaatttctcctccgccacgcctgccgcctgggctcattccactagtgatactggattactagcctgaacgcaggagatcggcggtcaccccgatttgtttcgatacctacaaacttacaatggtggatcacccacttcgtactttcccgatctcttctcaccatgtcgagcgagtttcctatttcaccgcaacacctactatcgaaaagcaatcgtttttcctacccgaaggttcccgcagcaatcccatccgcgctgcgaaccagcgactgcggacgcgcgccacgcgcccacgcttcaacaacgtacccgcgatcacacgggcggccggccgcgcgacacagcacgtgccgcccggtggtccgcactccgcgcgggcggagcacgtgacgtgagagcgcgcgcgggggagggacaccggcctcggctgacatgcgcacgcgctgcgccgagccaagccacccgtccgtccgccatgcgcctgccggtcggggagcgcagctcgctgatcgccccctcgctcgggcacgtgaactcgtacgccgcggtggactggtggtccgtccgctgactcctgccgacgccaactagcttgcctcctcgctgcaggactgcagcatagtagtcggtaggctgctacgagcaagtcgcgatgttgtcgagtcgtggtaatgcagacgtgcacgtcggtttgcctagttgagctgacaggttttatacgactctctctctctctctctctctctctctctctctctctctctctccacacggttgtgactagtgtgcatccaatggtacagtagtttggagtggagacccatacaccgaggaatatacgattccttttcacgtaaccccacgccacgtcgccacagcccccgtactgtgtatccgcgaaagctagcaaaatgtatcttttgccgaactgcagcagcagctccaattaaaccttgtattcaattgttcttcttactaagggaaaagtacgcagaagatactcaacttatcatcgggataaaaaacgtccttaaaccataaaatcagatatatagggtcccttaactatataaaaccggttacccgagatccttcggtggttttgaccccggttttgatctacgtggcagctgagtcagcgtgggacccacgtgggccccacatgtcaggtgaccacaccaccccctctctctctctttcccctttctctttctttttttctgtttctctccttccttcctctcgctctctgctctcacactcgcagggcatggggatgccgacgctagggcgcccacagtggcgcgcgcgggcagaggatggtgcggccggcgacggcggctcctagggcggctcgagcttccccctggcggcacacaagctcagggagggagcatcgagaaccaatcccgcagcagcctccacctgctcatggtccagcacgacgacgtcctcgccgcggatctcctcgccgtgctcgctgtggacctccccgcctagcgccgccacacctctttgtcatgggccgctacctcggcggcgtcgacgcgtacaccaagctcgccgagagcggcaagctgccggtgatggcgaataggttggggggaggggctgatgcaggagctcgctagtggggtccggctgctcatggaccccgcatggacaacgccgcggaggtggccaagagggagaagcgggggcattctgtcgatgcggcggtggaggaggaggaggacgccagccaccacaacgcggcgggatccggcggggatgagggggacgaggaggagaggatctcgtcgggaggaatgggcgcgaggcacgccgacgaccaccgggagaagcggggaacaccgacgccgacgaccaccatgcccgtcgctagggggctgccacctccacaacctccgcctccgccatcgccgcctactggctgccgctccctatccgtcgcccgccgcgcgctcgcccgcctgccgccaccgccactccgcgcctccactccactccgcttcgtcggctcctgcactcgcacactgcctccgtcggccgccctcgtggcgccgcccttcttctctcccgcctcggccccgccagcttgcagagaagtgtgagagagagagatgaggaagggagagaagaggcgaaagagggagaggaggctaacgtggataaacctgacatgtggggggggcacgataactcaaccgccacgtagaccaaaactggggtcaaatccaccaaaggacctcaggtgaccggttttgtatagttaagggacatcgcatatctggttttgcggttcgaggatgttttttatcccgatgacaagttgagggacctgcggtgtactttttcctcttactaacgaggcctacgcccagtcctggcccagcatcagaatagcaagcccgatacctttgccagcccagacttatgtgtgaatttaggcccaaaacaagtcagtcttttcgcccgctgaaattgctcaggtctactagcaacttgggaagggcgtcattagatcgaggatggtggcagtattaacaagggttttgacggcgccttctcttatgtctctttgtataattgtactcctactattaacaaagatatgccaagtatattaattaatcagttggaatatccaaattgcatctgaaaaatatatgccaagtatactcccatatcggcgagagagatagatggacaggaaactcttcatcagatggtaagttcaaaagttccatgccattcagattttcatatttgcgatttacgatcgatccccttaatcaaactaaccctcccgcgatttacaaacacacgctgctaccatcccgagccccactgcttttaccattgctgctgccgctgttgttactgtcactgccgctgctaccgctaacgttgctgttactgttgttgttattgtcgccgccgccgtccccggcggcttcccaggcggacgccgagaacagcggccgcccgtgccagccgagggtgaggcacccgtcggcctcctcgacgctgtgcccctcgccggagaacagcccgaccagcatcctcgcctgccgcagcgcgttcgaaccgagcggcacggcgctcaggccggcgcgcgtgagcctgtcccgccaccgagacagcggctcgtgccgttccctccgggcggcgccctccccgcacacgatgtcgcagatctccctctggaggtacgcctccgccatcgcgttgcccgcgccgccgctggcgctcgccgcgtccagcgagtcgaacaccgcggagtagtagaacagcgcctccgtgaacctgtcgaggaagcccgtcttgttgtggtcggcctcttgctcgatgaccgtgaagatcttgggccggacggaggcgacacagtcgagaacggcgtcgatgggcgcctgatcggccgggtcgccgaggaggcggtggagctgcagcacggagttgaacgcgacggcctccccgggcgcgatctggagcatccacgggcggacctcgtcgaggctgttcgcagcgaccccgcggaaggagaagcggacgcggacggagcgcgcgaggtcggcgagtcggaggccgacatcgcgcagctcgtcgcggccggtaggtgagggcgggccaatgccggtgatccggaggaacggcgggccgcctggtcggagggcgagggcttggatcaaggccggccactgcaggccctgcatgaggctgaagtcgatgacatggacgtggtcgcacccatggaaggcctcgaggatggcctggttcgccgtgaagtgcgcgaacttgaggtagggacacgcctcgtagaagtgatggtagaggaaggcgtgctcggcgtcggtggtaggcggagcgacgggcgaagggaacaatctccgggagagcgcggtggtgaagtggacggcaacgcggccgatgccggaggcggccgagacggccgcaagcgcggcgtgcgagtcggcgagctgcgcggacgcgagcgcgtggtcaccagcctcgatggcgcccgcgcagctcatcagaagatgaaccaagcggatgcccgcgacctcctcctcctcccgccgcatggccaacacagcagcggcagcatcaggcgcgcacggcgggaaggccgcggcgaactccggcagagcagcggcgtccacatccgcccccgcaggcgggtcgtagtaccccacgccgtcgtcgggcgccacagccgctggaggcggcagaaacccagcgtcgaggccggatgacgcggctggatccatgggccactggaacgggaaggtatccatggccatactaactcaaagagtagtctagtctcaccgcttcgcactcggcgagcggtgcgtgtgcagcggggggaattgtagcggtggatacaagagtatagagcggagcgtcagctaggagggagtaggagtcggtcggaggagggagaggagggggaagaggttgagggcgagtgacgttggcggggggtgcacacgtggagatgcgggaggggacacgtaggcctcgggaaggaaggattccgggtgcgaggcggggcgggaggcccgaggaaccgccgtggggtggggatgctgccccccgccttctgtcaattcctgttttctgattttgtccgtgggggggatctcggagtttggaatcctgtacaaaactacagaaaacttcgtgacggagagagagcgaggcaggaataggccattcaagcacgaactttgttgagattttgtagtgaaaccactcgaattttacatacaaacaggatcctatgtccatgtctgacgtgaaatgttcaatcgctagcagtaatttcttggtagcgttagagtgtttcaaatgaagtgctatttttttttttacgtgccatggagcttattcatggcgcggtagcaatccaacagaatatgttagtcaagctaccaaacgatacggtagcctgaaggtaattgtctgagacaaaaaaaaactagtactgcctctatctaaaagtttaatacatatttcattttttagtttttaaataaattggacatatttactctgtgtgctgaattaaattgttagtcgaaatctaatgagttggcttaatactcatcggttacatgtatgtatatagttcgttggttttgtcacattgatgaatgagttaatttcttcttaattttgattataaaagaaatactccctccgtactcgtaaagaaagttgtttagtacaatgtttaagtcaaaccttaggaatataaatcatgaataactctcaaattgttgagtttgaaaatgtaaaaattatataaatagatttgtcttgaaaaatactttcaaaaaagaatacatatatcacttttaaataaatatttttataggaaaaagatgttaaagttgtgttttggagaccgtgtcgctgtccaaaacgacttcctttacgagtacggagggagtataccttaaacttttgggtagggtttgcgtgcgtgcgtccataggggtgagtgcgcgtgcgttgtgagtgtctgcgttgtactgtgtaattctcataaaaaatatttgtggagaaatggtgctaaatacttgtatgaggaaattacaccatggggctggaatatgcctcatgcgaatcataaactggatatttggatagctaacaagtgtaaggagaagtgttcagcctcaaattatttatttataaagcttagatatttttgtcacaggatgttattagtacacacctagtatatctgattgttaggactatacatttttgttcttgtgatgagactttggcttggagttgtcagtccactgattaaattgtacacaatatgtacctttccataggaaacgcaactgattgatcaattcaattgtatgtgttgtccttttcatgctacataatcgacatctcaaacaacttgatcgtagttctatcaaacaactaactaaaaaaagaaatcacacactctacatttgtgaaaaaatatcggcccggcgaaaacttttgtgaaaaaatatgtatatacatagtacacaataatttacctttccttgtcaattgtggcccattaccatcatttttttttctagttagacatttgcactttcccgtatgacataataatatgccaatttcttcgaaataacttcatcgcattttaattgtgccatatttttcttttacagatgtcccataatatatataaaacggcgatcaaagttgtcataaaatgctcctacttttggctggatgagtgcacatatctttctgtgtacataaatacatcatttcagaaaacgaaagtaagactgcaacattacgaacctcaaatggaagtttgaagactacacaaggcagttgctggagcccccacacctgtgttgatagtgagatatgtaagcaaagagtatggttttacctcattaagcacagacaaaaattgctgggtgccccacggttgctaccccggagaaatttccttgttgctgtaacggtcgaagccgtgccatgtgttatcacccatcggtgacatagggggaggtcccccacggataacttctgtagcaaaatcagtgggtaaatgcgtcgcgcccacgagaaatgcacccagatttacccccagagcattgcttggtgggccggcgtgtacaagagtaggagaactggggataaggcctgacgttttgtagattccgctgctctttggcgaaaagtcgttttcagttgtgccccccaaaacaggcgatcgtacatcggcggcacaccaccgtcgctcgcacgccgctctgtagccagccggcagccgcccggcgctcgtcacaagaaaagtttcctcggatccatgcacgcatcaactttcaagcaagacttgttgctgaaacgacgacgggctttctgcaaaatttgacacaagttcttgtggaaaccttagtctcagctagctgctgaacttgatttcacaattcacagccgagtttgctcttaaccatggcaattttgaggctctttgtgccgtgtactggaacatgcgcagcagagcatgtgcgcaactgtgtaccgaagtgacgtgcgagcgagtcgtcaacctcggttgcatgcttgcggccatggccctacagtctacagaggcaggggcacgcaaattaaaacggaaatcggggctggacccgtcgacctggcggatggtcctgatgcgtcatgcggttgcacggtaccaccacgacgttcgtaacaagaatttgctgggtgggagacgcgcgcccgtacttaccctttgcatcctagtatgaccgattcgatcggattagcccatgcgcaagcgaatcagcggcggcgaaagcgccaccacacctaattaagcgcttgcagatttgtcatctgccatatcgcacccagaggcacatgacatcgaccagcgtactcaccaaccgttgccgtttctcctcgcgaacgagcatcgtaggcgaatttcgggctgcagcaggtagcagagctttacagtaatgcagtgtaggagtacgtttgccacttgctggaattcttttagacattgactaagcaatgaaatggactatgaacgcggcgccttttcttttctctttttttttttaaaaaaaaactctttttttggttggagtatcaggcgtagggtgatgtgccgaacagtatttggtatttctttcttcccatcttctcccgtgcgatttatatcttctaaaaatacactccttccgtcctaaaataagtgtaattttacactattcacgttcaacatttgaccgttcgtcttatttgaattttttttagattaatatttttattgctattagatgataaaacatgaataatactttatgtgtgactaaatatttttaaattttttaaataagacggacggtcaaatattagacacgaatatttacggctgtacttattttgggacggagttagtacagagttgggactcggatagcgagtcggaagatgctcctgtctggatcaatagtacaaaacatggtcccggaattgcgtgctacacggtcagataaatggtcctagcaggctcggtcagttgcagcttgctttctttaaaccggttgaattcacccagatacttctcattttcaatcattgcaagccaactgactttgtaaaactcttggttttaaaatttgcggagaaaatcctttgctataccgatgatctcaattacttacttagtatttgcaagttgtaatttgactaaaacaaccagccatcacttcttgtgacggtgaattgtgctccaaacaagagttagaaagaaaggagaaaaaaaaaaggagaagtaacgatcagaactgtactactgataggaatgcaagtggatagttgcgttaaccatataaaaacttatttgctagtttatttttcatatggtagtataaaatttaaaagaaaaaataaactagaagtaggataaacgggctaaaaaacccgcctgcccgcatcgcttatatttctaactatctctaactactgagcgtgtcacccacggaaaattacagtacttttggcatggttggaactggaaatatatgaaccaaccgatagaaagagatatatgtgattggtgcaacaaaactatattttttataatggcaaaactagagttggatacttggatatcatggttttctagaaattacacatgtgtgcaattatttctaaaaaatgcataaatccacgtgcagaaaatcattccgaccaagatctagtcaaatgcaaagaaaaaatgcaaagaaaacggatccactgaaacataaaaaacaatctaataggagtaggatatagctaccatagtgaaaaagctagaccgtccatgaaattggtgaagctcatagttcaccagctcaccggtagggtttcctaaaccgccgaggtcggggttaccacaccccggcggtaagtacggcagggttcgacttaccgtcagtaaccttgcagttaccgggtttaccgtgggggtacggtaatataaataccgcggtaacctccttaaatttaaataaatttaaaaaataatttaaattattgataaattttgcacggttttttacggttaccacggttattgcgcggtagtcaccggtcgtgcggttcgatcgaagaaccgatgcatttatttggtgtgaatattctttgttaaattgttagccatggtgcaaaagccatttagctcgcttagacggtgagctggtagctaagcaaccatgattcaattccctcgcacactttctttttcatttatttggtaaaattgacgcacgtgtaacttgagcctagtagtctttctagcgtaatccatgtgctcgctagaaccgtcgaaagcaaaccagagttggttccggttcaaccgcatagccattggtcttggtcggtacggtcaatttcccatttccctagtgaccctgagtggccgttgagcttattggcaaaagcaaatgcaatttttgcattattttaggaatcgaaaacgccgttttcttgaaaagcagtttaatattgttagacttgcatagactaatttttaatccaaatatatcacatgagtagtaatcactggtttgaaacatatacatttcggcctccttggaatgtacgaaaattttccaattcgaatccgtttcaaaataaagcaacttctgcattcgtaatttatcatagatataacacatttttcgaactactccgatcttaacaaatcacaatcatcatttattcaatttctctatctctacctactcaccgaaatcaatcataattatctcttatttaatttcacctcttattgattctataattacttatatctaaattataaaaataaagggagttctttgcaagaactaactatccaattttttctcattcaaatatagcagatgcaacacgcgcgggtgttaattggcctaacgtcctaaactggacaacgcgcattggggcgtgtgttgtgcaagttttaactaagagcaggtacaactattagctagctgtaaacatattttaatgagataaagaatgagagagaagatcagcgggctacagatctgtagccaactgcaacgcggactccaagacgcagtgtgtgtatgacaggtgggatcatatattaatagaatagtaagcaactattgtgtgaattaactattagattggctatatatgaattagagttagcagtgactatctcttgtaacgaattccacgcgcattctcggccgattagccccgccatgtggctgtgtgcgattcgagggtctagttcgcgtgcgcgtccgttggattaggaatcaacggcagagatgatgcaagggagtttagcgcgattcgcgaaccgtctccggccgtccggcgtcggccaccgccgctcccgtccctcgtcgatccctctgtgcctccccggcccctcgccgatccccatccctaaaaaccctagcccacagtgccgccatcgtcacttcagctctcctgctcgttcgcatctcggtagccgagcgtcgccacctcctccgatccttgcccctttgctgcccatcgacctccctccttgccgatgcgctggacccgatgggccgcggtcgagcttgctggcgcagcgctcgagttgtacgtcccacctccgctccagttcgccccctccacatgtaagtgcgctacctcctcctcctcctcggcgagctagcggatttggttcggattgccatggcctgacacaagttttgcacggtgtgggtggggtggcagagaagcaggggagcaggtgccggcgacgcggatggcatgagaggagacggaggcgtacgcgcgggactggccggcagtggtaagcaagctacagtctatagtctgatatttgttccatttatttccctggacatgaaggatgtgtggttgctgatttgcaacgcaaactgtgcattcatggtgttcgatgaaatgaccaaaaaagagtatatttccttatttcttagagttgcagttgattagcactcagttaggaatattttgttggatagtatattaattgctctattgctactaccacttctgcagaaatccaggagaaacacgacttgaaattgcaaattttgatgctaattaagttgtcatgtgaaactctatatggattattaatctgttaacttatgcattactgattccatcatagcagcaatcgaattatacatgagttagagatattagtgtatatacaattagcataatctggaatagaaatagtaataagctaaaaaaacataatcaggaatggttcttgacaaaactcaagtttgttttttttttatttctgaataccctttctaatagcacttataatcatgaaaatgatcctgcactgcagcactggtacatactttttttttctttggtctcaatcctgcacaatagtttctttacagagttttcctcctgacaaacgaaaataaatctataaaagtggcacaatttagacatttgcatcataattggttagtgccctaattgcaagtgttctactcaagggaacatcctgagtattaacttaagaaattctgaagttgcgatcgattgcaactgtacatggtgaccacattcttaagttaatacatcatgagtttgttatatttctttccacttctctaaatgtataaaaaatatagtgttctctgaacatgctttttttgcagttatctgacaaatatatagagatgtaatgttttctgaagacatttgtttctctgttttgttgggtggatgttatcactttgatgggcctatcaacaagttatttcattatcatttgaatgcacctataataaaaactaacaattggcaaacaacagttttccttcagaactggggattgttgtttcattctaaaaataaaaatagtcatagtctcttatagcttttgctgctttgccactagcccaccaggacgatctggctttgcaatgcttatgtctcttgctcttgatctccttctatcagtcactctaggtgcagctaatttctgttcgtctcctgacatttctagggatgcaagatatcgaagatgaaaattgctgccgcgtgctcgaaatcatcacctccggcatttaaatgtgtgaaagactggttcttaaatttatttttgctttcactgtaactacattgttgtgcttcttctttgttccatagctagaagctagactggaaacaactgtggctgtttcaggctttttttttatcttggtgaattaatgtaaatatatttagttatggttatatccggttttcgatggtttgttcttacagggcaatagttactatttttagcaggagtgccataggagctaatttagctaaacttgttgcatcagttaataacaccatcgaatatttcatttgccaaccttttataaacctgaattttgaaaaccaattggaaaatatacacaggctataatgagcagaggcgcgctaattttctagtactattaaacttgctctaaaatctgctggcacacagtacaggctacagcaacacagcatgcagcaagcaccacgcaattagtgaataaacaaggacgtgcaaaagggaactagccgaagcagcttgatttgttgacagcgaaaatcctatcatatatgggtagatgtattaggtgtcaagtagcatccaagtgtacagcccgagctgtgagttgccacctaatcttttataacaactttttgtaggctaagcttagtcttatcgcgagaaatctacttagctcaatcagaagcataggtcgttgtccaagtatatcgacaatgtaatttatccccactatcactaattaaacagaaaatcgtgggctttaattatgaagttgaagcagcagcccgagaccagccgttcaagagatcggtattgacggagtgagacagctcgcaaggattagattagctgaagagtaggcatcgattgtacgtacgtatctctgcttgtctgaccgaacgtgtacttgccattgttccctgacacttttcagctttcaggtagagatgtcgatgcagattctctggccaagattatttgttaatgatgcatgggttgttgaccaccctgaagacctgtgcaaaatatggtctttggtgtctgatgcacatataattaatactgatcatgcaatccatattccgtggcgtgatgcgtttgtttcgtagctggtcgtaccgtgcaatgcgctgcagtatgtggaaactgtcggcccgcacgtacaaagcgctacgtttcaggaatcatacgaagccctttttccccattcttttatttatcagttggacacttggagtccagatttggtgaacccaataaaccacatggatgcgtgctatccatctcaaagtttaaaatttgctttaagttccctggtcaagttcaatttgccctgtgatcttgtctgcaggtaggtttctgccatccggtactaaaaactgtatttatcacagtaacctagctagctccagatcgctaacagctaatcagtatctttcagccatggcagggaccagaatgctcgcgctcgtgcagccttgcagatgctcatgctccccgacttaccagtacgtactccatacattatttgaccgaggaatgatgaagcggttcagatcgatccgatccattttttccatccacgaaaaaaaaaaagggaagagcacacgctaatccatttaggatgtcaatggatcggatcggacacgagcataaaaggaacacggctgatcaaagacccaacatctttaatccacgtttgatattcttgaggggcaaaatcagtgcccatgcccgacagtcaggcagccgatgggtaattagtgagcttctttataacttgagttatattttttatagataattaaacagaaaggaacacgattaataacaagctagaaacacaaaactagctcatatacacgcggatagagactaagaatgtaagaacatataagaagcacaagactacctgcacctttaattgatatagatagtactgtactaggatgatgcacgatagatgatcagatagctcaattaattagtagagtatagaactgaaaatccttttatcactcgttcaaatatggttcctggcacaaaaaaaaaaagaaccgaataggtattactctagatggactcaaaataatttggcgaagtgtttgtttcaaaacggaaagtggtcgtctgctctgccaaactccgtcaaggaaggagagagataggtgaggggagagagggaggggggggggggataattgagggcaaatccagctagaattccattttcacatgagctgtgagtaaatgggccaaaattagtacaaattaatatcgaatcaggtttagattagccatgggcaaaataaatgcccatacacatccgctatgatttcagggcaaggttgggtgtgtccagaaaaaaaggtaaattgtattttggatcatcgttttattactaaagttaatatactccatcagacttggacacgggtagtgcattgttgttttttcaactatgctaaggtcaaatctccaacgcaaatatttagtcgttattttttaactgtatattgataagaatgttaagatgtaacggatttttatgataaatctactaatactatttttttatatatcagattatatttcattagagttaagatgttgaattttaacggtgataattccaaaatgcacctatctaacaacataccgtagtaggagaaagtagtcttcggaaaaataatgaagaaagtaacaaccgatcgcgctgattgcaccttttaggcctcctttgattcataggaaaaaatggaggaaaaacataggaacaagaatcctatgggatttggtactgttcatccatttgatttgtaggaattgaagataggaaaagcatgggaaaatttcctataaccatgatttcaagggaattccataggaaaattaacatccaccttgagctcatttttcttctcctatgtgtaggatcgaggcaaaacactattggaagataaggtttaccctagtaaaaccattcaaattttgattgctattaacttaatactcaacattcctatgtttttcctttgtaccaatcaaacgatcattcctataattttcatatgtttttcaatcctctgttttgcatatgatttcctacactattcttgagtttttcctattcctacgttcactgaatcgaaccattccacaagagcatctggtacatgtctctgcaaactagcactgtccatgacaacaacctgtgctgtgcgtgcatggatctccccagaaaaaaagaaagaaagaaaagaagcccctgcccgcggtatcaggtccagcagggctgatcggaatcagcggctgggtttcacattcatggtttcatttcgttcatctgcctgaaagaatgccaggaaagtgagagcagcatgtgggctgatgtggccgaaggcagatgcaacaggactacaggagggcgtacatgtggtctatcacctcagtcctcatagaggaaaccattggtgcatactcctccagagtccagacctgagtacacaggtgtaccgcgcgccgcgcgcgcgcgtggtggcacccaggccggcacgaccgcacaggcgcacagcgcgagccacgccatcatggctgcgagcagtcgagcaccaacgacgtgagggtacgagagtacgtgagacgatcgcccacgacagctgcgccccaacgataaacgggccctaccggcctaccggtgctcgcggccgcggagcagggaggtggctgccgaggcgggctgcggaccgtacgcgggtaacgcgcgcaaggctgcgcttgcaactgtgtctgtggctgaccgaggtcaaggagatgggcctgggctaagaagcatgggcttacagaagtgataccgacctgggctgcgtgagtcgtgtacattggggggggggggggggggggg

SEQ ID NO: 61252 - DNA, 3150 bp, Oryza sativa
  unsure (1)..(3150): unsure at all n locations
ctgtcaggtgacaacttctccaccaacanggagttaaagcagcagatgacacttggacacagtttgctgttttatggcaagttcttttttgttagcaggccttttctgctgtatttgaatgtattttatcacaaatagacctatattttgtggttgtttctgttctgcagttccaaatttcatgccacattgtgggttccttctcactctcttttttcttttgcatgccatgtcatggtctctttcctatatattacagttgcaagcaccattccttctcatttctttgggaactagaagataatagtatctgttacttattattctctcctaatggcactgagtttgctccataatcactagtcattcttgtttggtctttcagaaccttttatgttagctctgaaaggtttattgttccatgcagattgctattcctttaactatatgattaacaccttttgtccttttgttgtccattaggaaccattccctatgggtacaaacatccgagccaggtcagggagatcgcgagcttcctctggcgaagaaagccaccaggacatctcaatcacctcggttaattgtgacacttctaccaatggagttgatactacagggcctgccaaggactgagtaacacaactgctctggatcactaacccccaaatcccaaatcataacttttgcgacgcggtttccatttcccagttttccgccctttttcccccaactttggtttttttggtatgacccccaatctgtatttattaacttccatgaatgcgggttaccgaagacttggctagattgctgcaacattttgtccctgatggaaacatggatagagagacagagagggtgcttccagtttcccctgaacctaccattatcatattaacctgaaggccgagaaaggtgaaaggcgcagcgagagcttccagattttggtcactttttaagaatgtattaaccccatgttgtatagcagtttccagtaactgtgctgaggggagagagagaaagagaggagagcaaggagacaatttacatgagtttttagtggtggtgtggagaggaagtctttccctgcattttcttttggaaccttttctggcgtcttcatctatgttccattttgagttgaggtctcctcttttaagttgtgtgcagaggagttccgattttgtcttcagggaactttgaccgtatctatcgaccttcatatgtaaatcaacatctctatatagtttgtgtgccctctgttgtatgcctgcggccccttgcaccaaacgaattgtctctctaactcgtgagattgctgtcctcgtttggtcgtattacatctgaatctaagcatttgatgttacgcaaatacatgccaatggctgcattgcgacatgtagcagacggccaatgttcaaacaaaaatcttaacttatgaagtatactagtacctccatcctaaaatataacaatttgggactgatgtgtatatcctagtccaatgaatctggcccttgtctaaattcattggactggatatgtctcatccactttcaaatagctatattttgggacgacactttcaaataactatattttagaacggagggagtaaataattataaatactagtactatcaatttggcacatggtgtcaagtccacttggtgcatggtcatctaggcttccctttggtgcctctcttaagaaccttctaagcgtttaacacaaattaaaatcgaagtaagaatctgacacgaattgaattcgaaatttgctctcacaatgagacaaaaacaaaagaatttggcgaatacagcagtaacgccgtggacgaagacaataataatagtctcggactcgggagttgttcagtcagtgtccgtcactgggggcccgtgggccgagcccgaagaggaggtgaagggtccagcagtggaggcccagctgctggaacgtggcgtcgccccggcgaatccccccccacgccgcgccggcgaaccgcaccagccggaacgcccgcctcccgccgccggccgccgaaaccgagtggcggtgtcagtatcgaaagagcgcctccaccgaccgtgccgcaccgaactccttctgcaccacccgcccgtcggggaacctgacgcgcacactggacgcctcctccccctcagtcgccttgcgtagtccgacgccgcgtcgccgtcttcctcctccaccacgttgctgttgccgagcacgggcctgagatacccggcgtcttggaagaagctctccgtgcgcgcaaggacccgcattggcgggcggaccacgggcaccgccggggcgnccggtgncggtggcgtgcccgtnaaatgcccgtggtcgtcgtcgtcgtcgtcgccgtagagcctctcggtgcgggtcgggatgggcgggcggatggggggctcgtcgtcggcggcggcgaagtagagggcgagggcgtcgtcgaggctgccgcggcatgatctgatgtggttagctgcggcgtctcgactgtcgcgcatggtgatgtccatgaaccgcgcgacgaggtcgtccatgtcgcttcccgccatcggtgatggatggatcgttcgatgtcgctggttgatgagttggttttgcagcgcgggcaaagatgaaaagttgacactgacacacacacagagagaaacttgctgatcgtggaagtggcgggcaaggggtgtaggctatttataaggattgaagagccctgatatattgattccgacttggattggaggctgcacgagtgcacggtcttctctccgactccgactcggatttgaggctccgcttcgtcatctaactgttgacgaggacaccagacgaattctgacacgatacagtccgacactatgacatgccctttctggtcttaataatccaataagcttgtattggctgcaagcctctgcaaatgtaccttgccttggccttgtgcacgtggttattagctgaaatttaagcaagaatcttggagaatatttgccattctgtacctagtatcgacttcgaggcttgtgttggaantaatgaatgggccctagcccactcgaagattacttctttgaaaaatcacaaaagcccacctcatgggatgacatgcctatggagtttagtatacc

SEQ ID NO: 61253 - DNA, 590 bp, Oryza sativa
acttggtccagccaagccatgcgcgtcctcgtcgtgtctgcttccccaaccaccaccgtataaaggccgcgccaccgtgaccgcgtcggcgtcgccgccgccaccgccgcccgccacctcgccgccgaccagacgagccgccgtttgacccaacaccgagctcccgcgcggagttgatgtccatctccccttccgaatccaccagaggatcccagccgctcgcgccgcgcccttccaaccctagccccggaccccgccatggcaacagctccgccccaccgcgccgccgcggccgacgctcccctacggctcccgtctcaccgccctcagccgccggcgggagcggcggcccgagctccggtgagttctcgcttcccgcgagctccctccctcttcccccttccacggctaaacgtcgattgaaacgataggggattatcggcggggcttgcagatctactgatctagatagctggactgggttggttggggggacgaggattgtgggaagctttttacctgttaattttgcaggttgtagagttgagcccaagctttgtgtagaaactctaatacctttttggtaaatt

SEQ ID NO: 61254 - DNA, 4979 bp, Oryza sativa
atgttttgatttttttgaaaaaaaccgacacctataattgcttaaaggtgccggttttttgcgatttcaaccagcggaagtgtggaaaggcctatagatgccgattttagcacttccggcacctatagtgctgacacctatttgatgttttgtagtagtgcccggctccggccttagccccgtagagtcatccaaatggaaaacggggacccgacaggtgagcgaggcctcgcatcgggcggcaacatggagaacatggtgacatcattggatggcaacaagcacttgtttgcatggctggttgtcgacgaagggatggaggcacgcccggcaacccttccttggctgggaacgaagcaagtgacgggaaaaaggagaggacatgcggagacatccagcaaggggaacaagaagtcgatgacctggcatggagggatggaggccggaggagaggacagtagacgacgaggagggagagcgcttctcgctccaacggtgtgaccgcttctcactccaccgcttttggctcatgaatctgatgatgacttgcggcacatgtgttggggagaaatttcgggataggataaggggagagttccttcttaagcctgatgggccttattttcataacgggttatcactattgttgaatagtcccacattgcttgtggaagggcaaaggatcttttttataagtaggggagcccctcacctcataatctagctttttggggtgggaaaggccctttaccatcctataattggtatcagaacccggctagttcaacatttctggcccgagggacaaaaggtgtaaaggcctgatgaaccgggggtgcctgcggggcccgtatacctgagggaccatggggaaatggtgaaggggcggtgaacggctaagggacaccaatgtgtgaagggggagattattaagtagtcccacataagttgagaaagggcaaaggacgtaaaatataagtgggcgagcccctcacctgataggctagcttttggggtggaaaagccctttatgatcctacaactatattttcactctataatgtaatcctaaggcccccgcggttggagatgtttccctgcccccggctccgcatgatgtcggtttcctgcccccgtatcacctgcgagtagcatttcgcccccgtccctggcccggtaggggcgggtacccgcgccccccacccccaaacggggaaattgccacccctagtcaaaaaggagagctaacgactattgacggtcataatagaccaatttcgactgtcaatacatccggaaataaaagagaattagcaatatttgtatgcatatttgtttaagaataatttatttccacttgtacttggcaacgtatttgtatataggcgatcttcatataaatggaggagaaacgatggaaaataatcgttcaaacaatcaaagctcgacgtgtggcagacttaatggatggatgggcccacaaacccattagaacacctgtaatttggcccaaccatcatgccactaagctaaggatccatcaagcgaagtccaggagaaaggatgtgccagcccaaggttcagccgaaaccgccaccagcgccgttcatcctggccttccacgtggacatcctaaattgcttcccaatgatgtttgcagggtgtttaggacattttcaactatcataaccatcattgagcctataaaaggatcactacatctccatttcaacacacaccaagaaggatcaatcaagaaactctctagttatttactttgttctaatgctagtggagtagaattagaatagttttcttagttcttcaagtcttctagagatttcaggtatcgctctactagctcctctctctctcttgtaagacttaattcaataatgaaatattcttctttatatagttttgttcctttacttcatttatataattattcgagtaccgactttagttcatacttgtctcgtaataattatgtagctagcttactagagatatgcaatggtattggtttggtaatcaattatttgattgttctatgtcatctgcagagatatagagtagtatgtagtaatgtaagcacaatgcttagattattagataccagtaaatggtgctatatgtacggatctatagaggtaggctgctgatggtgacatcttagtacatgtattcctccacgtgcgtatatagggctaagagattttcctagtgtgggtactcctccgtatctattaccaattggatggccatgacggataaggaactcggcaattaggcgtgatttctcgatattacaggagggcatagttaggggtattggctgcataattgtataatagaaagtgttaattaaaatgactatatactataagtacaggaattatgcttttctatttctttctccaattagcttagactattatttcagtgagagtattttggttaattctttttgtgtgtcaatcaacccttgtccttaaattgattaacccctgtattagattttgatcaacataagtgatataattgttattataatactctcttctcatatctttccttaggactaaataaaatacgatcccttggaaatacttccggatgaaatgctacagcagtatattcgagcgtttgcagattatgtctgtaactataaagaataataagtaatatttcgggcataattgtttggaattatatttctagtaattttttaagaaatattaagaacgacaaacaagaaactccttcacctgtgatttttgttgtgtgctgagctggagggaaatgatacttactaataagaaatcaacttattttaagatggaaggtgcatattaataccatgatcatatccacaaagaattgtgaactataatgaaaaaggaaggatctttcgatcttagcaattagattcacttgttaggtataggcctataatccaaaataaaaacagacaaacatgcccttagtatctcataatatctttgtgtttttttaaagaaagacacagacaagctggttttcttaaacaataagctgttgcttatgtgttctacccacgtgctcttaattatatggtgagcatggacactcttgattgtcttaggaggagtgttaaggctgtgtccgggaggtggaatttggaactccatctccccacactgaaaatgtggtggtttattaatgtataattaattaagtatcagctaaaaataacttaaaatagattaatataatttttgagacaaatttggtataaaactttttttaaaatgtaccgtttagtaatttgaaaagtgtgtacgtggaaaatgagaaagattagttgggaaatagaagaaaagaacttagagcaactccaacagtccccttatcccaatctccaagttaaattttagcaagtttgaagaaaaaaaaacactccaatagcttctctatttgactggccaagccatctagctggccaaaatggctccttggctggccaaacttggccagtttgcctgcctagccaaacttggttgctagctgtgggacccacgttgctccccacctcaatatctctttcccctctctttcaccgcacagatcgatcgtcgccgccatcatcgtcctacagcgccatcgtcatcctgcgatgtcgctggctcgcacctgcacagtcgtcgccgtctgatttcctccgtcgccgagggagctccgcgatgacgaggcaagagcgaggaaggtgtgttggcgacggcgacgagggaggagcgatgatggggaaaaagcggccggatccatcatcgctgtcgatggcctcctcctccggcaccactgtcgtcgtagaggtcgccgtcaccatcccctctgcatccgtcgtcttaagggctccgctgtctcctaccccgccggattcggccggcggcgtgtaatcgccggggggtgggggtggggggcacgtgtggactccgctgcctcctcccctacgcggatggcggcgtggattcgccgggacgacaatgtgtggactctcgctgcctcctcccccgccggattcggccggcggcgtggattcgcgaggggggggacctctgccgtcgtctggccgccaacctccgcgcatccgccgtcggaccaccggccgctgaggttgccatcgccatctgccgcaccgtgctcgtcgagccattcaccgctgttgccatctagaaaaatggtgagaaaagagaaaggggaaaagtaggggttaggaatagcataggctgacatgtgggtcccatttgtcatagatttataatggagatggtagataaagagactgatggagcaagcaacgagtttaactagtcaaatcagatggagagttggctatatgggtatttggagagtgggatttggagaagctgttggagatgctcttagcctaattagcaatgctactaatgctatttaacactccctcccctctctatctccctctatcgctctctctcgtatggagtgttttggtgttgcatgctgtccctgctgtgcataggctttgttagctagcaaggcagctgcagttgtaggtggtgcagctcagctgggggctgggcatacagccccaaaacactgtccttggcccccctcctgcacagattcccccttctgccaaacccagcaaaaggttcccttgtctagctcctctcatcacacacactctctctccctctccaatgcacaagtaggagatgagtaccacatgcatcatgaccactttattcctcccttcccagagacacagatgagaacaacgctgtctcacctttcctgctctctcacctcctttaccacctccccctttgtctttttcttatcgaaaaagaaccggtactatatagggcgatatattagtataacaagaaaattataagattacaatcagtattagaaaaaacaatacccattaattaaattttaactttaaaaaa

SEQ ID NO: 61255 - DNA, 5248 bp, Oryza sativa
  unsure (1)..(5248): unsure at all n locations
gagccttgattgccnnttgganaancgaccttgtaccccaatcagtattagaaaaaacaatacagattaattaaattttaactattaaaaacttgaaaaacctagacttatctgatattttaaggtaacctttatatataaaaaagttttcatacgaaatatgttatttaacagtttaaaagaatactaatgaaaattaagataaaagaaaagaacggagtctaagcgtgagggtcggggggggggggacctccccttcgtcctttcttgagttgcttcctcccttgtcatggcagctcttgcaaggaggtgagcaagcaagcagccccctgttgtttgtgaattctggtcacaaatcttttagttgcatgtcttgcgcatcttctctcttgctgtagctagcttccaatgtgcgtgtgtgtgtggtacgaacgggtacgtcccctctctactctgggtgtttctcacatcgatgtgtcacttttgtaggatatgtgtgtgccactgtgtggttcccctcgacttttgtttcccttggcacaaagaaacaaatgggataaaattagcggacaagaggcattttgtaagcttgtatcaaaatcggaagatatatgtagcacacgagcttaattatactcctccatgccctattcacgagaaaaaatatctaataattttaacatacatctaaacaaaattagaggtttggccttacgtggtacagatatacaaccatcgaccgtatactcacgtgcgcatgtacttctactctggatcgatatcggtcctgaggaaaatgcgagcctaacaatatattagtttctaatatgctttcgcaacattcttcccattcaaaactatataaatatatatttatatctcattatgtgtttgtccaaaggtgaaaagagaatgacaggatgcaattaataacttggggatggggaagacacgggaccggctgagtatatatagaacgatggcggatggatctcctctctatctcctgcctacgagctgctttgtttgcttgcaggatttttagctgtactttgctaggggatgccacaggcttctaaaaagtatgcccattttgttcccatgcgtttgttgcattccttggctgcattttttttttgtatggtttcaggcttgtccgcgagtgatttcagctactatgctgagtttgctgccttgctatacgtgggctttgtccgtttgctccaggtcttaaaaacagtgaaaaatccacggctctgttggttattacctctgcttctgtggcgtattaatcctctagctagctacctcaagctttgaccattcttaccctcgagtgtgcatggcctggcctggctggcaggccagtcatccttgaaagttgaaagttcttctcttttttttttcagaaacttaatttgaaagttgaaagttgaaacttgcccctctgatcacaatacaaaccttcgttttaacggtattcatgcactgatgcgatttctatgtttcaatgcatgtaaatttaatcagatgcttggaaagaaaatctaattaattcaaaattaaaaaattgacaattaaagtaagaattttttgacctaatattattgtttgctaaataacccaaaaatccttatatttcagaacgaagtgggtatattttaggacttttgatgtagtcttcgatattgtaggagtgatgttaagaatttatttttaaatacaaatctacgatacattctttcacagcgtgcttttataaagacttcctcgatcagaccttaacctctacgattttaacaaatccaatactagaactagcattaatgaagatatttatatttaaaatcaggccttaacctctgcgattttaataaatctattactagctagcattaaaaaatatttgtatttgaagtttttcgaattttacatgaaccatacatgttcaaaatggcatgtttttgttactgaaggagtatgtttttagccaatgtcctatgtgaaaagaatttggctatattggtttttgaattggctttccccttcagaaaacttccgaggaagcaaactaattaaacatcttctgaaaattgcgaaatgatgtccaatcgactgtttttaagaaatcatggtataattctggcctataacaccaactatgatgtacaattacatcggcatttgctaaatgtaaattaagacaaggagcaaaagaccaaagtaacaatttggagcaacattgtttggactcgatgatgatgataaaagttgtttatacttctttcgttaacgagggcacggctaagatatttcaccatcgcagatcaaaagtttctccaaagcaaattcttcaaacaaaaaaaggccgcttaatacggtgcggtggaggcctcgtgctgcaagtgtggtggtttttgagtggatgggcgacgaacttcaagaaaggttgcaggggttccaggcgaaagccatgtctagtagttcaccgggccggcaatggctacgccttcgggtgttgtaaccccctctagggcactgtcgaggattcatctcttccttggcgagtttctcgaggtgatggcggcgtctttgatgtcgtgatctctgtgggggcatcgttttagagtctcgtctttgttgttttgtcgtaggcctagtggcgatcggccacgtatagccgaggtcttttggtgctaggttcctctctcggtgggttgtgtttgtgtggttagcacgtggttcttagtcatgcactttggtgcacttctgacttcgatagtgtctgtcgattgttgtaatttttttcctttttaatatattcggatggtctccttcggtctttcccggtgaaaaaaagccgcttaagtcgatgccgtcgatggatctaattaactggtgtaggtcattgagagttttcacctaagttgcttgttctccaaaatgaccaaaaccatgccacaaattctgttggattgaactagaaaaggctagattttctaaagtctatagctcagtacacatattcgactattaaaattaagattattgtaggttataccgatcaaacagagacgtcagttgcggagacagggacggctagtagcatggcctcctcgaacaatacttctatatctatatttatattacctaattaaaaaatacgtaaggtttcgtaaaaaaaaatccgtccgtcttttttttctttttcgtccttttttgcaaatttttttcgtccgttttcctttatccggcggaaaaaaaaagcgtgcaaaataaccacatgcaaaaaaaaactggggaagaaaaccgcgtgcgaataaaccaatcggataaaaaaaccgatcggacggaaaaaaaccagcaagaaaacagcctattggacttttttttctcagtcctttttcaccctttttcttttttcttttttctgtttttaagtctttttttggcggtctttttttctgctcttttttcatgtgctttttaattttttttgtgggccttttttccggttattttcatatgtttttcttcgtggctgttttttagttgtatttttccgcacgcggtaaggatttgtgccatgtttttttcatcacggggcgaacactaacgtcgccgccatgttgatctatcttcccatgcgttccctcctccaattgattgccaaacatcaatcccccctactccctcaccattttcctcatgattttcccttttaactccgctgtaattcactgaatttaatctctatttaaaaatcaccggcttttttttctttccgtcctttttcaccctttttcttttttctttttttttctgtttttttcgtctttttttgtccgtcttttttctgctctttttccatcggctttttactttttttctaggccttttttccgggttttttcatatgtttttcttcattgctgtttttttagttgtatttttccacacgcgataaggatttgtgccatgtttttttcgtcgcggggccgaacactaacgtcgccgccatgtcaatctacctccccatgcgttctctcctccaattgattgccaaacatcaatccccctactccttcaccattttcctcatgatttttccttttaactccgctttaatttactgaatttaatctctatttaaaaatcacctttttatctcgagttttgtcgcttcgatttcaataaaaatggaaagaggagaactagtgtatcaaaaactctctaccaatttggaagatcgagaaagattcgactggatttgatgtgggggatttgaccagatttgatggggagaatcggggacctacagctccacttgacaaggaaggaaagaaatgagtttttgtccaaaaccaaataggaaaatatatagcaatctaaaaatgtttttacccgttgcaacgcacgggcattttttctagtatattgttaaaatacgtaaggtttctgtttttttgtccgtcactttttttttattttcatctttttttttccttttaaccgttcctccattttttttcttcgcttcttttttccttttttttcacccgttgtttttttctcttttaacgttctgtttttttttctttttcgccgtttgttctcgtcatctccaccgccatgtcgatcggtctccgcattctctcctttaattgatagtaaaaatcgattcctcactactctcttattattttctccataatttttcctttcaatgccgctttaatttaccggactccctcattatttttcccataatttttcctttcaattccgctttaatttaccagatctaatctctatttaagagttttatggattcgctcagattttgataaaaacagaagagtagaataagtgcatcacaaacccttaaccaattttagaagatcaataaagattcgatgcgatttgataggagatcagttctagcatcacactcttccgggctttgatggggaggatcagttctagcatcacactctttcgagctttgacgacagcagtcggctatatgagttgctataatgtatagtgatcgaaaatgtttttatctattgttaaagacgacagtcggctatgcgagccgggcctacanccttagttcccccccccccganaaannaanagaaanaaannaaaccnaacgcaccgcctaaccacaaaccacacccccccanagccgcacccccccaaccacaaaaacccaaacaaccccaacacanaaggctagagg

SEQ ID NO: 61256 - DNA, 2697 bp, Oryza sativa
  unsure (1)..(2697): unsure at all n locations
acggcaggtangaccntcgtcgngcncgcctgcaggncgactctagaggatcccctgcgtgccaccgtatcattctagcttgggatttgttcctgaaaaaccgcttcagccttggtattataggaaaataccacatcaccttagcaggaattcttttcttcaaaggttgtccgtcaacttcacctggatcatctcgtcttatcttgtatcggagtgctttgcaaacagggcatgcttctaggttttcgtactcaccgcgatacaagatatagtcgttcggacacgcgtaaatcttctgtacttccagacctagagggcagactgtcttcttagcttcgtatgtactttcgggcaattcgttcccctccggaagaatgttctttacgagtttcaataactcgccgaatgccttgtcactcacaccatttttaaccttccattgcaagaattctaggatggtactcaactttttgtagcccttctcgcaacctgggtacaacgctgttctgtggtccgctaacatgcgctttagtttctgcacctccttttcactttcgcagtcctcctgtaagtcccgcaatatttgaccaagttcatcagcaccgtcattcccttaacatccagctccgcctcgcccattgtgttttcttcaaatcccccatactgagcccagtcccgaatgttctcatcttcaactttatcttcttccattgcaaccccaacctctctgtgcgaggtccaacaattgtagctacgcatgaacccccactaaaacaggtgggcatgaatagttcgtggggtggaaaactctttctggtttttgcacttgtcgcatggacagcttataaaaccgtaacgcttgttatcattggccacacccaaaaaataatgcacgccgtcaataaactctttcgaccgccgatccgcgtacatccattgccgatccatctatatgaaatacatataaatcataattatacaaaatccaagatttacaaggtaattacataataatacaataattgaatataattattcatacaattaatcattattattaaattcattgtacatatttttcatgttttaattacattataaacaaatatttaatatgtttttcttattttaatattaaattagcttagttttataatttcatacaaaattatatgtaattattcaaacaagtatttataatcttctttattccctacacacactttttctctcatcagcttccatcacattttttagagggaaaaatatgtaaaaaaaatagctccaaatgtagatgctaagcaaaacaaagagtaggatgaagttactaaccttttgaagacctcaaatttgtatattaccaccaaaaaaatttgcttaaaattttgacagcacctccctccctcaaagcttaattttgaagcaatggctcgggctagaggaggaagaaggggtatataaagctgtgcaactttagtcccggttggtaacaccaacccggcataaagatctcaaatcactttagtcccggtttgtattaccaaccgggactaaagatatgatctttagtccccggtggtaacacgaaccgggactaaagatcccaagccccccgacagaggtctgacatgccctgtcaggagacgaaccgtctttaatcccggttggtatcgtcccgttgagtaataaacccgggactaataagccactttagtcccggttcgttttggaaccgggactattgtggaaatcggccgaccctctaaagacctcttttccagtagtgatatatctcaaggatctgtttccaataaaaaagaaatctcctctctctatacatacgtactcctccctctgtggtaagtacgtgaatttcctactttattgctagcaaccccatataaaatcttaagttactaaattatactcactctgtttctaaatattcgacacgttgacttttttaaacatgtttgaccgttcgtcttattcaaaaaattttataaaatatgtaaaactatatatatacatataattcaaatgataggaaaagaattaataattacttaaatttttttgaataaaacgaacggtcaaagatgactaaaaaaagtcaacggcgtcaaatattttggaatggagggagtataataaaccacaaagatgcagagaaatcaaaacattgaatatgttttcaacgtgcgtgctgcttgctttaatgtggttatccaaatagactaacctattcttgctagggattatcaatgcagttagcattaggtctgctacaaatgagggtgtgcacgtgttttcatcctgctaagctctactagatttatcttaatcatcaaatttgcgaacacatttaaatttagatccatggtgtctttaaaatacttaatgattcaaccgtggtaaacttctatggaaaagaataatttctagggcatgtcatcctaattaccattttaaaattaaaaaaaattatatactaaaggtatacaaacactcctatactaccacgtggtacgcctataaacactactaaaccgccacgtggaattataataaatcggtaaaccatcaattttcgactattagatttatcttttttttcttaaaaaaaaccacaatccacatccatcgcctgtctcccaccggcataactctcctttccccactggcccacccttccga

SEQ ID NO: 61257 - DNA, 7438 bp, Oryza sativa
ggccgagagggattcggcccatcgaccctgggggaggcaaaatagacttttgcggagggatttgatttggaaggatttggattcggaattggactcgacgatagatcggggatttgagatcttgagatggcacggacactagacaacaagcaaagaaacatatttcgcaattagggtttttaagagataattttcccgctaggcgccacgacggaacgggcgctacacggcggcggccccttcatcgtcgccaacaaggggctcgaggtcgacgccccacacgctcgtgcagaggttgtgcacgcagcgttcgtgcggtcccacgaacacaccgggcgccgcgtgcaggtacttgcccttgagccacttcagcttgtagtacaccttggcttggtcaatgtgcagggagagggagcccctgatggagtcgaagagcgcgcccatgtcgggaggcgtgggacatggacgagcgcgcgcggaaggtggcggcgccggcgaggagcacgacctcgtcggcattgccccagagcttctaaatggcacccccgtgctgccccacggcagcgggcgcggtcacctcggtggggtccgtgaaccgcgctgcctgctccaatgtaacatcctcaaattttaatctaaaatttgactgcatcatgctggcttttgacttgaattaatcttaatttagcaaaatcaaaatcctttttaaaatttcctttttaatcttcatttttggttcaagtattacccctttaaaattcctttaaacctaccctataccatcgtacccaaaaatattctaattactcccctaccctaaactctagtgagtttagcaaatttctttcaaaatttaaaatctagaaaccttctttaaattacccttatatttgttagacttagttatattacaaaaccctagcaaaaacccttcaaaaacccctagagaaattcttttctccttaggcaaatttgtcaaatttctgaatttcactgttcattgcacatgagctgctcgatgaaatgcctagcccggccctagcagcccagcatccacccaaatatttgcaaagtctagaattgatccttgggggaccacacccatccaaaactgtggcctctctttgcctttccaccccctgccatgctgccttggtgccctgcgcgtcgtgccgccgcagccgccgcgcgtaggctccacgaccgcccgcgcgtgcccggccaccttggcgcgccatccatctgtccagtgcgcctcaaccaaccgtcgtcgcacaaatcttgtcaagacaaatccgggacggccaccgccacagctcgccgccgtctgccgccatgcgcgcccacccgatgtcgacgtcgaagctgacttcgcctctaccggggatgaaaccctccaaattcgccgccgctcatttaaacacaaaaggtgtaactaactttccctctctcaactcgaaccgaacgccgccgagccggatattttaccccttgccgccgccgcgcgtcgagcccgggaggacgccagctcaccgccgctcgtcttcacccccagttaaacccaaccgtcgtcggtaaatatctgaacatgatctcccgccactcaatttgctcttcccttccctctcacagcctttgccatccctgccaccccttaactccaagctcatccatggcggcattggtttagggaaaatgaagagtttgctttagggattactttcaatttgtcaacattgatgtgcttaagggctttaatagaaaaatcaacctcagaagaattatttcccaaagagacctcaatacggtttaaagacgaacaaaaactaagttgagaagcggaacaagaacttgtaaaaggctcattaggtgtaccttgaggggaagccaacaaggccggccttgccccataaggggcaaattgatcatccagattgatggctgctttcctcttcatcgctttcaacagagagtcatcatcggccgaagcgatgccgagggctgtctcggagttggaacgatcactgcggcgtattggtgtcatgttcggcgcaagcccgacagccactgcttcattgctgccggtcactggatagtgcgaaccagcgtgtcccgaagacttaagaagcattgccgcggtcatctccttttcaggctgcgccgacaaaaccatatcaccatccgctaccgtcaccacttgctcgccagccacctgctcgctacccgatatcttcttgtcgaccaaagtcggctttgtcagcccgacagtcgcccatcctgtggcttgtgcgtgctcccaaacaggggactgggaggagaatgaattggtgcatgtgttcaattgcttttacttgaaaactggattgtaatgaggttgagctaaaatagtttagaatcaaatttgtccaatagagcaggcgagcagcagagtggatgtgcctctaataattgaatagacaagaatgcagcaaatttcaagaaaattttcaatgatccacctagcagcacagcatcgtttcactagacaagtatatatacaagattatcccctcctccttttccgggcttgggaccggctatgtcattaaacacctcaagtgacataggcggagttacctacacacctacaagaagaagaagaagaagaagaaacacacaaatcattgacctctcagagccactcgttgacctccagctcatgctcatctccatggagctggcggtgttgctccggaagcccagggatccacagctgagagatctcctgcatacctttttccagcaatagccactccaaaccacccaactcctcgacatgcctcaaattcaggcattcatttacaaacagctctctcacttggggaaggttggagatcctctccaggccttcacatccttcaacttgaaggaaaccagagaggaatgggaggtcctccaccgtcttcaagcaacttgtgcatcttataaagaactccttcaagttggtggcctgctgtccaagctgtggtgggagagccctcagcttggggcagcccacaagttgcaacctcgtcaaacaaggcagcagccatgacgaccttggagttggagacggggcttcctcccccttttgcttcgaagcagcagttccatcctctcccccttccttggctgctgcagctgcttcctcctcctgcacttcttcttcttcaacaaaggaccacttgtcagactcgtaagaagaatggaggaaatttcagaaagttcagagtttcggttaactgaagatgcaaaggagggagaaaacgtttcatcctgggtaatgaagatctaagagatgagacaaagccacgtgttcgagagagggatccgacggtgttaacgtcatgagaagccgctgtagctatcaaagcttgtcgttttgctctttacattcactgtaataattttagctgctgtaaacttacttaagctggcttttgctgtgggaagaagataagaagaatcacaatttctatttgtcttaggagtagctaacttagaaccctaggagatagtcttgcggcggccacccaaatcctaccaaaattcacaaatcgctactctgtttctccatttctggttcagggttctgacagaggtatcagagcacgagcgaatccttggctcttggatctctctggtgaaggttggtggaaggcggcggcgagatccaccgtaaaattcctgagctaggagggattcaatccggaggcgagtggtgcttcagatcggacagcaagggttgggttgccactttcgtggtgtgcacctgtaaaatctccggcgcttctgatttgaggttggcggctgtagatccgactgcaggggtaataggggaggaatcttgaattctgaacctaacctgcaggggcgaaatggtgaccaagatgcgctcaaacgatgagattgtgggactggaggagatgaacgagtttcgctcagatgtggcatctctgaagaaggaagtagtagagcttaagggcttgaggtcagaggtgaaggagatcaagggccttctgctggagttgtgcaaacagaaggggaacgagggacaggagaatcctgtgggagatgctgcagcaaaagagaagagcacgggagaagcaggacccagtcgatctgtgcaggtaaccacgcctagtttgggagttcagttctctattgagccaaatactatgagcctatctgcacctatgggtcaagaagctagaccacaggggggagtcagtagtgttcagacagatttggggcaggtgactactgtattatcaaaacctccaccattcataccatttgccccatttccaaaccagagggtacctttcttaaactcagctccttttcaaactcaaacaacagttgggggaagagtgcccaattcaaattttcaaacacaagggacagccactagctcaggcactgggcaacaaggggttcacatattagatcatagcagacctggtggtatggtttatcaaggagaaaatcaacattatgctgaagctgtaatcaagggacctcggttggaaataccactgttcacaggagaagatcccattgactggttgaagcaatgtgagaaattctacgagattactgggacaccatatgatcaatgggtcaatctggcaattgcacatctgcagggaagagcaatgaagtggtttagaggagtaggtattccttggcagttgattccttggccacaatggtgtcacatggtgagcactcgtttttcggctgcaaatgagcatgaggcagtggaactattccagaatgttaagcagtatggttcaactgtggaacaatatatagataaatttgaggagtatgtggatctagtcaggagggaccatccttacttacaggaacagtatctgaatagctgcttcatcggtgggcttagagaggatatcaagcatgatgtgtgtgggcaaaaaccacaaggtctgttggagtcctattggtatgcaaagaactatgagaaggcagctaatgcaaggaaggtggcactgaatttcagcagaaacagaaatcagaacaccaatttcaacaatcttggcaggaacgcaaataatagaccacaaaggggtgatggtgagaagaaagaagacagaaaatgctggttttgtaaggaaccatggtttcctagacaccaatgcaaggtgaagcaagctatcaatgctttactggtagagaatgaaccttgtactgaagaggaggaggatgaatcaaaagagaaggaacaagaggagctggccactgaccaaatagaggcacctaagcaggagggagcacatgaggagttaatgagtgtgtcatttagtgcagcttctggcacaactcggcctgatactttttcagtcctaatcatgatcaatgggaaacaagcagttggtctaattgatagtgggagtactgggactttcatgacccatgagtttgcagttaagtgcaagtgtcctatagcaacctcgactattaagaaggtgatagtagcaggaggaggagaattgaaatctaatcttgtagtcccagaagtggcatataaaattcaaggggtgaaatttgttaatgctttcagcctgatcaccttgaagggatatgatgtaatcttgggggcagactagatttttcggcatagtccaattactttggatctcaaacagagggaactgtctatcaccaaggaaggtaagctagttgaatttcaggatttcactaaacctgggaaacatttcttaattgatggtcataaaatggagaagctgataaaaaagggagctgtggggtgtgtgttacaagtgaatgcgatgactgaagaagagaggaaggaggaggctgcagtgccagcagatgttcaggaagttttatcacaattcccaggagtgatgaaggagccaaaaggcttacctccaagaagagcttgtgaccatgtgataaacttgaaacctgggtcagaacctcccaaccagagaccctatagagtgccacattaccaaaaggaggccatggagaacataatatcagatctgatccagtctaaggagattaggttcagtgacagcccttatgcctgtccagctataatggttagaaaaagggatggatcttggagaatgtgtgtagactaccgacagctgaatgcccagacagtgaagaacaagtttcctatgccaattatagaggacttgttggatgagttacatggggctagaatattttctaagctggacttaaggtcgggatatcatcagattagaatggctgaggaagatattcctaaaactgccttcaaaacacacatgggtcactatgagtaccaagtaatgccttttgggttaactaatgcacctgccacttttcagtcactaatgaaccaagctctagcaccctttttaagaaagtttgttcttgtgtttttttatgacatcttgatttatagcaaaacaagggaggaacatatcaagcatatcaaggcagtattgcaagtcctggagaagaaccagttggtggtacggcttaagaagtgtgcttttggtctgagcagtgtggcttacttgggacatgtgatatcttctgatggagtggcaacagatcctagcaagatcagtgatatcatgaatcggaaggaacctaaaaatgtgactgaagttagggaattcttggggatgactgggtattatagaagatttataaaagggtatgggttaatctgcagaccccttcacgacatgttgaagaaaggaggtttcaattgggggttagctcaatctgaagcatttacagagctaaaagggaagctgtgtactagtccagtgttagccttaccaaactttgagcagccgtttgtgattgaagcagatgcttgcgaagttggtattggagcagttttgatgcaggcaggaaggccaattgcttattatagcaaggctctagggccaaaagcagcagctcagtcaatttatgagaaagaggctatggctatactagaggctttaaagagatggaggcattatgttttgggtggagaattagtcatcaaaacagatcagcagagtcttaagtacatgatgaaccaaagactggtggaagggatacaacacaagttattgcttaaactgatggaatataattacactattgagtacaaggctggtagggagaacttagtagcagatgccctatctaggagcccgaaaaacaaggaagaagtgactgaactttgtgcagctattgctgtggtggtgcctgagtggatactggatattaaaagaagttatgaagaggatgttcaagctcataagttgctgagtttaattggcacagcaggggatccagaaggggagtataagtttgaggctggaattatgaaatataaaggaagaatatatgtgggggaaacaggagaaatcag

SEQ ID NO: 61258 - DNA, 8538 bp, Oryza sativa
attgttgggactgggggagttggtaagacaacattagctcagaaaatatacaatgatagaaaaataaaaggaagtttcaacaaaaaggcctgggtttgtgtttccaaagtgtactctaaagcttctcttttgagagaacttcttcgaattatggaagttcatcatgatcaagatgaatcaattggagagctccagagcaagcttgaaatagcaattaaggagacaagttttttccttgtgttggatgacatgtggcaatctgacgcatggacaaatttattaagaattccgttgcatgctgcagaaatgggagcaattctcataacaactagaaataatattgttgccttagaaatcggagtggaccatacttatcgagttgatttgatgtcaaccgacgtaggatgggagctactttgcaagagcatgaatatcagtgaaagcatagaattgcaaactctgcaggatgttgggattgagattgttcgcaaatgtggttgccttcctcttgcaatcaaggttattgctagagtgttagcgagtaaagaacaaacagagaacgaatggaaaaaaatattgagcaaaaatgcttggttcatgaacaaccttccaaatgatttgagaggtgctttatatctgagttacgatgagttaccacgtcatttgaagcaatgctttctttattgtagtgtatatcctgaagatgcaaacatttaccatgatgatcttacaaggatgtggatcgctgaaggctttatagaggaccatggaggtcaactactagaagaaacagcagacgagtattactatgagctgatccaccggaaccttcttcaaccagatggtttatattatgaccacagcagctgcaaaatgcatgatcttttaaggcagcttgcttgttatttgtcaagggaagaatgttttgttggaaacccagaatcattggtaggtaacactgtgtctaaacttcgacgtgtttcagtcgtcacagataagaacatggtaatgttacctagcatggacgaggtgcaatataaagtaaggacatggaaaacttcttatgagaaaacactcagagttgataattcatttttcaagagatttccttatcttcgtgttttagatttgactgattcatttgtaccaagcatcccaggttgcatcgggaatttgatccatctacgtttgcttgatcttgatggtaccaatgtatcttgtcttccagagtccattggcaacctgaaaaatcttcaaatattgaacttggagaggagtgttgctttgcacagtcttccttcagcgatcacccaactgtgcaatttaaggcgccttggcctcaattattcaccgatatatcaagttccaaaagggattggcaaattggaatttctcaatgatgtagaagggtttccagtctatggtggcagtagtaatactaaaatgcaagatggatggaacttggaagagttggcttatctttaccagctaaggcggcttcatatgattaaattggaaagagcagcttaccgcactacttacccattgttaacagacaaagggtttctgaaatttttgtatctatggtgtactgaacgtacagatgaaccatacacagaaaaagatttcagcaatattgagaagatctttgagcagctaattccgccgtgcaacctggaagatcttgctattgttaaattcttcggtcgccagtatcccttctggatagattctacccatttggcttatgtaaaatccttgcatctcttcaactgcaaattctgtatgcaccttccaccagttgggcagctacccaacttgaaatatctaaaaattgagggagcagctgcagttaccattattggacccgaatttgctggccacagggcgagtaatcttggacgaacagttgctttccccaagcttgaagagttgctcattagagatatgcccaactgggaagagtggttctttattgatgaagcaacgtcaactgctaaggaaagggttgatgatggagattctgcaataccaaaagagaaagcattacctccaaggatgcagatactgtcacggttgaggaggctggaactttctggctgcccaaagctgaaagctcttccacagcagcttgcacagattaacagtctgaaggagatagagctaagatgggcaagcagcctgaaggtggtggagaacttccccctcctctctgagatgcttttgattgcgacatgtcaagccctggagaaagtctctaaccttcctcaagtgcgagagctgcgcgtgcaagattgtccaaacttgagacttgttgaggatttgagcactttggagcagttgtggctttatgaggatatgcatgaggtctctacattgtgggtgcctgggcttcaacagcagtgccggcaacatcatggagaggatcttgaagtctacaattggacatagtaataatgtatggatgcccaaaattatttggacgcttcagttgtttgatgcaaggtatgtgattttatatactctggattcggattgcgcccattttttggcgtgctattgtgtacatagatatatattttttgctttaccagttctcggtcttgaggatgaaaggatctagtactttgtaatatcggatattacagatatgacaataatcccaaagatatggcagtataagaactaaaaaactgtacttctagtttgttctggtaatcctctattaggttctgcaacttccatgcagctcattatcagcacatcgaccttctactgagcaggaatgaatgaatggatcaacgggtagatggtaggagtaccagactgactgtgtgtatattcagcaaatttagtctccctgatgtttacagcctaccttaactgaatttcacatcagcaatgattgcgtgcaaggccctttttcctccaccagatgatgcttaaggaccacaaaatacatgtatatctcgatgaaccgaaaataaaagcattccctccattatccaacatcgttttttatcgagtccatccttctccatttaaacactgaacagaacagcttgttactctgtcatcaggagagatattatgaccaatacccccaggttttccccttgttattccgtattgttgaattaactgtagttttgatgcattcatgtgttatgcagggggatgctgatcagtgccccttttggatacttcaaccttcctaatgttccatgtaagctgttttcctaatttctcccattgtaatctgctctactagcaatggcttatctgctgcatctcctgtacaggattcagaactcaagttcttgccgcaaaatggtttctgtacacacaaaaatggctaaaatttcaaatgccaactgcgattaacagcagattgagttgctgatggaggtgaaaactcactatgctttagagttcgctcccaaatcatcaaccctcttatatggactccgaaatcagaatctgagttttgtgttcagttatttcagttcagtgatctagtttcatctcaactgttccgagtaattaacaactggagtagaaattatccttcccctgaactgaatcacaaatgcatcgcaaagcaatcaaagctgtggcgaaattcatctatctagcgacgagaagagaggaagggagggaggcgtcacgtacctgggttgaactcgaggaggaggaagaggccgcggcgtcgaccccgggcgccgtggcggcgaagggggcccatggagcgctccaacttctcctccgtcggatctctgtcgctccctgcggcccaccctccagctccgcctccgcctccgctccccgacgccatcgccgaggtggggggttggatggccgtaccaggcgctccacgatgtacctcactcactgactcatcggagaactcgcccgcagcaatggtagctcccttctccaccatcaacttcgccactcgtcggagcgccgccgtcgccgtcggcgaccaacgcgcccttttccaacgacaatacgagataatccgagggcttattcgaaaatgatcctccaatgctcaggcgcccttagatatcccggcccattaattagggcccacacgtcatccgcaaaccccttgatggcccataaaatatgggctccacgttgcatcccgcccatgttcacttgcagcacgttgggctgtgaaagggtccaaagtccaagtatcgccccagagacggcccgtacactttgggcctcacattgctcctgccctgcgctgacgggccgcatgtccgcgtagtatcgtcccggcccacaaattaaatggaatcgcttgctggcctacgcccattagtcggcccgaccgcaagagcgatagtctcctggatgatagaatccgccgccatggcagccgctcgccggagctccgccgactggccacggagctcctctccggcgaagatttgcatcacgtaggttcttcgagtcttccctttccataatgtgctttggctctttcatcttcctctctctgtctcacagatcagacaagtgcaaatgagagatgctgtactgctgagtaagcttcagatactgttgtgttaccaaaaattatctcgggaaaccaacacttgacgagcatgtcaatacctattgatgagagatgttgtatgtactgctgtttaagctatagaacctattgatgttatacagatctgagtgcattttttttctttgataatgtcaggtgtgagctcatgaaactgggattgtgttctgttcgtagcatcctcttctttcattctttgttgtgaatcaatggtcctgttgaagtcaccaattggatgctttgttctctatgttctgcttctgtagctggatgagtatcagtcactgtatctgaacacatacagagtgaactctatggtttcagagcaggtatgttccttctttgacatggtcatcaatctgaaagcatgtcctccactagcatgtgcagtagtatgattccatgatggaggaaacaaaacttaatcatgtgcacgtctttctttttcttttctaatcaaagtgcgcgcctgctttaacaccatggactataatattcacgtaaactaattataatcacatcaccacgtacgtccagtgcgcttcatgcagccacggggaagctgccttcttccaggtcaggattgtcgatcagagccaaaccaagcagtttgttcagagttcagaattacatagaaactactgaaatctgaatgctgaaaatgattttgttgttgcatgcaggcacagcgaggggaaaggaaggcatgacacttatcttcgtgtgctgcaaccccagctgcaatcacagatggagggagtgacatgtaaattaattgtaattaatgctactattatgctgcatgtaaaggcaatagagctttgcattatgccatgaattggtatatgtttactagtcaaatcgagggataagacgacaaacaatgagtatgagatgccattgagcccgtgacggaggaaacaaaactcaagcatgtgtatgctcacccctttgtaaaggcaataaagcacgcagctggtttcacatcatggaatcttggaagcaaactctaaattaatcacatcgaaataaactgtaaactaatcacatcgccagagcccaggcgccagctaatcgttgcaatatactattgcagctgttgatcagtgccctagaatatgtgagtgtagctaatagaagtacgaaaaggaaaacgcaaagttccctactaatctgtaaggtctattagtaggaattaagtactctctcaggagcctcaccatttgcattctaacaaacctaacgttttgacaaagaccattgcgtttccatggtgttactagaacaattgcttcagcgctagtgtgcaggaaatcaattaccatttagtgatgattggggatatgaataagaaaaggagtagccatagctaactatacggttcatgaatatacacaaaatgttgggttgtgcagcatagacaagtggacaattacttaaaatttggtcagtgatagtaacatgggaaagataaaagaaaagaagagtggttcagcagttgtctagctagtctgaatgttcagctatacaatatatgtaaggccttaccaccttgcctaaatcactccctagcctcctgcagtactgttgctttgttccactgtgtcgcattcttacactgcatttctaccggctgtgggtaagctcaatacatatagctgaatttacttcctttatttccttaagttaatccgtaaatgctcatcttgactgcagggcacggattttcaacaggatcagttgcgtccatttctgtctgctttctgattgattgagatgagatctactaggaaggaaaaatctgcttcatctgagtaatcccatatatactgctcttcttgaagcactccttgatcggtgaatgtcaacacatcaaccagtatttctggtactctcccgttgattcttctagttaaccttctgaatcatttcagttgtacatatataatacacacttcacttttcttctgtcccctttttgcagttgtagcagtgcagtctgcggttctctcttgatgactggctcataatgttctgaaatctattctatactctggcttattcaatcagattcctttggtcttgattaatctcagtttattgagatcttaagcacaagatgggaccgagcaacctgttaacctgtgcaagatggttgctactatactactgatccttgttatgtaccatatgttatttttgtgctgaatgatcgctctgtaaggtaagatttgcatcccggcgaaaacgaaaaaagatttgcatgtgtacttcaagtttcgaatgcatcattctgtgatctttttttgggatgcagctagtagagtagtaggtagggaggtgtatccgccatgcaacttttaggttttcatgtgtgaagctacctaaataatatagaccctgtttggatgcttgggctgtggttacataaccataaatgtcaattttgctagccattagactcaacatgcacggtacaccgaattaagtggaaactcttatacaaagaatagatggataatatatttactgaacttcatcttgcattcatattttgtcagccttatctaacttttaaactatgttaacacaagtttggttacatgtcaggctgcattttttacattgatcaattatatatggtggattaccccttttgagtttgtcggatggcaacaatagtagacacattggttggatcatgcatcaataagttgcaagcgatcattacagacaagacaatactcattttaggggtaaaagatgagcttgaagaactgcaacgaagaacaaacgtcataagatcttctcttcaggatgctgaggcaaggaggatggaagattcagtagttgaaaaatggcttgaccagctaagagatgttatgtatgatgttgatgatattattgatttggctagatttaaaggaagtgtcctactgcctgactatcctatgtcatcgtcaaggaaagcaactgcttgcagtggcctttcactttcgtcctgcttttctaatattcgtatacgtcatgaagttgctgtaaaaattagaagcctgaacaaaaagatcgataacatttcaaaggatgaggtatttttaaaactcaaccgcagacatcataatggaagtggttcagcatggacaccaatagaaagctccagcctagttgaacccaaccttgtgggcaaggaggtcatacgtgcttgcagagaagtggtggatttggtgcttgcacacaagaaaaagaatgtttacaagcttgctattgttggaacaggaggagttggtaagacaacactagctcagaaaatattcaatgataaaaaattagaagggagatttgaccatcatgcatgggcttgtgtttccaaggagtattctagggattctcttttgagacaagttcttcgtaatatgggaattcgatatgagcaagatgaatcagttccagagctccaaagaaagattaaatcacacattgcaaataaaagtttttttctggtgtcggatgatgtgtggaactctgaagcatggacagatttactaagcactccacttcatgcagccgccacaggagtaattctaataactactcgagatgacactattgctagagtaattggggtggaccacactcatagggttgatttgatgtcagccgatgtaggatgggagttactttggaggagcatgaacatcaaagaagagaaacaagtgaaaaatctacgggacacaggtatcgagattgtccgcaaatgtggtggcctacctcttgcaatcagggctattgccaaagtcttagcaagcctgcaagatcaaacagagaatgagtggagacagatattggggaaaaatgcctggtccatgagcaaacttcctgatgaattaaatggtgctttatatcccgggaaaccaacacttgacgagcatgtcaatacctattgatga

SEQ ID NO: 61259 - DNA, 15790 bp, Oryza sativa
ctgcccctctgctcttcagctgtatatatgcagctattctagcatttgatagtctccttagttgttcatgtcgtgtgcattgactgattgtttaatgatttatatgatttagttttattttcatttatgctgcatgtaagcatttcatcatggtcaagattttcataaaatggtggatatacattgacaaattcattagttgtccatttctttaatcctctcgtgatcttattaacatgcgtcctgtacatacggtgtattctagataaatgaattgtcctatatgtactacaacataatcatgtgcaatagtgttcctagctctgcagacaaagatagagattacttctactccaaaagaaaattgtatgggttatatcaccaaacaatgctatgatggcattgctatattcactatatgatagtagtaatatcacaaatgcatatatccatccaaggacttggggacaacataaatggtttagcatttggtacacaggctgcataagtgcacgactaaacataatggacttcgctaggccaagagataagtaatccttaattcagctcttgaatgtgctagctatgattggccgtgtacatccttcgggatgtagaggccgggttttatttaatccattatttaaaaatgcgctatctatgacgaagaccagatcacgtgcatttagccttcaagtctgcaagtgtgttctatgtcatatcaatgtgcacatttagtactcagtatcttataaaaacacaaatacacatgaattttcgcaagacattaggcaatagagtagtttttttagatttcacaaaaaataggtcaggcccaatgttacagattccttgcagcctgtgagcaggatattgaagatggaagggttgtgcccaacatctgttcctagtgtagggctcctaattaaggtttgtttggtgaaaaaacaaaagccacctaaatgtctttgtattggttcaaattgattaatatttttgttcgtattacatctgttataagcagaggatattgccgagcgacatgcctatgtatagtccctatgtgtcttttccttatactttttgtaattcacgtatgatgtttggtaagttcaattgtagaaaatagattgttgcaaaacggatgtcacttgtattttcttttccttaattaagttatttaattaccaaattgcttatgaatatacatccatgattaatttttgtgcgcttatttgtgttgtaggttaatcttgaagaatttgggctgcagtcacctgtaatctgtacttttgtctttacctagctactggtctttgaaatatattaaaaaaattaaaaaaacaaaaatatcaaaaaatgggaaaatgtcaaaaaaaaggttatattttctttagctcttgtaaaatacatcgtcatgttttcttagatgtgtgcgtttcttttctttttattttttttattgtaggtgtgtaggtaactccgcctatgtcatcttaggtttatctgaatgacatagccggtcccaagcccggaaaaaggaggaggggataatcttgtatagatgttggttgaaatgacgctctcctactatatagtagatcattgggatttttccgtacttttatcagattaatttcattttcaatgatggaatagttatggagacacttctagagactcatccagtcttattttcaatgacggaatagtctactgctaccaggtctttgaaagttttcttgaaactgcacctttgtcaggctactgcattttttttgtgatggaataattatgaaaacactttcagaggcacatacactctgtttctctgttggacgaacctgagttggaaaccagtttagtttgagctcatttcaaccccttctttcaccagaagcaattgggctaaacccaagcaccaatcattctcctgtcagtccttaatgacaagcctgcaggacaaggaaatcaatgaagatcactgaggcaaaaatatatttatcctcccatcatgatagaaactgattgtgctttgtgaattgtgatcgagaggagaggaaatggtggataaccttcctagtcattcctttgtactgacaatgtttcagtacttgaggaaatctcagtgatgatacctcgtattgacaatcaatacctgtgttaatagatggatacaacacatctttgactgaaatttgcatcggcaatgattgtgtccaaggctctttctccaccagctgctgcttatgtgggatggaacccatgtataacttgaggaagagaagtaaatccaacttttgtttatttcattgaattcatcctttttccttttgaacactgaaaataacagcttgtatgtctttaggattggttcaggaaaatgttattatgacagtgcactagcttttcaccttgttatcccattacattgttaaattaaccatggttttattgccttcgtattttctggacggggatgcaaaccagtgtcttcttggatacttgcatcttcctaatgttccgtgtaagctgatttccttattttgcatagtgtaatgtgttctactagcaacgatagggtttgagatattcggttttgacatttcatttgatggcatttgatcattatgttcaaagatgctcactactgatgctgtagagctcactcccccaaatctgcaaccttctcatggactctgaaattagaatcgaggtttgtgttcattcatgtacacaattgagctattcagtttgaattttcatctgaatcattctgtgttcatctacaacggacaaattattcttatcgtgactgatcaacgcagcacaaagcaaagcacagctatagcgcatccagcgatgagaagaaaaagggggaggaaaacgaggggtcctgtacctcggttgtgctcgaggttctccggcgccggcgacgtgggactcggcggcgatttacctcgtcggagcgctcgctcgcttgccgtcgtcgcatcaacggcaatataaacatataatgtctccctgactcgtggggccacttgagggcaagaacgcaagaacgacgcgtgtctctcctgcttgagaactaaccggcagccgctcgccggagctccctccggaaaccccaaatctcggcgcccgtatccagaggcggttcgtgtcccgttggttcttgggctcctatcctcgttcagatcagggaggctgttcagttcttgtttatccagcggggcgcagcgaaatttacagaggaatctcaatctccaaactggtaggaagagagtttggtcgatagaagttgagctcttgtttgttcgttggtctgcagagttcactagttcagataatcatatcatcaacaccatgaattgaaagagatgctgcactgctgtttattgtgttcactgtttaattcatagcatccatcaaacctgtatctgtttgggagaatgttcgatcaatgctacagttggaatcaaattcaactcaggaccaaattcgtgttaggcaaatattcatgttcaatctgttaatacgtttaactgcagttctcaacatctcttgacgaggaagcagggctgctgctgcaattcggcctgcaattcaagtgcagcaatatgttgtgtgcaatttgtgcattagtgcacaagttgagaatggtaatattatttcactcggaagagatggaacagttgcgaaacgcagaaccactcggttcagaggagaatagtcctggacaaaaggacagaaaatggtccaatggtgagcattgatcatttttacagtgaatggtgagcaactgatcagcatcaaccatggtgaagctgaacctgataagtcgacagcactaggggtgatgatcctagccacccataaatcctttcttgtatgtttcctaacatatataagtcagcaagtcaaatgttcttatcgttttctttagtcgatggttcatcgattctgacatcaagacaagaagccaacatactgctagccatgttactttcctcttggctcacatacggccatttgaatggattagattcagaaataacactatatctcgtctttctttcttacttacatgagttgaaatattcttggcctttttttctctacttactagggcagaattaagattttgaagatgagctgcaccccaatccttaagagatactaggaggtactccctccgtttcatattataaaacgttctaacattgctcacattctagacacacacatatatatatatattgattcattaatatatatatatgaatatgggcaatactagaaagtcttataatatgaaacggaagaagtaccatattttctaatgtaaaatttggtatttctcgataccttcggtattaggaggtctttctttctctatttactagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttgagcaaaattaacaccgcaatttgagccggttacttctttctcgtttgcctgttgatacaaagaagccaccgaaaggtaaaccccttaatgatttcagttcttcagcttcagtaatcagtatatacttgctcaaaacagattgcaaaataacttgctagctacaaagatactctgaaaccaattcaacttttgtccattttcagacggtattactcttgcatgatttaattggatatattgcttacgccaaaaaaaaaaacttggatatattggagcatcaccctcgacgagtttctctatggcaaccatactggattctttgattggatcatgtgctaagaagttgcaagagatcattaccgaggaggcaatactaattttaggtgtaaaagaagatcttagagaactgcaggaaaaaatggaacaaatacgatgctttataagtgatgtggagcgaaggggcatggaagactcatcaatacacaattggatttctcgtctaaaagatgctatgtatgatgctgatgacattatcgatttggttagctttgaaggaagcaagctattaaatggccattcttgttcaccgagaaaaacaattgcatgtaatgggctttcacttctctcttgcttttccaacattcgggttcaccatgagattggtaataaaattagaagcctgaacagaaaactagaagaaatagcaaaggataaaatatttgtaacacttgagaatacacagtcatctcataaagattcaacatcagaattgagaaaaagttctcaaattgctgaatccaaccttgtggggaaagagatattacatgcttctagaaaattggtgagccaggttcttacacacaaggaaaagaagacttacaagcttgctattattggaacagggggaatcggaaagacaacacttgctcagaaagtattcaatgatgagaaattaaaacaaagcttcgacaaacatgcatggatctgtgtttctcaggactactccccagcctctgttttgggacaactacttagaaccatcgacgctcaatgcaaacaagaagaatcagttggcgagctacaaagcaagcttgaatcggctattaaagataagagttattttcttgtgttggatgatgtatggcagtctgatgtgtggaccaatctactacgaactccactgtatgctgcaacctcgggaatagttttgataactactaggcaagatactgtcgctagagaaattggggttgaggaaccacatcatatcgaccaaatgtcaccggctgttggttgggagctactctggaagagcattaacattgaggacgagaaagaagtgcaaaatctgcgagacatagggattgagattgttcagaaatgtggtgggctacctcttgcaatcaaggttattgctagagttttggcaagcaaagataaagcagagaacgaatggaaaaagattttagctaattacgtttggtccatgtataaacttcctaaggaaataagaggtgctctatatctaagctacgatgatttaccacagcatttaaagcaatgttttctttattgtattgtatatcctgaagactggaccattcaccgtgattaccttatcaggttgtgggttgccgaaggctttgtagaagtgcacaaagatcaactactagaagatacagcagaagaatactactatgagctaataagtaggaatctcctccaaccggttgacacatcttttgatcagagcaaatgcaaaatgcatgatctcttaaggcaacttgcttgccatctatcaagagaagaatgttatattggagatccaacatcattggtggataataacatgtgtaaattgcgccgcattttagctatcaccgagaaagatatggtagtcatacctagcatgggtaaggaggagattaagttgagaacttttagaacccaaccaaatccactgggaattgagaaaacatttttcatgagattcacgtatcttcgtgttttggacttgactgacttacttgtggaagaaataccagattgtgttggatatttaattcatctacgtttacttgatcttagtggaaccaacatatcctgtcttccaaaatctattggtgctctaaaaaacctccagatgttacacttacagcggtgtgaatctttgtacagtttgcccagcatgatcactcggttatgcaatttaaggcggcttggtcttgatgattcaccaataaatcaggttccaagagggataggaagacttgaattcctcaatgatttagaaggatttcctgttggaggtggaagtgacaatactaaaatgcaagacggatggaacttgcaggagttagctcatctttcacagttacgccggcttgacttgaacaaattggaaagagcaactcctaggagcagtacagatgcattgttgctaactgacaaaaagcatcttaaaagtctacatctatgctgcactgaaccgactgatgaagcatgctcagaggaaggcattagcaatgtcgagatgatctttgagcagctaagtcctccacgcaatttagaagatcttatgattgtattattctttgggcgaaggttccccacctggcttagtacatcccttttatcttcactgacatatttgaaactcaaagattgcaaatcttgtgtgcatcttccaccaattggacagctaccaacttgaaataccttagaattgatggagcaagtgcaatcaccaagattggacccgaatttgttggctgctgggagggtaatctcatatccacagagacagttgctttccctaggcttgaattattggctatcaaggatatgcccaactgggaggagtggtcctttgtcaaagaagaagagttgcaggaggagaaagcagctgcagcagcccaggaagggggaaaggatggaactgctgcttcgaagcaaaagggggaggaagccccgtctccaactccaaggtcgtcgtggctgctgccttgtttgaagcagttgcaacttgtggagtgccccaagctgagggctctcccaccacagcttggacagcaggccaccaacttgaaggagctcgatataagaagagcaagatgcttgaagatggtggaacacctcccattcctctctggtatactttttgttcaaagttgtcaaggcctggagataatctccaaccttccccaagtgagagagctacttgtaaatcattgcccgaatttgaggcatgttgagatgttgggtggtttggagcagctatggctgtcaaagaatatgcagaagatctcttcactgtgggtcccagggcttgaggagcaacatcgccagctccatggagatgagcataagttggaggtcaacgagtggttttaagagccaattaattagatggcacaaggtatgtacactaattggttgggatttttcactggaataaactaatcattgggttgtacatccatgcttcttctctgctcttcagctgtatgcaactactctagcatttgatagtctccttagttgttcatgttgtgtgaattgtgattgtttaataatttatatgatttagttcttttttcattgagtttttctcccggccttccttttgtagcacgcggtactggtactgtgaggtaccagtctccatccggccgttgattgctgaggggtacgatgggtatcacgtgtggtccaaatagcgtgtgtgtctcgatatctctcgctttcccttctccttctgcatctagcgctgccgcagggcacatgagaaaaaagtcgaggtgaaggtcgaccccatcggccgcaccgccgcaggcagacgcagcaagggcgatggcatccgcaatcgtcccagaatcgtggccgctgcagttgtcctcgccagcgccacaggagttgtcgctgccgcaggtgtcatcgctgcagccgtaggtgtcatcatcgcggtcacaggagtcgtctcggcgccgctgcaagggccgtggctgcagtggatctccaggaccccatccgcagcatggtcgcaggagtcgcagcgttgagaggaatggatgaggcgccgccgcgaaggggaaaacgatgggacaaggggaagacgccagcatcgagaccaacgaatgccgccgccgccgccgtcgtattgtccgccacgcgccgccgtcgggaggaagcctagggttttgctactctgcggcacttccccaaacaaaccaccgatccaaacatccttccaaacgcgaaaatacgattatacccttccactatggctcactcgtgcttgctaccccacgatcaagctggtaccctgaggtaccatgtaatcgtgaccattcgatatgccatcattaatggatgggattttagtaccttgcggtacaaaaagaatgaccggagcaatgctctttttcattagtgctgcatgtaaccatttcaccgtggtcaagattttcataaaatggtagatatagatcaacaaattaattagttgaccatatcttttatccactcatggtcttattaacatcctgtatggtatgttaaataagtgtatcgtcctataggtactacaacatgatcatatgcagtagtgtacaaagatttgaagacagagatagagactactgctactccaaaacaaaactgtatgggttatatcgccaaaaacatgctatgatggcattgctattcactatatgtcaataggaatatcatagatggatatatccatccaatgatttgtcccaacataaatggtttagcatttggttcataggctgcaaaagtgagggactaaacatattgggcttcgttaggccaagagataagtaacccttaatttgactcttgaatgtaccagctatgatgcagaccagcttacatgcatttagccttcaatttcacaagtgtgttctatatcagatcatgcatgtgtgcaaaagatagcatttactatcttgtaaaaacacatatacacatgaatttttgcaagacattagacctatagaataatttttttttacgacaaaaaataggttaggcccaatgttacagattccttgcgacctgttagcaggatattaaacatgaaagggttgtgcccaacatctgtttctactgtagggctcctaattaaggtttgtttagtgccaaaagtatccacctaaatgtctttgcattggttcaaattgattaatattttttttcatattctatcagttaaaataagcggaggatattaccgacatgcctatctgtatatgtgtcttttccttatactttttgtaatgcatgcctgatgtttggtaagttaattccacgaaatatgattgttgcgaaactgatagcacttatatttatttccttaattaagttattaaaactgatgtctgatgtataaagtatatatacatccgtgattaatttttgtgtgcttatttgttttgtaggttgttaatcttgaagagttggagtgcagtcattcctcagagaataaaatgaaaaaaaaatcacaaaacatgaaaatttaaaacaaaaaaaaaacaaaagcatcaaaaaaaggggaaatgtcaaaaattgaaaaaaaaagcattttctttagctattgtaaaatacatcttcatataatttgttatatttgcttgcgtttgttttcttttaaaactttttttattgtaggtgtgtaggtaactccgcctatgtcatcttaaggcgtaactaaatgacatagccggtcccaagcccggaaaaaggaggaggggatataatcttgtatacttctatattgaaatgatgctctgctgctaaatacatcatttgatattttcttggaagtttctgcacttttatcaagctaatttcatcttcagtaatggatcagaatagttatggagagtcatccactctgtttaattgttcaacaaatctgattctagactattttagtttgacctcattacagtccagttttccagtaaaagcaatttggatgaacacatgcatcagttcattctcctctgtcggtctgtcctacatccttcagttatcagtgccagatcaatgatcacaagagttgatattttggagaccacaaatgcacaagtctgtttgttggaggctttagtatttttcatgatcaaaactggtgcagaaaacatctgttatcacatatcacgctatttaggttcagaacataattatgaagcacatgatcaacaaataaaaatgatgaatttaaattcatgaaaaatggaattggcaaaaaccagaaaaacagagaggcgtgcttgatgtcctgacaagaatgatttccagcgatggtcagtaattactgaagtacattgctctagtgaatctttacataatcacttcacctccatgcaagtttcttgactggaaaaaggtaaacatggaacagaataacaaactgcacctggagggggctactttatttttatttttttttgaaagataccttaaagcggatactgaactggactgaaattgccactgaatgttcgatcacattaagcctggcaggaaagcggagttctcaacaaacagagttggacaggaaatggtccagcagcaatgcaaacaagcaatgctgatccgggtaggaatgggcgagttcaagtcgttgtgtcacgcagggttcttcttccccgaggcgaagatcaagggacactggaagtggagcaagacgattaaggtcgtcgaaagcgagacgctcggcagcgctacctatggtaagaataggaagatcttacaatcgaattcagggcgttcaggtaaacactagacaaatcccaatcgccaaatccacagcatcctaaacgaaaatcaacagtgtttctcacagcaatgatctgaacgaaattcatcttcacatgcatatatatcacccatggccagcacccccacacatacatatcttattcaacaaaattacaagcagttccctgataaagttgcatattacaccaacaggttctgcaacttccatgcagctcattatcagaacatcaaacttctattgagcaggaatgaatgaatggatcaatgggtagatggtaggagtaccatactgactgtgtgtattgttaggaaaccgccggcccatgaaggcccggctcggttacccactaattaggcccatcactaaatatggaaggtggaagagggaatggctataaatagaggagtagagaggaggattgtacacttgagaatgcaatggatgaatgagaaaggatgccacaccctcatatcttgtgtctccacttttgtagaattacgcaatccctcttggactatctcggtacatttagtctccctgatggttacagcccaccttaactgaattttacatcagcaatgattgtgtgcaaggccctctttcctccaccagatgatgctttatgaccacaaaatccatgtatatcttgatgaacagaaaagaaaatcattccttccattatccaacatcgttttttattgagtccatccttttccatttaaacgctgaacagaacagcttgttactctgtcatcaggattggttcaggaatcaggagagatattatgacaaataccctagcttttccccttgttgtcccgtcatattgttgaattaactgtagttttgatgggatgctaaaaagtgccccttttggatacttcaaccttcctaatattccatgtaagctgttttcctaatttttcgcattgtaatctgctctactagcaatggcttatgtgctacatctcctgtacaggattcagaactcgagttcttgccacaaaatggttactgtacacacaaatctggctaaaattgtaaatggaaaatttcaaatgccaactgcaattaacagcagattgagttgcaattaactctcctatgctttagagttcacccccaaatcatcaaccctcttatatggactctgaaatcagaatcgagttttgtgttcagttattgcagttcagtgctctagtttcatctcaactgttccgagtaattaacaactggactagaaattattcttcccctgtactgaaactcactcactgactcatcgaagcgctcatacactctttgatgggccatacactttgggcctcgttttgctcctgccctgtgcagctgtgctgacgggccgcatgtccccgtagtatggaaaaagtacaccgaaggtccctcaacttgtcatcgagttacaaaattgtcccccacgtcccttaactaatcaaaaccggtcacaataggtcctttggtgtttttgactccggttttatcctatgtggcaactgactcagcatgggacccacgtgggtcccacatgtcagcatcttattccttcctctctctactgccctttccaatcccccttccacgggcgacgggcgtgcgcgggacggagaggcggggcgcgggcggctgggcacggcgtggccggcggccgaccggaaagaactgagcggcggcggcgggggaggagctaggcgcgagggcggtcgcggtggagccggtgccatcctcgcctcgcctcccgcacgcgcgcgtgtgcgtgcgcctcgccacacccccgccgcctaccgcgcgctcgcagccgccactgccgagcaaggcgaaggcgccatggcggcgctcacgcaggcactcccgtccgtggcacccgtgccgccgccgtcgtgatctctctcctcatcgtcatctagttccaaggaaggatttggtctgtgtctgtacatgactttttttttgttttgctcgggctagcttggccattgttagtgaattgatggtgaaaataaaaaagagtttattgggtaggtctggtgttgccgccaacgccgtcccgcgaccaggcagcggcagcaatcggagacgaccacgctgcggcgacaaaacagaggggaacacgcagcggggaacggaggggaacatgtcgatctggccgatgtcaaggttggtgggtaccagcgtggggttcacccgctcgacggcctggtactgcatcaggctctgcagcttggtggtggagacaatccagaaggtgtcgccggcgttgatctggtactgcataggcgcgtatgcattgggcgagtgggaggggcacccacactggagcggcacaagcagcggctgccccgccgctcgcgcgcaacccctccccccaccgaccgcgtgacgcccctcccccgtcgccgcttcgtgggtctcgtcccctccctcccccacgcacccgtccgtctcgcgcgacgccatcaccgctgacgccctcctcctctcccgcctcgcagaacgcagagcagagaagtgagagagagagagagagatgaggaagggagagaagaggggaaaagagagagaaggctgacgtggccacactgacatgtgggatccacgcgggtcctacgctaactcagccgccatgtcggacaaaaccagggtcaaaaccaccgaaggatgtaaagtgaacggttttgttagttgagggatgcccgctatttggttttgtggttggaggatgattttgtatctcgatgacaaattgagggacctttggtgtactttttcccccatagtatcgtccaggcccacaaattaaatggaatcccttgctggaccatataacatgggcctacgtcgcttccggcgtacgcccattaatcggcccgaccgcaagagcgatagtctcctggatgagagaatccgccgccatggcagccgctcgccggagctccgccgactggccacggagctcctctccggcgaagatttgcatcacgtaggttcttcgagtcttccctttccataatgtgctttggctctttcatcttcttctctctgtctcacagatcagacaagttgcgcatgataccaaattagagatgctgtactgctgagtaaacttcagatactattgtgttaccaaaaattatcccgggaaagcaacacctgaattcttttgatatcaacacatatctgtttgggacaatgttagatcagtgctcctgttgatgtcacaatccaattggatgctttctaggagtaaaatgctttctaggagtaaatgttctgtgcaatattgagttcaacacttcaatcaaaccagatggtttcagatcagaggtattctaaggcatagttatcaacaacacaaacttgcagaaggactatcaaactggaggaaataaattttggtcaaatagaaagaagtcatgaaaacaagtactcatctaagcaattactccagtaattatgtataatattctatgagaaatagttacaatggcacagactccaagagtttttgaagacttcgtgatatgttcatcagccataaattctagaattagaatgcgacatgactagcaagatccaaattctccaagaatgctctgtccttgtctctattgcccggctccttcacactgcagatgcaaagcagagtgaactgattggggtctggatggtcgggtgtgatcccattctctagactctttgagataacaaagatttgctctttgtcacctttaatctccttcttgagaagtactagaagcatctcagttgcctgcagcttagtagggttcaacgtggagaggaagatctgcaagaaccagataggcatcagccatgagtaccatgaagttttgccgtgaatggtaagctgattagaatcttatatagtcatatatatttacctttcttagttttctatgtaataagtgataatagaagaattttgttgttgctgagtg

SEQ ID NO: 61260 - DNA, 542 bp, Oryza sativa
aacacgtgtgcccttctgtactactgaaagctgggttttcctttcccatgtgcactatgcgctttcatgttttcctccactagatgttaactacgatatactacctccttcctttaatatatgacgttggttagttcaattaacatcatacataaaagaacagcgcaagtatcgattattcttaccctatgtgggagaactggataccacgcttcaaatttattctttcagttttgctaaacttctcccatacattgcaggaagtggacctccagtccaaaatcacaaacaaggtgtactttgacataagcatcggaaaccctgttgggaagaacgttgggagggtcgttattggcctatacggggatgatgttccccagaccgcagagaacttccgtgctctttgcactggtacaaagggcttcttgcttttcttctcttctgtcatctactactttacaggattacccagatttggtgcatgatacacataccattgcccttttccttttcaggagaaaaagggtttggttacaaggggt

SEQ ID NO: 61261 - DNA, 653 bp, Oryza sativa
agtgattcaataactacaaatgagaaaaaaagattactattagtagtagcattaaagaggtatagtggaccactctaaaaccacacatttttaaggacgaattctaagactaaaactacaattaaaagatggagggtgtagtgcataatccttctatcccaaaatgtctatttctaggtttttcgagggagtaaggaataaaggtaaaaataccacaatgccttctttaaaacacaaaagacatgaaggaatatgtaggttagtgggtgcgaggtggttcatagggtgggtctaatgggcgagcgtgttcgcaagccgtaggcacgttccgacagcccagcccccttagcccccctccaccccttaaccctaacctattgttgttatacaggcaggaagtgttcgctagcaattgtgtgcacgttcgcgaataaggctttttggattcataggattataattgacataatagcattgacctaggaatagctatatttttttagacatgtttaaattttagaaatagctacattttaaaatgggtggagtattacagatcaagaaaaatagaaaatgccccaggaaatttattaacgagaagtgttcaatgctcagcataaataagccaaagcgataagtttatctcttaaatg

SEQ ID NO: 61262 - DNA, 2804 bp, Oryza sativa
atcgaatctatcttaagaatgcaacattcagcaagtcacagcagggatccttatgtggttgattattaccaccaagcttgcatcgcgaaaaggggtgccaattctaggccaaaggccaattttgccccaacgtcaatgaaagacttgccttccaagtcccgatccagtggtgaccatcatgcatatcttcaggttgatgctgtaggaagagtttccttctcttccatacgtaggcctcgttctcttcttgaagttgaccttccttcatcaagtgatggttctcatgatcagaagtcttctctgagaccattggagaaagaaccaatgctggccgctagagtcactgttgaagatgccctctgccttcttcttgaggtggatgatattgaccgtctgttgcagtctagtcaggcacaggataacagtttccaactgaggcgaagacggcaggtcctccttgaaggtttagctgcatcacttcagcttgttgaccctctcgggccgagcacatcaagccattcatctggattggctgctaaggatgatcttgtttttcttcgcattgtttctcttcctaaaggacgcaagtttttgtcacgttaccttcgacttcttacccctggaagtgagttgacccgtatagtatgcatggctatttttcgacatctgaggtacttgttcgggggtttaccatcagattctagtgcagcagaaacaacagttactcttgcaaagactctttcatcttgtgtgcgccatatggaactaggtgctcttagtgcttgccttgctgctgtggtctgttcacctgagcagccacctctgcgtcctctagctagctctgctggtgatggggcttctcttattattaaatcagtactggatcgagcaactgagttactgactgaccagcatgccgcagccagctatacagtgtcaaaccggactctctggcaggcatcatttgatgctttctttggacttctgacaaaatactgtctcagcaagtatgaaagtattaggcagatgtttaccatgcagtcaccaggctctgtaattggatctgaggtctccaaagcaaccagcagggagatgccggttgagttgctacgtgcaagcctccctcatacaaatgatcatcaacgccagctgctgtttgattttgctcagcgaaccatgccagtgactggttttaatgccagcggtgcaaatggtgggcacatcacctccgagtctgttcctggttgatttagctcaagatgccaaaaagtgtagattgtcaatgcttaaaggacttaaatgtgcttgtctttggatgataattcttttatatctggagacatgcataaccccttcataaggtaaggttgtgtgagcttggagaaagttccatttgctcaggaaaaaatagccttcagattgtgactttaggcttcagattaatctcatagaccaacaatctcctttctgtgggtcatttatatagcacccacctgatatgcatatgtacatgcactgttgtaacactatcgttggggcgaattttagcttttaacataacattcatatgctcccagtgaagaagacatccaagactagtgggtttagcagcagtggttgtacaggctctggtactttgaggttactataaatgttggcttattctttgctcaaaaacaattttttaggggggaactctggtggaatcatatattttttaccaggataaaggctgcctgcctttgttgtaagtttgtgtacagtagttattagttgcagccttaaactggatcatttgaatgaagtagtcgcagttaacctcgagtgatcatttaaatggagaaattcgtgggatttttatggaatttaggctatatcatgtgattctggcattcgaaagaagccaatatcatttttcagggcagcattttgaattttgagtattaacagtctataacagcgatcccatttgcaatgcaaatgactactcctatttgattttcagtaggatgaaagtgggccccgtcaattctctactagatccattccaaaatatagttgcatggcatgttgaaaaccaatcgtctggacaagcaaaacggtgtggtttattagtggcaagcaaaatgaagtactcattagcacgtgattaattaaatattagctcgaaaattttaaaaatatctactaatacactttttaaagaaacttttacttaaaaaacatcgtttaatagatcaagagatgtacacatgaaaaatgagatagtgaaagttgagaaaaagatatagaatggaaccttacttcacctacaaccatccgtaatttaatttctccatctattcctcaactaattataacatctcttatttaattttcttacctactattttatcttaattgattagtcacctaatcatttaattttaccttatctttaatctccatgaaagactcaagtttttatcttttttaatggagtcaaggagagagtatttgttactttgaccggttctcctacagccaaatgaccacaccagcttactttccttttctttgtttagcgaaagatttgcatcgaaatatgtgtaatccttttcttattttgattttccagaaggcccaaatactagatccaccaaatttaagacgatggataaaaaataaacgattttaaaagttaggggataccaatcaaacagttctacagttgagggacggaatggttttgagaccataagagcattctcaccaaatactccatcccatcatcctgaaaatggcatattggaaatgaaagtcag

SEQ ID NO: 61263 - DNA, 1899 bp, Oryza sativa
ccccttgagtttcttaaaaacaataaatttgttttttcagctaggtttacaaatatggttataaaaaataatacaaatatatggatggtcagaagatattaacaacatatagaaaattgtgatatgaaggtatatggatgatctgttggagtgaaaaggaatatgtagagagaatcgttttctataataatccatatagggatatgaagatttaaatttggatgagctgctggatgctgtaagagagacaacatagactcctttcgaattgagttgcccatgggatggtggcacaaactttgctttcaccctgtagtgtatctcgtgggctgcagtgtagatcgaagccagatccaccgaaaacaaagcccagcagtaacaaggctgtgcatcaagtttttgggctgataccataggaaacaagagccttctacactgaatttttttcatttttaaatttttattttttaatatttacaaaaatattataccgacgaaaatatttatatagacccggccgcccaagtagagggcatcaaggtgacgtggcacatggcgccgtgtgcatattttgcgttgaggtcccttgccggcaagggggtaaatgtaattttcgccgcatgcaaaattcgcatgtccgctcagtggcctctagcatctggtcacacaagtcaccctgcccgagggcgacagtgtctattttttaaatatttttgccggtataatatttctataaatattaaaaatataaatttgaaaatgaaaaaaattccctacaccgggtccagtccagtcgtgaggacaaaagatttgggctatttgaaaaaaaacatagaaataggaataacttctattccggggagggcggcagagtctattttttaaatatttttgccggtataatatttctatatgtattaaaaaatataaatttaaaaatgaaaaaattccctacactgggtccagtccaattgtgcagacaaaagatttggactctgtgaaaaaaaaaacagataaataggaataacttctactccctccaaaatagacccagaaaatatcccattatattttagaacaaaaatagaactagtttggaaaatgtgttcacagagaacgatgaaatagctgttgtgaaaagctatatagaatgcacccttactacttctagagttcttaatttataccgaaaatattatgacatatagcattcaaaatttattttaaaatataataacttgttcacctatattctattctcaaccaatcataaccttcgaccatttaaattcttcacctatactactctttcgaaaacataatcttttttatgtttaatttcacttacttttttaacactacgatctaattcttaaaacttcttactccttgtatattttaggagggaggtatttgtttgatcatttttacgttttacaaatcatatttttcataagcagcgggtgggaaggatttcggctaagggtgaaaatggtataaaaattttccgaccgtaccgatacccgttccgtaaaattaatagtgataatatatttaccgacggttcttgttgtcaaaatttagtttttttcaattcatatcaccgtgataccgaagtgatactatatagttcaattcattaatatgaaaattttcccaccatttccacccgcttttttttaaaaaaaacaaaaaaaacaaaattaaggtatcgtttccgaccgttttcatccgtaccggctattcggtaattccggccggaggggctctgaaaaccgatgaaacagcacgtacggtgcgaggccctgacttttgagcaaggctttttgtagccttgcgcttgtgcacacgccaccccttctcccttcatttaataatgcccacaccaaaggagcggga

SEQ ID NO: 61264 - DNA, 1915 bp, Oryza sativa
  unsure (1)..(1915): unsure at all n locations
gcggacacatctttctccgaaaagtaacgtgacgaacagctgatctgagctggaagtatcgtaacactactaaccaatcagcgactattcttcttttttcacaggcacgtcgaaagacaagcagcgggagcagcaggccgcatcgagaggcacgccaccgccgccgccgcngangacgcagcagcagcagggtggcaagaagcggcggcgagccgacgacgacgaggaggaggaggacgacggccgccgcggcggcgagctgcagagcaagctggtggagatcctggatcggagcagccggatggtggcggcgcagctggaggcgcagaacgccaacagccggctcgaccgggagcagcggcgagaccaggcggccagcctcgccgtcgtgctcggccggctcgccgacgcgctcggccggatcgccgacaagctatagccaggcatatacagtatatgaataagatactagtactcctatatgtaacgctaattaagcgtaggaattcaggttgttcggagtcacgtagagtgtgaaataatttacagcaggggagagagaggagaaggtgacatttttatggggatattgtacagattggcttagggatcattaattggcaattcgattcttttgtaaacccccggttctgaagttcggtcagaaaccgttattgatttgagatgttgcctttgttttgtactgtaatttatagggaggaaaggtaaggttgttactggcatcttgacgatctgaatcgtagcaatgtttatctgctttagtgaagttgcattaccaacgcaaaagttattttataaaagtatttcaggcaaacgtttccagatgaaagtttttcggacgaatgttttcagatgaatgttttttaggaaaagaaaatgtgcactgcgaacgcaaatgtgctaaataagaatcgccgtttaactttgggatatttttctcatcttgtatgagtcttttttcctgtttgatgtaagaaatggaattggttcattcgtttttacttgaatttatgaaaatgggccaaatgtcctagcaaaggcctagcttaacacgtcctccactctccaccgggatctattctagcaaggaagaagtctgttctgactccctcatctcttggtctttccccaaaaccggatatagcgccttccccatcttcgaaaactattacaaatcgactccctggatgtttttgtagatggttttatcctacatggtgcttaggtggcattttaaacagaaaaaaaaatgacagtgggtcccacatgtcggatcatcctccttcctcctcttcttctacactccttagccaacgactccggcgagcttgcaccaccatggtcatgccacagccgccaccaggcatcacccttgctgccacccaattcctttggcactgtagccgtggctacttttgaccacaacgcctcttcgtcgtctctttcctcaatcgtctgctttcaaccctagtgccacctcgatgagctctccgcggacgacgcagcggtggcacttacctccgcccaacgtgttgtggcacgggccaccctcgccacgccccttgccgttgccgccgaggtcgccaccctcgccctcctcgccgccatcgaggaattcctctggttcgcggaatcgagggaggtggagagaaaagggagtggtggtgcttgcttgcgagcctattggcgaggtggacgcgactgtcgctagcggagtagagggtggcctcgtcgctgtagtagagcatcccgaccttctcgggtggcggcgaggcaagtgaggtggtcttctcggtagcatcaactagcgcccgcggcaccatggatgcaccaagatgcattggcgccgcacatgcacaacattccttgggagggagnagtcgatctacaccgc

SEQ ID NO: 61265 - DNA, 594 bp, Oryza sativa
gatgatgtgccactatgatattgcttctgtccctgctagtagttagtacaacattaagagttaactagtttgagtggattaacttgtccaatcatgctcaatacacacacacacagcacagcacatctaaatctcactggttctgttaggtttgatatcagctagaacaatcgcaatgatttccctgttactcatgattctctgtcctgtttttacctagtgctgtgcgacaattaacagtacccacaatgcaaacttagagttgctgttataactgtaatttgttttctttcagagtaggaaagaaacatttcaaaaaatgaatgagcagtaatacagtacatctgtatgcaggttctcgactggcttcggtgtttctgggggaagtacgcttatccatgatttttactcaagagaagtacagagccccattcatctcactgttgacactgggttcacaaggggcgatgcttcaatcaaagcctatatctcatccaacctgtctcttggagataggcaccttgctgcgcagttccaagagattccccttgatctgaggatgcttgaagcaggaaaagttggatgtatgtctca

SEQ ID NO: 61266 - DNA, 655 bp, Oryza sativa
  unsure (1)..(655): unsure at all n locations
gtaactaagaatgccttttggaatagtgttattaaaaatgttagataaacatttggtttggtgaaaaatgatatggttttatccaaatgagtggagaggttcagctgcaaatccatatgcacatcctaaatttgctttgtttataaatgccagcctgttcaatgcaactccttacaaatttatggccctagtgcacatatgtgctcatcacaataactgggttcaaagtgataattaacttggttttgcctatagcccaggtgtttgacatggacttacagcaaacacatttaactctctacagttggtgattaaccaataaaaagagctccattcatcaaatatattcaaccaatatattacagtattggctccacaaactagcttactataataagatatgcaagcatgtctatcaacacaaggaaaagtcaagacatgcacttggagagttgttacatatgtgcaagaggtaagcctgataaactaagcactgaaatttcgctcatgtggggtaacgccacaaatcatatggagttggcacgttgcatcccaaaatattccanattattatttttattttgaataaatattaactgtatgctaagaataggaataggaagataactagcaagatacaactcaaagttagcat

SEQ ID NO: 61267 - DNA, 1986 bp, Oryza sativa
aggaggaatcaaaattaatggtcaatgtgggcctctagggttcttctaagtgaagctaaggttcacatcagtagtgtccggaaagtggttatgttggaattgtttttgtgcttcaattataggcagatcgatgtgtgttgaatacgggtgtttatcagttgtttataagctaaaaggttccattcaacggtagaatttcatgagacacggatgaaagcggaatctgtgctgcgaccatcctgttggaacatgtagagttgaaaatcactagaacagtgcatgcttcttttgataattgatagtgactatgaatgtttcatcagaatatgacagtgaaatcgataatgttcaaggtagccttttggctgcttcgtcaaaagcctattctttgcttgtttaagtccaattataattccttttgatagttcatcaagctatagctgtatagcttctggctatggaatctttggtttggttagttttctagcacacttttccttgtgttgcttggcccaatgctcatttgctctggaactcaaagagaactattactgcattttgggatcaatagcataattgggcaaaaaccatataatctagttcgttacaaaatgctgcactgcttcaactgttggctgtattgccatttcttaaatgcttgagttgctctcgcattctctgctgcattgttgatagattgcattgccaatgattactatttagcagacttaaaattttcttgaggatcaaatgatggtttttattgtccatgtcatgtcatgtaagcctaagcttacaggttaacacttctagctttgagcaattgcaatttataacttttatatttttgttggttggattaaaaggtttttggggggttgaattgaaatagttaatgtgcttgtctaaatagccaattggagtttattgtgatgggcaaaatttatgtttaatattacattgcaattggccatcaatctttgaactgctcaggctctacaaggagttatggatgcatgcatgtttgagcaccctgcattctatacatgcccttttttttttaattttgtagcactttcaatttctacttccctccttagattatagatttactatcattttcagtgttgtggagttattctgattcaatttactatgttctgcagattgataatctgagtaacttgtccgatattgatgatcttgcgagcacttttgcaaaggtttgtttcacaagctccactgttttaaattgaggttccattattaaaaaaaaatgcttttgcagtaacccttggaagtattagatatgttaaggatacttatgctttaccattgttggctaagtggttactctaattcttccgtaatccattctcgtatcaagaaatgttttccccagaaaggttgcatcttcaggctgcatgtcactaatccccccaccttccaccccacaaggctaagctaacttaaacatcaagtgcacattttattcatttgtagttgtagctatctgcctatttccactacaactagtcctgcctgctgccaagcatgtacgggataaatgacacatggttagtcaagtcctttggctgaatctagcttcttctggcattgcaataatctgttttgcaatctgcaagtattttgccgcatctaaggcccaattgtacatagaagatctagatacatctgtaatgtctgaagttgttttggattgattagcttggctgttgttctttttctaaggatattttatatcatattgcttagttgaagcccatgcaaccaatggattaggaattcaggataatcactaatgaggcctcaacttttatctatacctgacaaattgcttgcatatggaaccgtaacttcataatattttgttctagccttaaaaacttatgtttttgtggatgccgtccgtcttgttgccgccacctgattaatttatatctttttttgtcacgtgaaccggac

SEQ ID NO: 61268 - DNA, 3389 bp, Oryza sativa
tgactgaacttttgcaagctcctgaatcacaggaggtagctgacagatactgtgtgtaccgcaacatggtgcaccacatcgccggggagttcaccacattgcttgacctggaaggatgtcttcttccaggtcaggattatcggtcagagacaaaccaccagtttcttcatagttcagaattacatagaaactactaaactctgaaaggtgaaagctttaaaagctttaaaccacagcgaggggtgaggaaggcatgacgcttatcttcgtgtgctgcaaccccagctgcggtcacagatggagggagtacgtggcatgcaaaggcagtagagatttgcgttatgccatgaattggtctatgtttactttgtcaacaagagtatgagatgccatgatcctatgacagaggaaacaaaactgaagcatgtgtggccttccttctctatctgtttttttttctaattcaagggcgcagctagttgactagttccacatcatggaatcttgaagccaacagtaaagtaatcacatagaagtaaactgtagatcaatcacatggaaataaactgtgaactaatcacatcgactagacaagtggacaagcacaaaacgttgggttgtggagcatagacaagtggacaataactcaaaattgggtcagcggtattaacgtgggaaagataaaagaaaagagtggttcagcacttgtctagtctgaatgttcagctagctatgcaatatatatatgcaaggtcttaccactccctcctgcagtactgttgctttgttccactgttgtgtgtgtggcattcttgtactgcatttctaccagctgtgggtaagctcaagacatatagctgaatttacttcctttgtttccttaagataatctgtaaatgctcgttttgattgcaggcacggtgtttcatcaggatcagtcgtgtctatttctgtctgccctgtgatcgcttgagacgaggtctgctaggaaggaaaatctgcttcatctgaataaacacatatatactgatatctccttgtagcagacactctcccgtcggtggatgtcaacacattcacctgtatttttggtattatcccattgatccttctagttaaccttctgaatcattcaagttttacatcggtataatgagcatacacttcacctcttattttcatctcccctttttgcagttgtagcagcacaatcagtggttctctcttgatgactggctcataatgttctgaaatcctttctacagttggcgtatccactgagtttcttttgatcttcactaatctgagtctgtcgagtatctaaagtagatgggtcagagcaaacttctagcttgtgcaagatgaatgctactatactattgatccttgttatgtgacttatgtcttttcatgctgaattatcactccataaggtaagatttgcatgcaatatacttgagtaaaacccctcaacttgtttccggttacttctttctcctcatttacctttaacccaagaagcttacccgaaatgtaaccccattattccagttctttagcttcagtatgctaacttgctcaaaactcatggcaaaacaacttattaaaaaccttaccgaaatgtaaccccattattctagatactctgaaactgattgaacttttgtccattttcagatcgtgtaattctcataagtaatttacttagaaattttggtgcatcaccatcaacgagtttctctatggcaaccatattgggttctttgattggatcatgcgtaaacaagttgcaaggcatcattacagaggaggcaatactaattttaggtgtagaagaagaactcaaaaaactgcagaaaagaatgaaacaaatacagtgctttctcagtgatgctgagcgaaggggaatggaagactcagcagtacacaattgggtttcttggctaaaagatgctatgtatgatgctgatgacattatcgatttggctagttttgaaggaagcaagctattaaatggccattcttcttcaccaagaaaaacaactgcatgcggtgggctttcacctctctcttgcttttccaatattcaggttcgccatgagattggtgataaaattagaagtctgaaccggaaattagcggaaatagaaaaggataaaatatttgcaacacttaagaatgcacaaccagctgataaaggttcaacatcagaactgagaaaaacatctcacattgttgaacccaaccttgtggggaaagagatattaaaagtttctagaaatttggtgtgccacgtgcttgcacacaaggaaaagaaggcttacaagcttgctattgttggaacagggggaatcggaaagacaacacttgctcagaaattattcaatgatcagaaattaaaaggaagcttcaacaaacatgcttggatttgtgtttctcaggactactccccgtcctctgttttgagacaactacttagaaccatggaggttcagcacagacaggaagaatcagttggcgagctccaaagcaagcttgaattggctattaaagataagagttattttcttgtgttggacgatgtatggcagcatgatgtatggaccaatctactacgaactccactgcatgctgcaacctcaggaataattttgataactactcggcaagatattgtcgctagggaaattggggttgagaaacagcatcgtgttgaccaaatgtcaccagctgatggttgggagctactctggaagagcattagcattcaggatgaaaaagaagtgcaaaatctgcgagacatagggatcaagattattcagaaatgtggtggtctacctcttgcaatcaaggttattgctagagttttggcaagcaaagataaaacagagaacgaatggaaaaggattttagataaaaatgtttggtccatggctaaacttcctaaagaaataagaggtgctctatatctaagctatgatgatttaccacaacatttaaagcaatgttttctttattgtattgtatttcctgaagactggaccattcatcgtgattaccttattaggatgtgggttgccgaaggctttgtagaagtgcacaaagatcaattacttgaagatacagcagaagaatactactatgagctaataagtaggaatctcctccaaccagttaacacatcttttgataagagccaatgcaaaatgcatgatctcttaaggcaacttgcttgttatatatcaagagaagaatgctatattggagatccaacatcatgtgtggataataacatgtgtaaactgcgacgcattttagttatcaccgagaaagatatggttgtcatacctagcatgggtaaggaggagattaagttgagaacttttaga

SEQ ID NO: 61269 - DNA, 25392 bp, Oryza sativa
gatgctaacacctccacacaacttacgagatcttgttattgggtatttctttggttgtagattccccacctggcttggtactacccatttgccttcagtgaaatccatgatcctcgcaaattgcaaatcctgtgtgcaccttccaccaatcggacagctaccaaacttgaactacttgaaaattattggagcaagtgcaatcaccaagattggacccgaattcgttggctgcagggaaggtaatctcatatccacagaggcagttgctttccccaagctcgaaatgttgatcatcaaggatatgcccaactgggaggagtggtcctttgttgaacaagaagaagaagaggtgcaggaggaggaagcagttgcagcagccaaggaagggggagaggatggaactgttgcttcgaagcaaaaggggaaagtagccctgtctccaaggtcatcgtggctgatgccttgtttgaggaggttggatctttgggactgccccaagctgagggctctcccaccacagcttggacagaccaacttgaaggagctccttataagatacacaagttgattgaagacggtggaggacctcccgttcctctctggtttacttttagttgaaagatgtgaagacctagagaggatctccaaccttccccaagtgagagagttgtttttaaattgttgcccgaatttgaggcatgttgaggagttgggcggtttggagcagctatggctggatgaaggtatgcacgagatctctcagcagtgggtccctgggcttcaggagctacactgcaagctccatggagatgagcatgagctggtggtcaacgagtagctctaacacccacttaatgtagatggtgcaaggtatgtacactaattgcttgggatttttactggaatatactaatctttgggttgtacattcatgctgctcctctgctcttcagctgaatgcatctattctagcatttgatagtctccttacttgttcatgttgtgtgcattgactgattgtttaatcacttatatgatttagtatttatttcattactgctgcacgtaaccatttcaccgtggtcaagattttcataaaatggtggatatacatcgacaaatttgttagttgtccatatcttttatcctctcatgatcttattaacatgcatcctgcacatacggtgtattctagataaatgtattgtcctatatgtactacaacataatcatgtgcagtagtgttcctagctctgcagacatagatagagattactgctactccaaaagaaaattgtatgggttatatcaccaaacaatgctatgatggcattgctatattcactatatgccagtagtaatatcacatatgcatatatccattcaaggatttggggacaacataaaggcaaaatttgccactggacacgcaaaaaaacgtgtaattggctgagagacaccgcgaaaacgtgacatggctgatggacactacaaaaaatgtgtaattggctgtaggacactcgtcgcattattttattatttccgggtcaaaacaggtgagatatttttctaaatgcccggattgccccttctctttccttctttaaacaccggtgggtcccatgtgtcatggacagtgtatgtttaatctaatttataataggtttttaaccacctggccccacgcgtcatggactaatttttgtaacaccctgaaaatttgaccaacaaaaatcaaagttccaaaaatatggaccttcaaaaactttttaaataaattgcatcatgctgattttgttcacctatttcatcggattttaatttcggagttcatagatcacgaataaagaatagttaattaggaataaaccctaaaattagattggcaagagaaataattaagatataatttaaaataaagattatgtgaggatagaaataaataaaacattatcacgaccatatttatatcaattaaatttaaatgtgatggaataagaattaactctaattaaattccaataaattatatataaaaataaaatatgggtaatgataatctaggttagagcaacacaaatattgtgtaaacttgatttgtgcaaaaattataaatattgggacaagatttgaataggaaaaacaaccaaataggaaaaacagaaaaaaattcactattcattgcgctgtaagtgttcgatcgcgttccctagccctaacccctcctctgccgcacgcgcctggccgccatcacgtcgccgctgtcgcccgtcgcgtcgtcgccttgcgccccgtgccgccgcgcgccgtcgccgtcgctgccgcgccgccttgcgccccgtgccgccgcgtgcgccgtcgccgtcgccgttccgtcgccgcgcgtgcgtctcatcgcctcgcgcctcgcgccgccgtcgccgctgtcgcccgtcccgtcgccgcgccgtcgtcctgtcgccgtcgcgtcgccgcctcgtgccccgcgcccgcgcgccgcccgcccgtcgcgtcgccgcctcgcgccccgcgctgctgccgcgccgcatcgtcgtcgcatcgccgtcgtcgtcgcaccgagccccgtgtcacgccgcgctgcccgcccgtcgccatcgccgcctgccgcgccgcgcgccgcctgtcacgtcgccataaggctgcccgccccgctccacgccctataaagcccgacccctcctcttctccaccccacacacatccccttcatctttcctcctctccctctcccccttccccacgcgccgccgtcgtcgtgccgccgcgccgccgccttcgagccgccgcgctgcgccgcgacttgcgccgccgtcgccatcgtcgccgccgctgcccccccacctcgcgtccaccgccgccgccgcccgggtgggcaaggagccgagagagagagagggagaaaggagccgggagggagagaagagagtaaaaaaaaagaaagaaaagaaaagagaaaagaaagaaaaggaaaaagggaaaagaaaaagaaagaaaaagaaagaaagaggaagaaaataaataggcatttgagtaaaatttagaggtttagaaaatttaaaataattagaatttaatcgtggattaattatagtcgtaaaattgcgaaatttaattatattttggtagcctctatgagtaatcaatttgcggtaggaatttagatttatttaagaactaaaataaaggtgttgaattcttaggaaaattacttaggagacacaaaatgtcttaggttgaggaatagttctatttcgcgaataatatagtggatataacaatcgactctcgtgctcgctttttgatttggtctttattggattttatttgaattcggaattcaaatcaattcttcgcacgtacttgtagagcccgagggagttgcggatccgagcgaaggtcaagacccgcaagactttgagcaaggcaagtcatcactattctttgagcatattgatcccgattgcaaaatttattttgtttacaaataagattggatgtgatgatgaacattccacttgtgaactatgccatgccttgattattgttcatctttaaatctttgtaaccataaatacgtatgagtccctagtcaactatgacacttgcttagaaatgctactctagatttatgcatgctcatactttattaaatgctatatgcttgggcaattacctttgggaagttaattgagatgcggcatgtggagacatgagcgccacattgccatgatatgatgacatgaattatgaaaataggaatgaaattaaacacttgttttagactggggcggacggtaatattgggtgatatctgggaaaggctagtaccgtccccggtcaattaaggaccgagccatgaagttaagcatgaaacgaccctgtacaaccacacttctcgtatggggatagacctagcggagtaaatagctgagcggaggcagtatccttgcatagtggtttcttgatgtttgaggatggggctctacagtggtaccgccattggtaggactgccatatgataatttagacataattataacttaatgcatgtgcgtgagtcttcccttcccgggtgcgccagaactcctctcgctgctagaaactgtgtacgcctagagtgcatgaggatgaaaagttcatagagcggatactgccgatgccaggttatcgaaaagctttgccgtgacacgtctcatgtgttgggacgaggctcatgtgttgggcagtcgcggagtgcgggtaaagtgtacatccactgtagtgtgagtaaaacaaatctattcgaatagccgtgctcgcagttattgagcaccgggacatgtattacacttagctagactctaaattcttaacttgtgtggaatgggatattgcatgatgatttttatgctgttggagccacttcctgagaggagggaaggtggacatcctcagaaaaccatgacaactcaatggcgggaagctatccttgggatcacaatggatggtggacagcaccatcgttgtttaaatatgaacactggtactaaaatttgctcagtcaatgctaggtcttaggcttgtgaaaagaattacaaaacttgctttgcgcaaaagaaccatagccatcctttgaaatacccctatcatgtgcattgttgatgtgatggcttgctgagtacggttggtactcacccttgcaaatataaacttaatcagaggccggagatgaagcttcggaggatccctgtgcctattaccaggagggtgatgaagacgatggtgctcaataggtcttagttacggtcgttgcctgtggcaatggcgtgccgctgccttaactctgctgccttatctacctctgtttttgggatgtactccggaccgctcggttcgatgatttaagactatgcctgcgggcttatgatgtaataatttgcactagactctcgtgtatgtgcatatggtatttcagctataaactcgtgtgtaccagactacttgatccagggaaatggtactgtttacacgattgattcctgttataaaaacgggggtccacaatttttttctaattagtagggtgattgctatttgctaatcataagtggggcccatatctctctcctatccttcttcttcttcctcacgcacgcgccagagtagaggaacggcgcgcggccggcgcgacgacctgagccaggacggctcggcgtgcagcagaaaaagcggcggcgctccgccatggtctcaccgccggagctcgtcccttacttgaccagagacgggacaaagacgggacggagaagcgcgggtgggtcaggatggccgtcgatgccttggctgccgtcttgtccgcggatggggtaaacgaagataccaaggaaggtctcatcgatgccctcatagccggcgatctgggccccatcatgaacacgctcatcgcagctgttcccagatctggtatgggtcctcaaggacgccggcaatctgctgcatggcggcaaccgtgcaggtgcgaggctgcccagctcgctcgtagatggtccggccaggcgccatcccgacgctcgcgcgagttcaccgtgggagacgactagaggatgagagaggcagtggcatccgcgccggaggccgtgggaaagttgctcgtgtgatgcaaggacgacgacactgtacatgggcccacatgtcggctgcatcgagaagagaggggcattcctgtcattttgaaaattttcttccctctttcggcatggaaattataaaataatgtcttcggtgtcctacaaccaattacacaacttttgtagtgtccatcggcaatgccaagttttacagtgtcccttagccaattactcgatttttgagtgtcctgtagcaaattttgcccaacataaatggtttagcatttggtatacaggctacataagtgcacgaccaaacataatggacttcgttagaccaagagataagtactccttaattcagctcttgaatgtgctagctatgattggctgtgtacatccttcgggatgcagaggccgggttttatttaatccattatgtaaaaatgtgctatctatgatgaagaccagctcacgcgcatttagccttcaagtctgcaagtgtgttcttgtcatatcaatgtgcacatttagcattcactatcttataaaaacacaaatacacatgaattttcgcaagacattaggcctatagagtagttttttagatttgacaaaaaataggtcaggcccaatgttacagattcagagattccttgcagcctgtgagcaggatattgaagatggaagggttgtgcccaacatctgttcctagtgtagggctcctaattaagttttgtttggtgaaaaacaaaagccacctaaatgtctttgtatgtgtcttttccttatactttttgtaatgcacgtctgatgtttggtaagttcaattgcagaaaatagattgttgcaaaacgaacgtcacttgtattttcttttccttaattaagttatttaattaccaaattgcttatgtatatacatccatgattaattttttttttgcggggaacatccatgattaatttgtgtgcgcttatttgtgttgtaggttaatcttgaaggatttggccgggctgcggtcacctgtaatctgtatttttatctttacctagctactggtctttgaaatattaaaaaaataaaaaaacatgaaaattaaaaaatatatatcaaaaaatgggaaaatgtaaaaaaaaggttatattttctttaactcttgtaaaatacattgtcatgttttcttagatgtgtgtgtttcttttctttttaattgttttattgtaggagtgtatgtaactccgcctatgtcatcttaagtttatctaaatgatatagccggtcccaagcccggaaaaaggaggagggtataatcttgtatagatgttggttgaaatgatgctctcctgctacatagtggatcattgggatttttttgtacttttatcatattattttcattttcaatgatggaatagttatggagacacttctgtagactcatccagtcttattgctctgttggacacatctgattctaaactaagcttgaccagaccaccagatctgagagttacgttgcaaattgagatagacaagtaggtaaaggaaattcagtgccaggcatgacaagaggcagggcaccccagataaggtgtgcaacgagacattcgagtctctgagctcatatatgcccaaagtcctgaacaactcgatacaattttgctacaagatcaaatcataacggctagatcaaggtaagttctatttttatgtcggtttggccgatctagctaatgaattgacaaaatataagtacagttacatacccactaatcaataaagacatccccatgctaaaacaagtatgaaagaaatgtgcatatccctcagtatctaaaagaaaatagttttaagttttagcctataagtttatcccacaaagattatttttacagtgaggttcactagatctctttaatactactttatatttttctccctccttctcttttttttctcctcattaatagaatacaatgttcttttagcctcctacttaatctatctttgatagctaaaactacattgttttagaaacggagggagtatgtgagtgacaggttacaacttacaacaatcattgtctgatgtgtcacttgcttcggttcacaataggctgtgaactttatgtgttgcttcggtttgttgttcccctattgttttgttgctagctgctatgcttgtcatcagttcctgtgatgaacgtggcggtctgaaactctgtaagcctgcaggtctcactctctgtctctcctcattcctgagtcctgacagcctgtggcccatttctgcatttagtcctaattaatgaatttacctagccagttgacaccatcaggagggaaaaatactgaagactctgtgaaccctgcaatctagtagtttacatgtttattcaaatgagcaaatattcaactccctcatggactctgaaataagaattgagttttgcattcatttcttgtgctcttcagttattcagttcagttctatatagtgtcaggactatcatctgaactgtttcgggttcatgaacaataactgttaagtccatctaataagttcagttattcttcccctgaatgactaatgcagcaaagcaaagcaatgctgaatcgcatccagtttatcttaatttgggttcctgtgcacacaatttgggtgaacttgtaaagttcaaatgccaaatgtgattagaagcacatttagttagttgctgatggaggtgtatagggcttttgtatgtatggattgtggtaaggcttgtcagaagttgtaattcctacctccagtttcagatacatggcagaatttcacctgatggcatttgatcgttatgttcagagatgctcagttgctcactactgatgctgtagagctcactcccccaaatttgcaaccctctcatgaactctgaaattagaatcgaggtttgtgttcattcctgtacacacttgagctattcagttccaattttcatctgaatcgttctgtgttcatctacaaagcaaagcacatctagagcgcatccagcgatgagaagagaaaaggggaggaaaacgagaggttcgccccaagatccggccgagcctcgtcgaacagcttcgcgctccgccacctatctccggcgccgacgacgtggggctcggcggggatttacctcgtcagagagctcgttcgcttgccgtcgtcgcatcaacggcaatgcaaacatataatgtctccctgactcgtggggcccacttgagggcaagaacgcaacaatgacgcgtgtctctcctgcttgagaactaaccagcagccgctcgccggagctcctgccggaaaccccaaatctcggcgcccgtatccggaggcggttcgtgtcccgttggttcttggagacttggactcctatcctcgttcagatcaggggcgctgttcagttcttgtttatccagcagggcgcaccgaaatttgcagaggaatctcaatctccaaactggtaggaagagattttggtcgatagaagtagagttcttgtttgttctttggtctgtagagttcactagttcagataatcatgtcatcaacaccatgaattgaaagagatgctgtactgctgtttattgtgtttactgtttaattcgtagtatccatcaaacctgtatctgtttgggagaatgttcgatcaaattcaactcatgaccaaattcgtgttaggcaaatattcacattcaatctgttacttcctccgttttacaatgtaagtcattatagtatttttcatattcatattagttttaatgaatctagatagatatatatgtctagattcattaacatcaactaggaaggaagcccgcgcatatgcgcgggcaatttatttattgtctataaaaagaatattaaaagaagccctatcacactatattcactgtaagaaatagatcatagattttgatagtactaaatgataagaatgtgtatcatatccaaacaaaaaatcactttgttccggttatatgtaaattcgcctatcacccctacttattattattgtcttggaaatatgagtatctttttaatagatagaattgtagttatacctaaaagtaaacccaatacaccattaatgccagaaaaagttaaatctccacatcatacccaagtgcctatgtctcacatgtgtccaaatctatatataaatatttaaaagtactgcttctaccaattaataggataaaaccgtttaacttatataagaatgcctctctaacgatcgggtgaagccgactatagccgttaaggtttttctttaatgccttaattcatggtctcgtattgatatagtcgtgctcctcaagtaggccagttaagctctattttcaatggtaacctgtaaaatcggaccacctcaaccgaataatgcatactcctgcatagtttactacaacgtagccaattgagattcatgcttggcaccctttagggaatgagtgaaaaaagatggaggtaatgaaaaaaaaggtttttttgtgtcttgagttgatttaatgtatagagtagacataatgtgtttatgatgttaatcaatggtactaaattttagtagtaaagacatattgtttaaaaaagattagtatggatccattcgactatctaatatcttcagtggcgaggatccacataaaaaatatatgctctcacgatgatcatttgctaacatatggttttgatatttttttcacttgtattatacatctaattcccctatgcatgtaagtagggtttaatatgcgttggaatttgtgctaatttgttaacactatttggatgagaccaacaaaaaatagatataatgtagttacgtgtatgttttttttttggggggggggggacagtagtctctcgtacatacgtttgtttttcttttttttggacaaaattttttctaatgtagggatagggtgtacgcatgtgtactcccagtgtgcttctgcacatatttatatgagttcatatgattgtcttttaaattattagtaaaaagaatactttcgagaaaatcaatgggaagagagtggagcaaagggtggcgtaaggcagttgcatatggcatggcttgttttaccacctcagtaggagtagttgctacatttatataccctcaatttgggaaaatcttagagctggaaagaaagagaaaactaccagatgggacggataatatacacactcttttttttctttttatatctcttatctacatacttacgtaggagttgtgtacgtacgtatgcacagaactatacggtttttagcacatagggattagtttagtatatctaatttaatggttgaaaataatggatcattgatttaattgtaaactgatggataaatattttacttttttatataatttttcatagattctctctaatttattagagcatcacgtggcatcttaggagtatttgtagaagtgtaggaatagtattactcataggtgtaatgtacttgtagtccactattgtttgtagtatattgtttttatattctatttacctataatttgttgatggttgcgcacttagtatcaccctttatcttcggtgttggatgacacacgtgctcattagatatcagctatcgtttggtgcattgtgcatggatatctcgtaagtaatattatttagcgatttgtggacaatggcttgtatatagaattatatatggagataagtgaggacatatgttcgatattttaggttatgattaaccaagaatattgtatactacatatgtttagtaccctaagtaacaaatttaagattgtgttctaaagtgcttatcagattggctactctcttatttatattgaacatgtttcccgaaattgctaaacatgtttcctgaaattgctaaacaatatattatatggtgcatgttttgcaaatactttttatataaaagtttttttttagaaagatcaactaaatttatttttgctttttaatatttaatacaaaattaaacatgtgctaatgacttgcattattccaagtgcctacataaactcacccaataagcttgatctaacgaagtttaaagtaggagataaaggacaacgacacgatgtaaaaataatatatttgatatttaatttctaataatatataaataaagaaaaaacagtacataataaatttactaacctcattttaatatattagttttttttacagtatggaatgagtaatttttgagggtgctatttataactgggttttttcattttcaaaacgcaggtctaatagtgtacttcctccgtataaccttgtaagactttctagcattgctcacattcatttagatgttaatgaatctagacatatatgtgtttagatttattaacatctatatgtatataggcaatgctagaaagttttacattgtgaagcggagagggtacatgttatgtttttttctttttccgggggtacgtacgtgtgtgtgtttttttctatatagtattcgtatgtgactgggtacgtacatattttctttttgtcaaatagtgtacgtgttatggtttttttttcttctccgccggcatgagaagtgaaagaaaagcgtacacacacaaaggggaaacggaggtcagatggatacgtggatagtacgtacgctacggagggatcatacttgcgttggacggatggatcgagattttgatttccttttaagataaatctaacgatcaaaattaatgggtccatcaatttaaaggaaaatcgacggtcagatttctctattttaatagagtgacatgtggcgactcgagagcgtttataggatgccacatgtcgatttaggagcgtttgtagaaagtttaatggacttaaatctaacgatcaaaattaatgggtccatcaatttaaaggaaaatcgacggtcagatttctctattttaatagagtgacatgtggcgactcgagagcgtttataggatgccacatgtcgatttaggagcgtttgtagaaagtttaatggacttttagtatataatagaagatagatagataatagatagatagatagatagatagatagatagatagatagatagaagatagatagatatgaatgtgggaaatgatagaatgccttatattgtgaaacggagggagtaatacgtttaactgcagttctcaacatctctcgatcgacgagcaagctgtggctgctgctgcaattcggcctgcaattcaagtgcagcaatatgttgtgtgcaatttgtgcattagtgcacaagttgagaatggtaatattatttcactcggaagagatggaacagttgtgaaatgcagaaccactcggttcagagaatagtcctggacaaaaggacagaaaatggtccaatggtgacaattgatcatttttacagtgaatggtgagcaactgatcagcatcgaccatggtgaagctgaacctgataagtcgacagcactaggggtgatgatcctagccacccataaatcctttcttgtatatttcctaacatatataagtcagcaagtcaaatgttcttatcgttttctttagtcgatggttcatcgattctgacatcaagacaagaagccaacatactgctagccatgttcctttcctcttggctcacatacggccatttgaatggattagattcagaaataatacaatatctcgtctttctttcttaattacttacatgagttggccggtgcgcaactctgccgccggctaccgcctgctgcgcagagatgcaagtgggtagtcccgctacccgtataaaaacccgcttgctagtatatttttcgtatggtagtacgaaatttagaagaaaaaatgaactagaagtaggataagcgggacaaaaaaaaaagcccgcttgcccggcccgcttgcatccctatgctgcgcgccaggttgagctcctcggccgcgagcgtgccccgggtccactacgctgcagctctccctccgctcgcgccttccttcgtgcccgatagatgcgaccgcgccctctggactccctcacccacctccgtgccccacgccggtcaggcggccaacacgcgcctcctccgccattgtcgacgtttgatgtcgcgattccggtatttgcatagtatggggatcgttggtactaggatatacgcgagactgaggtaaaagagatggggacgaggatttttatataggttcgggcccctgaattgtcaggtaacaaccctacatcctgttggccgaagccggtattactcttattcaccataatcacaccagtataatatgtggggtagcctatctaattgttgtcgacatggcggtctgaaggtctgactcgtagtcgacaacagggtaatcttcctcctcgaatccgtgcccggcgagatcagagatagcgctttcgtctctcccgacagtatccggagacaccgtaggggactagccatgcttatccctgaagttgatatccaacgtcttgtcttggcgtatgttggcttgtatgttgtggcttctgttgttccgtgtcccctctcctcctagggggccttgtatttatacccataggtgtctccttgtcctagtagaactagggaaaccaatatggatatagtccgagtaatccttgtcgtttccatgtagaactctggttgtctttccttatccagaactccctccatatctgaagtcagtttccgtattagacatggtatgtggtgggtcctgccgagatgtagtcgactactattaggtatgtggtatccataaccctgatagtagcccctgacttcaatgcaaatgaacgaattcatattctcgaccactgaccatggagtaactgttatcgagctcaagtgaccattctcggtgagttcagagataacgttagacttcctttatcagcctcgtgcgggcacctaaagggtttgtctcagtccatctccaacgtcaaccaagaaagtacagaacattcgactaagtctcccgtcttgctgtaatcgagaatttggattgaagtcaagaaattttatctcggcgggtacaccatctcttcaatccgtattccttgccgagatccaccaactgttctcgagcgatcgagaaggcgtagaatctgcgacggagccttgtcaacatttgtcgtactcgccttagtcgatcttggtgtagaaccatagagacatggagtcttccacaacgtcgaatagaattttcctgaaatcaatactcagaaaagaatatcaaatagaaatagcccccgggcgaacgctcaaagggtgacatgttatagtatgtatggaaaactgaaaatgagttaaatttacagaccaatgttttgtatatgagcgccttctctcttaccgacttcgatcagtcagtttgttgagtcatacactctccctagcccccagccttgtcgtcggagaatcgttctcggaggagaaggctcttggacccttgacctgccttggttgaacaagcactaattctagcccccagtcgtgaagttggaaaatccaatttccgattacacggcttggttaatacgcacggcgagaactcttacacgaccagatcttacgtggtcttttgtctctacaggatccgacaaggccttatcggctctaggcgcccccagccaaagttcccttaggttcctcggaggccttgtcaagacggcgtaaagggacatgaggataggtttcaatgctaggtgtcgtcatggtaagggatctctaggtaaaacacttagcaatattgtgtatctgatatcaactttgttcgagtagaggtaatgggagaatcgctacaccgttggtcaaaaaccagttgtagccccaactcgaccacttgaaacaaaggtagtgggagaatcgctacaccgctggtcgaggaccaggtagtagtcgtaactcgaccacttaaaagtggaaatagtgggagaatcgctacacctctggtcgataaccaggtagtagtcttaactcgaccactagaagtaaatgtacgagagatcgctacgattaactggttgagaaccagtgagtaggtgtctctcgaccatttggagttggtacgagggccgttatgctaccggtcgaagactagtcgtagctgtccctcaactatccgaagtcatctgaagtcgtggtgcgaggaccgttacgctattaccatagttgtacctcgaccatcaggatttaaggcacgagagatcgctacgtcctactggtttgagaaccatgagtagaattatctctcgagcaccaatggaagctgcggtgcgagagattgctacggtttacaggttcgagaaccagcgagcgagtagaattatctctcgaacaccaatggaagtttgcggtgcgagagattgctacgtacttgttcgagaaccagcgagcgagtagaattacctctcgagcaccaatggaggcgctagagttggtttattacatgtgcatctcatgtggccagcatgactcacatacccaacttatagcatatccggatgtccgttcgcaatcatgtcgggtgatcaagccgacgacgttcgcgaggaattatccgttaacaaccttttctcgagtagctcagccatggctggtgtcgcgaccgagaaaattaccttttcccgaacgctagtgtattaatccccgtcccaggaaaagccggggtacaccacacaaacatgaaacaaaaggcacatctttattatatcgataatatttacattattacaaaggcacttcaggcatgacaaacaaaaataaacagcagcggactagcgggcctacggctccatcttcacaggcgctcaactggggtataagccaggactccacctaagacttcttctccaaagcttctgttactgaagggggaaagattgagcaagaatgagtacaaccacagtactcagcaagtcacaccggaaatgcataattaatgcaagggggtacaaggggataataatataggggttaagttttgcagtaaacagcatttaaaagtcatttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaatcattccacattttagttattaagcaggttttaagaatttaaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccagccctgtgccatgacatctcgactaccgggccgcagcccgtgtagccttcatttgtcctagagatgtccatcgacccccgactttgtccatctccatccgtgtacttttgtttataaccagactgagccacaaactaagccttacccacttgacatgtggaagtacggtagtgctttgcaacagaggcccgaagaccgaggtgctgctaacaaaaccatgcaccccgagcccagcctaaaaccattttgagggttttgaatagagggagaggtgtgcatccaattccacaataatccaaccattccatagtgtccaagtgacatgaatattcccaaagtctagagttataaaaccacctaatgttgcctagttaatcagcgaagcatctacctaaattcatactagtggaaccatgaatagagtatccactagctggggttttgtttattctagggtgaacaaggtaataataacaatagcaataataatgtcataacgaaggtaaataggcatggctaaataaaacagtgataacgcgggaatttaaataaagcggtaatgcattaatttaaatcaaaataattttataaactgggattcaatatgctcaagaataatgtgacttgccttgctcaaagagaacggccttccgaaccttcggcgacgatcgcgaaccacgcttcgggaacctccggaacgacagaagctacgcgaagcacacaagcaaagctacaagcctataaagaagcaataacaatacataaaaagaaagcacacggttctttaggttataataaacattaggagacttgaacgggtcgattcagagttcgtatgaccaagatatgatcatccgaagtttaatgctgttatatggagatttgcggattattataattaggctttgcaactataaaacatgtgaaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaactgaggcgagtagccgacaaacggactccactagacaccacgcgggctgcacacgtggaaaccacgtggctaccgagcgggcacactaacacggacactacacggtcacttcccgcacacgtgaacgactaccgacaccggtacacgggtaccggggtcgacaaccgcacaacgggtacggggcgacaacgaaaggacaaggacggggcagcgagaggacggatccttaccaccacacgacgaggcgagggaacgacaacgacgaacgggcgcggcggaggcggccgggaacgacggagacgaacggcgaggggacgacttcggtggcgatccttggacaaaggcgagacgcggccggcacgaggcttgacgacgcggagccgaggacgaagacgacgatggggctgctgcacacttgacgaaacgcgggcggcgaacgcgatcggcttgacggagggacgaacgccacgacgatgaggacgacgagaggacgacgacgacgacgaccggggccggcgaggagacgacgagggcagccggcggcagctgcatggagacggggacgacggggaacgcgccgctgcgaatccgacgacggaggcggcgccgcgagacgacgagccggcgaggacgaatgatgacgacgacgacgaacaccggcggtgttcgggtggaggggaggcgaggccgagggcgaccttgccgctatgatgccggaggtggtggtggcgcagcgagccgacgagccggggaggaggaaggggcggccgaagggacgccggcgacgacgaggatggagaggccggcgcaatgcttgacgacgcggtctccggacgaatcagagggcaggccggggtggaggtcgacgcggcgacgccgagggaggagacggcgcggccggcccacacctgagcggcgcggcaggggcggctggaggcagtacagtggcggcaacgccactggacgacggcgggaacgcgcctccggcagtcccgcgcgaaacggagggcaggctgtcgtaggctctccagaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagattcacactttcatcttaagcatggttacacatagcaaacacaactaagatgaaagaaacttaagacttacaacaacttaataattacataggccgaccgcccaaatagacttattagagaacagcggaagcttgactacccaaacacaagcacaccgactaagggtataccccattaagttctcatcctagaagaagcaatcggaacccgcatcactcaaagactaagactaaacctgcaaacaaaaggttatatcaaacagcaagagtcagtacattaaacaagttaatgtactggcaagcacaagtcaatcctaccatactacatgtaaagcatatattcaaaggaagacaatatgtagctcaatttcagcataaagcaagttttgtttcgcaattcttttgtaaagaagttgatgcttcaattaacaaaacaagttttaagttttaacattaagtttatcataattccatcataatcaatctcttgttgtcatccttgaacaacaagtcataatatatcatcacactcacacaactcaacacgttttatcaatttcaaatcaagtcacatgttcacattttaaatcataaagcctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagaatctagccttacaccagcacgatacgtgttcctccatcctaggcatacttggaaatatgtctagaaccgttaagtggcgggcccacgccttaaacttaacgccgtggtggcggacacaacgggaacccacccacgtggcacaataccgttgtattggacagacttagtcacctaaactaccacgtcggggcaaataggaagttcctctgaatcatcgactaattcctcataattatcgactaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtataaaatcacattttacacattttagttcgcaaatacccatcatattcattttattccagcaaaggttcaagtatcaaaatcacattttaattatagatggaatgaacatttgcatatttctaagcatggctaagcaagtaattgcacatagagcatatataaacccatttgagcacaaagagtgtactctaaccatttctaggggttcaaacagcaagaggatcaattattcaaggtggaatatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccactccttcaccgattatgcaattatctagataaaggacacgatatccaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttatagtagtatagtcttaggtagtgttatgaaatactttggtaaagtgatttttactagattagacttcataggagtgtgaagttgtgttttctaagactaacacatttggtttcacaatttttggagttataatgatttctttatgcattttacaagttataacgtgttattggtgtatagtgttttatatgttcatgacttttgagttataggttcagaacatgctacttcctgtataagttgaataaaaggaataatttggttatctaaaacatttttagttcacatgtttatggtctttactagtatggttcatattttataaactagagatgctctaatctaaactagcaatatattatattaacctagaaattgttatatgagctaagttcttctaagttttagtggatgaggatggaactatggcttcactggtcaatcaagtttttatttaggtttaattagacctaaagtgtatatatatacttatacatgtttatgtattaattaaacaacactatgtgtttaaattcttatttcactaagttaaggttttgatcaatgttctctacagaaggtgccaaattttattttactatgttgaagataactatttgctggttctatagaaactttgttcatttcatttggactaaaatgaattttctacaagttttacaaattaatggctgctctatgttagtaaatccttatatgaatatttagagacttttactacacagcaagtatataatattatttcataacttggaaatacttgtgttagtgatcctacataacttaagtttattcaaattgaagctaaattgggttctacatgaatttctaaagtttagcttatctaaaactagtcattttaaagataatagttttagaggcttttaatgcaaagtaagtaattacttttatttcacttaatcagagattgtatgatgatgaatgatgaatctgtagaatttgattttgtttcaaaatgagttgaaatgaattttctatgtattttataagtttgtacatgttttatgcatgacttatcttagataaatcttagagacattatttgtacagtaagtgtcaagttttatattcctggaataaagttcataacttcaagaatctacagaaactggaatcacttcaaaatgagctatatttgattttatatagattttacaactttgtgcatttttctgctaaacatataattgtttgggcattttcctaatttttcttcagattttaaaggatgggtccacatggctgtgagggaccaatatgcacaaaggcccttgatgtttctaggaatcaacccgcagtcctaggcccatatgtcagttactaacattttgcgcaaaaacctctggtttctcgggaaatagatcccgcagtcccctagttttaggtttgtatgcaaaacaatgcttgagttttagtttatttacagattattactggtcctacttgtaagtgactgttccagttgttaatacatccctgggagtctttaaatttcaaaagccatgcccttgctctggacagagcagagcagcagcacagccgtgagcttcacagcatcaccagtggcgaacaatggcgattcagcttaagctcccaaaacaaaaagtgtagagaacaaccgtgcgaacctattggtggctttctggcaagatttggtgctctatagcggctgttagggtgttagaggcggtggctaagctcggcttgcacatgcatgtgggttttgaggctcgatttaatcgtgcatgcgtatgataaggactctagggactactaggaggctcaccaagaatcaaacgcggctcggcgaagtcttggcgacggtgtactggttcggcgacggcgcaactgctacggtcgtcgtcgacggtgtactcccgggcttctactgcatatagagggtgcatgcttcggtttagatcagcacaaggtagctctaggcgaaaaagattgcgccgaagctcaccagagaaggagaaagaaaggaatggcggcggcggccagagcacgacggtgttccgagttgacgcggtcgcgttcccggagattggctgcactaaaagaggcgttcttggtggcgttagagacggcattgagagggaattacagaacgcttattgaacggaaatggagctcaccggatttcgacggcgtcgaggacttatctcaccggcgccggagttggcacccccgttcccggcgaatctgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagaggaggaaaaatctagaaaaattacatttattcatgataactaatctagtatttgaataaattatttcccatgttcacttatgtgcagttaaatgtacttttggatgaaatatggttttagccgattaaatttaatttgttttcttttagttgtctgcttcaaccgattaatttgagatatcaacatgagtgttaacatgttaccaaattacagaggacaagtttgtgctaatcactgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccatatgttatcacccaagattaactataggtttgtttagtgaaataattcttttagattatgctcatgggatctattatggaatgcaagaccaaaactccaaatgcacaaagaactcgagcctaggcatgcattatgtacatgtatgcttgatgacatttctagtctaatgttgggaatgaaaaggttttattttgttctcaaattttaatcatgcaatggtttaagttgatcatcacctaaattaaaacggaaatttttggctctcgaaatttggagaagttaacctctaactattttgacaagaaatcttaagtcctaaaatttcgggtatgttacacaggccgggggagaggaggcggctgcaacaccggggaaggcgacggcacggccggccggcgcacggtcgaggagggagaggcggtggaggcgcccggcgcggaggaaagagaagggcgacggcggggaggtggctagggaccacgggagaatgcgggagggggctaaaactggagaacggatcgagggggttccattttataggagaggagagggagccgggcacgggagagggcggaacggcgacgggaaacacggccggcggccatggaaagcggccggggaagacgcgggcgttcccggcgattgggggcacgattcaagggggaaattggggggaattgaagaggattcaatggggattaaaacccccgaatcaattttggaattagccaaatgaatcaagcggatttgagggaggaacggcgctagggttcacggg

SEQ ID NO: 61270 - DNA, 21641 bp, Oryza sativa
  unsure (1)..(21641): unsure at all n locations
cccgcgggccggggggagagagggaggactttgggccagacttggcccaaaggaggaaggaggattatttttaggtttttctttttaataaactttgataattgtttttgttgcttaataattattttcggtgctctgaaaattcaagtaaaatttgagggctccttttagaccaaagagaatttaacaaaaattctccgggccacatttgaatttttcttgtacgtattttagtgtttgccaatttcttttcgaattttaaataaattctattattccttttagagaatgatttttaattcgggatgaatttatcaggacgtgacagctggtgctatgagataggtcatcggtcttcgttggtaggttgggcgcgacgattctgcatttgtcgagatcgttctcaataatggggtgtactcgaccacaacctactcgagtgctcaattgttcctgaaaaatattttctagaaggcaagaaatatagcagagaatatcgagtatgtactcaaaaaactgcataaatcttctagtattatcaggatataacgagcagatgtaaatatcaggcattacgtgaaccgtaaacaagcttgatttgtacaaaataaaatagagcgagcccccggcattaaaccgtagtcggtttaacatcagggacactcgcacaacagatattgtacaaaaagcatgctctaggtaaacataattgatctgacaatatctgaaaataggtacggtaaattgtatataaaatattgcgtacctttgtagatatatgccggatatatctacggaataagtagatcaattaaattaattattccactaattaccttaattttccttggccggtcaatgcacagaccgtagctctgtacataccaatatgcatccgtatgcataggcatgtatgtgtacagcgtacaggggtgctggtcacggtagagtgcatccgatgcatgcgaggtgaagtcgggatctcgtcggaagacatactccggtcgggttagatcttcccacagccgaagttatcgagcagcttgttgttggagaatccatctcttaaacccatctcgtcgaaatcctgaagcaccaaaatccccctacctggcgcgcctctgtcaacgtttgatgtcgcgattccggtatttgcatagtatggggatcgttgatactaggatatacgcgagactgaggtaaaagagatggggacgaggatttttatacaggttcgggcctctgaattgtcaggtaataaccctacatcctgttggccgaagccggtattactcttattcaccataatcacaccagtacaatatgtgggatagcctatctaattgttgtcgacatggcggtctgaaggtctgactcgtagtcggcaacagggtagtcttcttcctcgaatccgtgcccggcaagatcagagatagcgctttcgtctctcctgacagtatccggagacaccgtatggggttagccgtgcttatccttgaagtcgatatccgacgtcttgtcttggcgtatgttggcttgtatgttgtggcttctgttgttccgtgttgtccgtgtcccctctcctcctagggggccttgtatttatatccataggtgtccccttgtccaaatagaactagggaaaccaatatggatatagtccgagtggtacttgtcgtttccatgtagaactctggttgtctttccttatccaaaactccctccatatctgaagtcagtttccgtataagacatggtatgtggtgggtcctgccgagatatagtcgactactattaggtatgtggtatccataaccctgacagtcgcccatgtaaccctagccgcgcgtgcgtgtgtgctgtggggaagcggcacgcgggcgtgtattggtaaataacagtggcagataagtcttccctctctaaatttatttttttattttcttctaaatctattcctcacagtgtgaatacaatagggctagacggccacttcgattttgaaaaagagggtcaaatgaacaaagttaaaaatatagggtcaaatttatagttagactttaaaatagagtgaaaaaaagcaattgtctctttgtcgttttccatatatatggtcgcaaacatttcagggctagcccagccttggctggccaatcaaagtttctacaattctctctcagttctatcttggtatatcagatcctcatcatcaagagatatttttcttaaccagcagaaaaaaattcgtccccatcttcgaatttggacgaaatacattgaaatgcttttaaatttagcattaataatatcttcaaatctgtccaaaaaacaacatcggtagtgtgcacttagaatcagtggagaatggacaagaggctagaaaacaacccaatggttagcattgatcataatgaagtgtcaagtatatatatggaagttagagttatatcagatataattgatttctatcatagtcttactagtcttacttatttttaatcttttcttatttctacctaagcatatattctacatatacaattgccctgaggcccaatacaacaaatccaatattcacaatatatgtcctcccattctattcaacacgaacctgagcctcatatgtcgacatgatagggttgatgaacatatatactacttcctccgttttataatgtaagaatgttataatgtcgacattatagcattccccatattcatattgatgttaatgaatctaaatagatatatatgtctagattcgttaacatcaatatgaatgtgaaaaatgctaaaatgacttacattgtgaaacggaaggagtattagacatgctttttaccctctctagtggtcgccaccctccccagccttttccttttttctttctcacttttgtaatctcttagccttcacggctattatacagtattttcctctcctttaatacaaacacaccatgctggggtttaaaaaaagacagtgatagagtattttgttgaacttagtcacccataattccagctacatttatcatcatagaaggaactttcatgcatatgctgccataagtcaataagtcaacgtttttatcgttttgtacaatggttcatcgatgctgacacctgacatcgataccggccggcaacaacaaactgattgcaactagaagggaaaatattagaaacaagaagctttagctttgttcacctacctactataccatcacgagctttaataccgggtagcaaaccttcccatatttatatatgcgatttcattcatataatatatactccctccgtattttaatgtatgacgccgttgactttttgacaaacgtttgacctttcgtcttattcaaaaaatttatgtaattataatttattttattgtgacttgatttatcatcaaatgttctctaagcatgacatacgtatttttatatttgcataaaattttttaataagacgagtggtcaaacgttggttaaaaagtcgacggcgttatatattaaaatatggagagagtataagccaatggatgcatggctttgtcatgtggatgagatttagctctccctcatctcacctcaggcccgtcaactcgtctcaggctactaaatagtagtgtagtaccttacacgaacttcacaaatctcacagccatctcctgtcctctttgtgcaaccgcatgagagcccagcaaatctcgtacagtatatggaatcaccaggagtgcgctgatcatcgtcttcctcacgatgggggatgccatggttagctgcacaaaaggcatctctccagtgaggtgagcctccctcacgacatacgtccacttgaacattttttttgttcttgtttaaaattatgtgtagcgattatacttgtgttcttgtatagcaattctacaaaactaaaggtactatttgattcaacaaaacctgcgaacagtatccaaaggggggcaaaattgaaggggaaaataaggggttgtatgcacgatgagtttttcttctttttgcacaatttacaattgtacgatgctttggtatagtaggagagcctagccgttcaaaagcatcttgcataaacagaaacttttaaacaaactacccttgctaaggctcatcagtacgctgatcaaatgtactcggtaagggatgcatggatattttcaagtggagctaatcatcatcttcacggttgctttgagaaccatatgactaagccttatcatcaagtatacagacaatcgacatgccttttaagaacttttttttgggtcatgcctgataacttctaccttacgtactacattatttgtgtaaggcacaatcacatggagttggtggcattatgctctcatgagaacattaaatttcatcaacttacatagtacggactatttacttccaagttgtgctccttgcatccttgattaatgggaacaactcagctcatggaatctcaaagtaaatggatcacattgccaactaatattagcaatatattactcctacatctcatgtcttgtcctgttcaatacacctaggcacttgacaattggtgacagttgcagttttccatgttgctaattactcccttagaggggtacatcagagtcaacacaatggaaggggaaaaactaaaaaagcatcggcgactttgtagacttgtatgcagtcttcatactttataatgtctcattgtacgttcttgatgtgatgcaagaccggtttctctctagtgtccagccatccctctgcttaatacagagttcatctctcttaacattgaaaaaaaatagagttcttctctcttcctagctcttctcttgatttgtccatgttgaccatgtcgccgaagatccatgatcaacgtggccatttctgttcttattgaagtttttttactgaagagatcttgttgttgggagttgggacttgggagggaccaatttttctgaacatatagcactctccttcagtccttctgcagcactctgaccaatggcatgataatttgtatccatatttccggttatttctcttattctctggttcatatggcgtaaccttaatttcttcttttccattgatgtgttttacttctaaccattggttgcaccagctttctattaatgaacttgcaattcacctgttcttttatttttcttctctttgcaggtgatctcaggttttatcttggtggtttcctgctgaaccttctgctatcgatccatcgaaaaatctagtgagttgatagttgcaggaaactgatgctatcaatccgttgaaaaatcaaatgggtcgatagttgcaggaaactgattttgcaagactatagctaattcttaccgtcggcataggattaatgccggaaataggtctgtaatgaaaggtaatgcttcttcacatcttggaatgttgaatgattttagtaaagtgaaagattctttctctagctactgttttgtgtgatcccgactgtgctttctgagcaattttatggtccttgaggaggtaccatgaagtaccattttttctattataaattttggtacctcatagtacctttacactaaaattttggtaccttatggtacctgctcggttgtggtanaattgctcgtgctttctgggtagcagcaactacagttgaactattaacatatttttcactttttgcacttcaattaagcagtgtctcaagttatctaaacatattatactttttctacaatcaaaatttggtgaaattgtggtgattggattattatcgttaggtagatacaatcatagtttgaattccataatctttttctcatgttttctaaacaaacaaacaaacaaacaaacggtttaatttgctgtcctaatatatatgagagtttttacgctccaggtactggtactgctaggtaccaaataaaatccaaccattgaatcaaaaggggcatgatgggaaaaaagaatcgatttgccgagcgcccctgcttctgaactgcttgttgactcgccatcgtcctcgattcttcgctggcacgccgccgcgtgagtgttcttcgacggcatcttctctgacgccattccttgccgccagcgccacctgtgtgttcttccgcggtaccactactagtgccacgacctttattcagctggtgcccggtggctgtgttgttatttctcgatccgtcgccgccggcgattaactgctcgttgctctacgcgatgccgattagtatggacggaggaggccataaatcttgtgataatgagaggataccgtgattgaaaggagtgagaggaaaaatcagtgcggatggttccgccatggactgagtagagaaaagaaaaaggaaagaaagaaggatgagaaaaaaaaggcagatggttccgccatggactaagttgaagaaaaaaataagagaagaaaagaaggatgagaggaaaaatcaaggtagaatggtagatggttccatcatggatgagtcgagaagaaaaaaaagcaaagaaaaaaagacagatggttccacttccggcatggacgagtaagtgccgtgccgtgcggcgaggatgccggtgacgggtcgaattcctgttgtcgagtcgaggtggggagatgaggctgtttgttcctcctcgctgcaatggatgggagaagaaaaggggaaggagcagtggagcacggtccggcgagcgcattgaatcaggattctagcgagaggtgcacagctttgaggctaaacacgaaattatggttttacccttcggatggttagtaccgggaggggtgagcgcttgtaccgctaggtactggatgcttgacagccgtccgatcatcctggatcgatggaccaaatttggtaccgcttccccgctggacggtaaaaagtctcggtccaacaaaaagtacctcgaggtatagtaccggtacctcacggtaccaaatcgttttcgatcgttggatttaacaatactcatcctgctcagctagatccaatgatcataaacgttttggtccgtgaggtaccggtacctcgaggtactttttgttagatcggagtaaatctcgtagaaaggaggaagtgagagaaatagagatggacgacttgctgtgataccggtattttcttgctgctgctttaatttgttgtatgcaaatttggtgattcatgtggattcgccaatttagtcacaaacatgtgattcacggcacaaggaaaaataccgttagtagaggtaccagtgaccaagtttggtttagggtttcgggttcagccattctagctctacatctatataatgtgcatacacttcacctttcttttctttcctccctttgttgcagttgtagaagcgtggtctatggtttcctcttgctgctggactcataatcttctgctgtatatatattctgtactttggctcattcaatcaattgtgtttggtcttcactaatctcactcaattgagatttgaagtggatgtgttggtcatgcaaactggttacgagatgatggctagcaactatttttcgagatgaagagggaattttgttaataattcagaataagagtacattcttcaggaactatttgctctatagaataaaaaaggaaatcaacatatcaatatcaacggcagaacgttttaaacattatgccaattgtgcaacctcatgagcaatgaattatgttttcctcatcatgatccggcaggacaattaaaccaggtaattgttcatcaaagtcgatgaggcaaactaagtaactttgcaatgtttgagcaatcaaacactaatattataggttgcttgatccaatcaacaggaagagctgaattattggttgccttgtctacacgttggccattcaacctgtatatgaggcctgcaaaattattattactatactttttttttctgctgaatgaaaacagtcagtaaggtaaattttgcttgcacacttcaaatatcgtattcttttctcttcatgatcttttgagacttcctttcaaacacatgagttttacaatattttcaaagaaattagttctattaccacagttcatgtgttccaaaaggaggctttacgggatgaaactagtagggaggtgtttctacatgacgttaattaccacaatgcgaagtcctgtcacgacttgtagaaatgttttttatgatactcgaagattgtctagactagtcatttcacactgatccaacagttggcattttttgaatcatattacgtcctatgcaaatactcactacatttctaaatatttgacaccattgactttttagcacatgtttaaccgttcgtcttattaaaaaacttttgtgaaatatataaaactatatgtatacatattagtatatctaacaatgaatcaaatgataggaaaagaattaataattacttaaattttttgaataaaacgaatgatcaaacatatttaaaaaagtcaactgcgtcaaatatttagaaacggagggagtaggtcttaaaaggaggcattacatttcaaacttgctattgtaagcatggcgacccaaaagacaactataatttttgaaataacgttatttggcacattttgaaattttaattacaaaatacaactgtaattttcacaaaatatgccaattctgttaacatcacttggcaaattttgtgaaccttctctaatttttcactatgttaacagaattggaattattgccagcctgcctttttttacattcatctggtattttggccttggtggatctccccgtttgtgtttgcctgatggcggcggtattagatgctttgattgtctcatgcatcaagaagttgcaggatatcattacagacaatgcaatactcgtgctaggagtagaagaagagctcagtgaactggtgagaaaaacagattacatacgatgttctcttaatgacgctgagacaacgaggttggatcatgaagcagttaataattggcttggacaactaagagatgttatgtatgatgtcgatgatattattgatttggctagatttaaaggaagcatcctactagctgaccatccttcatcatcatcaagcaaaccaacacgttgcaattgcccttcgtgtcattgtaatatttggacacgtcatgaggttgctgttaagattagaagcctgaacaaaaagatagcgaacatttcaaatgatgaactacttcaagatctcagacgtagaccgcatccgagaaatggttcgatatggacaccgataaaaacctccagcatagttgaacccaaccttgtgggtgaagaggtcatacttgcttgcagagaattggtggatttggttattgaaaataaggaaaagaaagattacaagcttggtattgtagggacaggaggagttggcaagacaacacttgctcagcaaatatataatgatgaaaaaataacagggaatttcgataaacatgcatgggtttgtgtttcaacagacagcacacaaacttctctattggaagaagttcttcggatcatgaaaattcgatatgggaaagcaaaatcagttgaagagctccaaaacaagctcaaatcagccattaaagagaagagttttttccttgtgctagatgatgtatgggaatctaatgcgtggactaattcacttcaaaaaccattgcatgctgcagccaaggggatagttatagtaactacgagaaatgaaaaagtagctcaggaaattaaagtggaccatacccatcaagttcatttgatgtcagaaaatgtaggatgggatctactttggaagagcatgggcataaccgaagagaaacaagttcatcatctgcgggacatagggattgagattgttcaccaatgtggttatctcccactagcaataaagatcatcgccaaagttttaattagcaaagagaaaacaaatgatgaatggaaaaggatattgagcaacaattcgtggtccatgaataatcttcctgatgaactaagagctttatatctgagttacagtgagctatcacaccaactgaaacaatgttttctttattgtgctatatatcctgaacattcaaccattaaccgtgatgatcttactagtatgtgggtggctgaaggcttcattgatgagcagaaagaccaactactagaagatacagcagtagaatactacaatgagctgatccattggaacctccttcaactagacctttcatattttgacctaggtgggtgcaagatgcatggtctcttaaggcagcttgtttgctatttatcaagagaagaatgttttgttggagatccagaatcacaaaatggtaatacaatgagtaaaatgcgacgtgtttctgtggtgacagagaaggacacggtggtgttaccaagtatggataagaagcagtataaagtgaggacttacagaacttcatattccaagtcactgagagtttacaatccacttttcaagaggcttacatatctccgtgttttggatttgactggcacacttgtacagagcatcccaagtcacattggaaatttgattcatatgcgtttgattaatcttgatgggacaaacatatcttgtctcccagagtccgttggtaaccttcaaaatcttcaagtactgaacctgcaaaggtgtaaatctttgtacaggcttcctttggcaaccacgaaactatgcaatttaaggcggcttggtcttcttgatacaccaataaataaggttccaaaagggataggaagactgcaattccttaatgatttggaaggatttcctattggaagtgtaacttataataaaaaaatgcaagatggatggaatttggaagacttggctgatctttcacagttgaggcggcttgttatggtaaaactagaaagatgtactccttgcagcagtgaagattcatttctcctaacaaacaaagaacatctgaaagttctatatctagaatgcactgaaccaacaaatgaagcatgttcagatgaacatgttaaacatgttgagaatatctttgagcagctagtccctccacagaacttgaaagatctatctattctgagattccttggtcagaacttaccctcctagctttgtaatgtctatctgccttcactgaaatatttgatcctctctgattgcaaatattgcatacatcttccaccaatatggcagctacccaacttggaacgcctgaaaattgtgaaagcaactgcaattaccaagattggacccgaatttattgggcaatttccaagatccagggaagcagttgctttccccaagcttgaatggttgatcatcaatgatatgcccaactgggaggaatgggcctttattgaagaagatgagatatcacttgcagcaatgaacgaaggaggaggggatggaactgctgtggccgaagaggaggagatatcacttgcagcaatgaatgaaggaggagaggatggaaccactgtgacggaaaagggggaagcctcatttccaaggttgtgtgtgctgccctctttgaagaggttggacattgataactgccccaagctgagggctctcccacaacagcttggacacgaggccaccagtttgaaagagctctcccttgtagcagcaagctgcttgaagtcggtgaaggaccttccatccctatctggtttcctttctgtttgtagatgtgaaggcctggagagggttacagaacttcccaaagtgagaaagctgtttgtaagtgtttgtccaaatttgagctgtgttgaggagttaggcagtttggagcagctatggttggatgtgaatatggaggactcatcaccgtgggtgcatgggcttcgagagcagtaccgccacctggatgtctacacgtggcctagagagtgagatgtgaagacccaactaaaagacagtagattagtagagacacaaggtaagggcattggctctgtatttgttgatacatatttttattctatcgttatctaaaatagtggaaacatattttaatttcattccaactttgcatattttcagccaaaatcatgcatgtctaatgttattctcacctgtacactttacattcattgatgttgtacactttgcatcattcttagtaaggagatcatcatatatattagacaaaatgtcaaactttcggtagttgttatgattaatatttgtacctatattactgaccttgtcacctaaaactagtacagaaatccttaaaactttgtgttgtaattattctcaatgtccataaccagtacagaaacaagtgttatagcattttataatctattatatcctaaagtacattaaacctcctacaaacgcttctaagccatcacgtagcactcctacgaacactcctaagcctccacatgacattctaataaattaaagaaatttctaaaaattccgagaaaaacaaaaacatcttgtcatttatctttattaaatctggtgaacccatcatttacaaccattagatctagtcgtcaacccgtgcgttgtatgggttattaaaatatttaagaaattcaattgtacatgtggttgaatacatgggttaaaatgattattttgcttaaaaaaatgttggaatggcggcattcgggcatccggtctcttgtactttaccatgatttgacttggaaaacagtgagggaagtctccacggttcggatataatgatgattaatccaaaactaattaattaattcaattaaaaatactcaactacagtaccatgactatagctggccaaatgggtggcccggcccaacacgcacggccccactagtggcacgacccactaaggcacggcaactgtagcaggccgtgcacgtggcccataaaaaattgaaaattgagggaaaaataatatgaagttaaaaaatgaatgaagacaggacaaacgtgaggaaaatttaggaaatatacgaaatatattagaaaatatatggtaaaaataggataaaatatgaaaaaaaataaaaaaatatgagaaaaatatgggaaaaattagaaaattgtagggaaaataaatgggcagctgggccgtgctcgtgccgacccgtcaacaggcatgccgtgccgtgtaagcccatgggctaaggtgctggcccaagcacgacacggacaaatgggccatgccggcacagcacacagtccgcccaacatctgttcctagtgtagggctcctaattaattaaggtttgtttggtgaaacaaaaaagccacctaaatgtctttgtattggttcaaattgattaatagttttgttcgtgttctacctgttaaaagaagaagaggatattgctgatcggcatgcctatgtatagtccatgtgtgtcttttccttatgccttttgtaatgcacgtgtattgtttggtaagttcaattccagaaaatatgattgttgaaaaactgatagcacatatattttcttttccttaattaagttattaaattaccaaaatacttatgtatatatacatccatgattaatttctgtgtgcttatttattttgtaggttgttaatcttgaagaatttgggctgtgcagtcacttgtaatatgtatttttgttttacctagttattggtctttgaaatattaaaaaaattttatttttttaaaaaataaataaaacaaaaatatcaagaaagggaaaatgtcaaaaaaataaaaaatatattttctttagctcttgtaaaatatattgtcatgtttcgttagattttgcgtgtgtgtttcttttctttttatttttttttgtaggtgtgtaggtaactccgcctatgtcatcgtaggtataactaaatgacatagccggtccccagcccggaaaaaggaggaggggatagtttggtatagatgtgtgttgaaatgatgctccgttgctagatcattgggaattttctgcacttttattagattaatttcattttcagtgatggaataattgtggaaacatttctggagactcatccacccttattgctctgttggacaaatctgattctgaactatttaagctagcttgaccagaccaccaggtctaagagctgcgaattgacaagtaggtgaaggaaattcagtgccgaccatgacctgatgaggagcaaaaatttttttcaagtcttggagcccaaatgtgcctgaagtcctgaacaacaagatacaattttgctgcaggatcaaacaattttgctcctctcatttgtttcttgtctttacctagttgctggtctttggaagattacaaaaactgaaaaaaaaaagagtgaaaagaacacgaaaattacaaaaaaaaagtcaaaaaagggatacagatccaaaaatgaaaaaaaaaacgtgtttttgttttttgtcttgcacgtgtgtaggtagctcctcctatgccatcttgggtgtgcatctttaatggcattgctagttccaagcccgaaaaagagaaaattgcatatgtaccatcgcgtaaaattggcttcgtaaaaataccatcacttaaatgggcttcgctagaataacatcctgaactgagtacacttcgccactttaccattttcatcatttcttccattttaaatttattttatcatctttgcatctctttttggactgaaatacccctaagtcatcaacgctgaagcacttctggtcccaagcccggaaaaggagcagggggtaatagtgtatagacattaagtgaaacaatgcgctgctgctatctagagcagtgaaagttctcttgaaaatttctgcactcttgtcaagttaattgcatttttattgatggaatagtttactgaaaaacacttctagacactcatccactctggtgctctattgggcaattctgtttctaaactattttagcttgacctcattgcaaaccagttttcatgtgaaagcaatggaggcgaacacattcaccagttcgtcctcctctcattccctgcatcctgtttgagaattgagaattgtgaacactgcggtgtggaggctgcggttcgtcagaagtttaaattcctagatccagtttcagatacttagcagcatttcacctgatggcatttgatcgtaatgttcagagaatgttatctcctaatgctttggagttcactccccaaattttcaacactgtcatggactctgaaattagaatccagctgtgttgcgttcattactgtaagagctctttttttttttaaacctaagccagcattgctggttttatattaagagagggagaaactgtacagacaagagacatcgggcccgaaacccatacagctgcatggttaattatggggaaccgacatcacagaggaaaacatgggacctaactacactactaacaacaacggcggagcccaaacgcaagacatcattgccaagctaaacacaaaagtggcacaacagctccgacatcatagaagaggtgttatcgttgccgagctagccggccaagcaacccagcagcgccgacttcaccactgcagcgacattgaagccacggaagttgccaaagcgaaagcagctccgacatccacaatggacatcagccaagccatgaaagagccacttccttcacatggccagcaccaactctttggaagagaccgcaacacgtcatcgttgtcaagcgtcgccgcaccccagcagcgagcagctccgacttcctccgtagaaacaaccgaagagtgtgtcgcccaccacaagagcgaagcgaacccaagaggcttaggcctcgccaagcaccaaggaaagaaagcttttgaaccgaagagaccctcaatagtcatcgatgtaaaggaacttccccgaagcgacgcccccaaggaggacacgacgcgtaacgccgccgccgctcgtccgaagccggagcaaggttttcacttggagatttgtggggcaaatgggagagcacattgacaacgccttcaagaagggaaatggcgccaatgggtgcgtcgtcgtcatcgagccggccaaaggtacagcaaggctttcgccagcgtctgcacattacccacacaagcacccccacatcgacgaccaaacgatagtccaagatgactcacaagcattccaccctcgacgcatcctaccatcgcccacactcctctgctgcaccgaccagaaccggccaaggcggccaaggtactggtcgtcgaagctccccgctgccatcgcctccacgagcacccactccccgctatgccgctgccaccgtcgccacaagcgcccgcagccccgctgcacctcgtcaagacgccagtgggcgtagctggaggttgccactgcgccgacaagggcctcgcatccgcctcctcgcagcaccagacccccgccgtcgccggcctcccactgccgctctggcgagggcacactggtccccaccttggcagcacgccatcatccagccaggagggtggtggatctggccaagggccaccggatccgaccgcccccatcgccgggccgagggccaccgccgcctcgcggctgcctcgccgtcgtctcgcggctgcctcgccgtcgtctcgcggccaccccaccgccgtctcgcgtggccccccatcaccggccgagggcctcgccagccggggcccgcgtcctccctcgtgccgctcgatgcccctctccacctccgtcgcgacgctagcccgctggccgaaaccgtgggtgagggggccagatccggccacggaggcgccggatccgccgccccaaaccgatcggccgtctcaccttcggctgcgccgtcgtcggccttctccgtcctcctcacgcagaggacggttccaccgagctgtacgtttgggccttgccgccgccttcccggctcaccactggctttgccgccggcgagcttcggcggcggcgaggtggaggagggggatgagggtgtggcggcacgggtggctagggtttcgcccccgagccgcccgcgtgagagcgacgcgggggacgcgtcctcctttcatcttcctgtaagagctcttcagtcattcagtttagtgcacagactttttagggcccctttgaatcgcaggattgagaaaacataggaataggaaaaacgtaagattttgataggaatgtaagtgtaaaacagaagattgcaaaacgcaggaaaaacacaggaatgaccgtttgattgaatcgcaggaaaaacacaggaattagatgagagagatagactcgtaggaaagttaccaagaggttgaagctcttgctaaatttcctccaaaatctctttaggattgtccataggaatttcaaaggattgtatatgattcaatcctttgtttcgaagggcttcataggaaattttcctataggattgaaatcctccaaaattcctatgtttttcctccaattcaaagaggcgcttagtgtcatcgcaacaagttcatctaacaggtacaaaattgtcttcccctggatgacaaaatgcagcagaaagcaaagcaaaactgaattgcattcagcgacgggaaaagaaagggaggagtgagaggtgtcgcttacattctctggtctccggcacgaacgccgaggtgggggctcgctcgacggccgcgcgcgctaggagctcgaggatgacctcattggctcgtcggatcgcccgctcgcagcaacgcccggttcccttctccccatcgcctctcgctgaagctcctgccgtcgccgggtcgccgtcgctcgcaacgacaacaatacgagataactcgagggcctatacgaaaataaacccccagttcacacttcacaggcgtgtttaaatctcagccgcctatatcagatcgaacggtgcagagaggctgaggttttggatcgctcgaacgaagagattttttttttgacgcaaaaggtagagactaccttataaccattgcattaatggtggtcaaatcagataaaatctggtaaagccgaacaagagaacagaggggggagaagaaggaaaaaacagaaagaaaagacatgagaaaaaacagaggtacaagggagaaaaacaggaagaaagaaaaaaaaatacaagagatacatagatacaaaaggggagacaagatggttaagcgaatttgaccacccaagcagtaatgtgtgctcgaaggcaaggcttgaggcaacgaagagattttggtcgatagtagttgagttcatgttcctttgttggtctgtagcgctcagtgattcacatcatctcaagacatgaatcaacctattttttttagataatggataaaatccggcctctatatccaaaggaatcaacctatttctgtttgggagaatgttagaacaatgcttcccgttgaagtcgcaatccaactagaaatgctttttatatgcagcttgtagatagatgtgcagacaagattcagttcagcacttcagccaaactgtattcagacaagattctattatcaaaagacacaacagtagtccccacatgtgacatgtggaccaaaaggagtgaagtagtatattgtaggagtatttcaaaaactcccctgtagcctccccacttgggtctaattttattttacaggaaccgtaagcaaaccctaggattttgcttatacaaggtttacctaactataccattgatgatagagacacttacattcttgccctttcctaacccgccctgctccttcacactgcggaggcaaactttttttgaatgactcgcacgagattacaagattacaaccctggagggtcgtaaccaggaaaaagaaaaaaaaccccacccacacaccgacatcgccaacacacaagcccaggagaaggctagcaccggaccggccgccgctaagtatgaccgaccgccactaggccgacaaagggacactgacgagatcgccccataggggtgccaaaacgatgtcttcaagaagagaagtgacggaaaagccgctgccgccgtccgtcgggactcgaaggagccaagactaggctttcgcccggcaattacccttgggggatgaaacaacacgacaacaccctcaggagggagaacctcgttgttggttcgaccaaggccggactgagttttcacccgccgctcaccacctgcaaatccacggctgacgcactgatgccccaccaccatacaagctctgccgacctgtgggacccctgcactggtgtccccagtcggctagccttcgagcgccgaagatcgcgccacacccaccagcagattctcctcacacctaggtcgcctcctccaccgtcagccgcgcctctcgcgccaagccggcctcctccaccggacacgcctctcgcgccaatccggcctccctccatcggacgcgcctctcgcgccaatccggcctccctccatcggccgcgcttctcgtgccaagccggtcaccgacccctctaccaaacgatgtcgcgccggccaaatgtagccatctcccacgccctcgtcttgccgtccgaggccgccatgcctccggtgaccgtagtcatggccaccaccaccacagccactgctgttgaacgcaaagccacctcaccgtcctcatcctcacctcgcacctccacttgctgccgccagtgacccgcatccgccgacatcgccagcgcctccacaggctatcgcagaagatcccgccgccgccgggtcaccgtcgatcatgacgacaacaatacgagataactcgagggcctatatgaaaataaaccctcgattcacagtcacaggcatgcttaaatctaagccacctgtataagatcgagcggtgcagagaggctgaggttttggatcgctggaacgaagagattttggttgatagcagttgagttcgtgttcctttgttggtctgtactctgtagagttcagtgattcacatcatctcaagacctgaatcaacctatactatctctgtttgggagaatgttagatcaatgcttcccgttgaagtcgcaatccatatgctttctaaatggtaaatgcaagtagcttgtagatagatgtgcagacaagattcagttcagcacttcagccaaactgtatctgttggacaaatctgattctattatcaaaagatacaacagtactccccacatatggaccaaacacagtgaagtagtttcccagtaaaatcaattgggatagacacatgcaccagttcatccccctctcagtccttgcatcctgctgtttgagagttgagaattgagacacaagttaggcaaaggaaatcattcactgtttgttagcagtacgtacaaagtttggccagatacacaaaaacgcatgaaaacaagtatacttgtaaacaattactcctgtaaactccaatatttgatgagaaatatttctgtatgtttactcgtgaaacctgtccattggattcaacgctaaaagttttgatcccaagtatgcaacaggactggaaataagccccgaattctcatagaaacctctgccgttgtctctgtcaaccagctctttcacaatgcaaatgcatgcctaagcagagaactggttggcgtcaggaaggccaagtgagattctgttctccagacacttggagatactacaaagatttgatctttctcatcttttaatcgccttcttgagagagatcatctcagttgcctgcagcttctagaaaaaaaaaacaggtacaattcagcgaggagagggaaggtcagcaagaagcagataggacacagccatgttccagaaatcagttccaactgttagccttttttttttcctgtaaaagaaacaactgcgttaccactgtcatataggccagaacacaacatcagttagatcttactacggagctagtgcccttgtttggttgattcaggttcattcttgagctaaaaagtactaacagtttaggatggcaatgtcactgcattgcttgactgaacttgcaattccctgaatcacaggaggtagctggcagtagagctactgcgcgtaccataacgtggtgcaccacaccgcccggggatttcacccaggtgctccaggacgtcgccggcgaccccaccctgccccgcaccaagtccgtccggtgcgccgcctgcggccacggcgaagctgtcttcttccaggtcaggattatcgatcacaaccaaaccaactagtttattcagagttcagagttaatacaaaagatactcaactaacgcaagttctgcatattctcaaaaaaaataattctcggtttcggttcagatgccaactgtgattaacagaatgtgtagttgcagatggagtaataattcggggtatctttgtgaacattgcagtggagaggccgcgccaggggcaacgcccggttcccttctcctcatcgccggcggcagcggcggcggcgtctcgacatctcttcctcccttgtacaacgacacgacaacacgagataatacgagggcctaaacgaaaatcggcccacggattccgaggcgcgtctaatctcagccgcctgtatatgatcgaacggtgcagagagaggctgtggttttggatcgctggaacgaagaaattttggtcgatagcagttgagttcgtgttcctctgttggtctgtagcgttcaatgatgcagagatgccgtactgccgttt

SEQ ID NO: 61271 - DNA, 1224 bp, Oryza sativa
ttttgagcaaggtgacgggaagagcacaatgccatgtattgggtcaaaatctgtcaaataacgcaccctgatgttggagactcatgtcattccacacactacttttttgcagcagttctgtgtattctactgctggaagtattttagtatttgaaatgtaacagcattttagagtttgagatgttagctcatgttgacaactctgtactgcagtgtactgctgactggagcagcttttcttgatggaagtattttagaaatctggaagatgaataattctggggtaagtatacaccttgttagcttatcattttatttggagcaccctgcataacgtttcttcaatacttctttttttccttgcatctatgtgaattatttcgcagctcattcaattgaccctctacacttttgaacttagtgatgtattgatcaaacacccactggctattgaattgagtggctactttgcacattgttgtccataaggatgtgataggctgatagcagatttttaggcatgcaattagtttgttcatttcatcggtaattatgaaatttgagctgaataaaagcaagtaaggagggagttaattggaaactttcactagtgtactctgaaaggtctagaaaaaaatggagataaatgtgtttaccaagtaaaagcggcatcacttcgatgacttgttcatatataaaatttcaaacagcagaaacagctttgctttttcccctattggttgtttactattgaaccttgcaacttgcaaggagccaaggactgaatgattaggacacttaattaaaatctatggcatttagatttgatttctaaaacctttcattgtaattgtgtaccatcgaacactatggaagagtttagggtgtcagcatgtgattttcatttgttttatagaaagagcaaaagttttctttcaggaaattaaaccatccatgtatttaacttaacaatgctggagagaagatagtatatgtttctttattgtcattgtttttgttttgtatgttgaaaagtatctaatctgcatatataatgtttgatttcacatggattacaaactgtattgtttttctcatatagcgcctactatgagagtcagagagtgtgtgtactttcttgtattgtgtgttagtagaaagtaaagggtgacccttgtatagtagattcaggttattctcacatcctatgctctagtatatatg

SEQ ID NO: 61272 - DNA, 6615 bp, Oryza sativa
gttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgtttaataatactgtgtagctctaggatcgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagctttggagaagatgtcttaggtggagtcctggcttataccccagtggagcgcctgtgaagatggagccgtaggcccgctagtccgctgctgtttatttttgattgtcaggcctgaagcgcctttgtaataatgtaaattttatcgatataataaagatgtgtcttttatatcatgtttgtgtggtgtaccccggcttttcctgggacggggattaatacactagcgttcgggaaaaggcaattttcccggtcgcgacactcagtcttgctcaattttttcccaaacccagaagaggagttcctggaagatgaaggctttggtgtctagctcgtgcctgccgtcaagtgcctgtggtcgtcgccctaatcttccactgtttcccgtttgtctttgtgtgtgctgggccttcgccgcccatgtaataaattaactatttacggttccgcttgttaaactctgaactgtatcaacttttggtgtaccttgcctcctgggacaaggaataatgcacgcacgtaaggaacgcccgttgggttatttccggtcgtgacagcgatggaatgcgcgcgcggcgacgggatggcgacggcgacggcgcggcagtggtggtgcacggcgcgaggcggcgatgggatgcacgcgcggcgcgaggcgggacgcgacggcgcgacagcggcgatgggatggcgacggcgacaggcggcgatggcgacgacggcgcggcggcaggcgacgatggcgacggcgcgcggcggctcgggacgcgaggcggccaggcgcgacgggcggcggcgcgtggtgacggtggcgacagagagagggggaaagaggaggagctgggttaggggaccacgtcgaacacctggcggccgatgaatagtgtctcttcctatttaatccccattttaccctatttcttgtgtaaatttgattctataaatcctagattttgtgtaaatgaagtttactcaatatttgtgttattccaaccaatggatttactctagattaatattagtcattttttttatttatataatttatttgaatctttaattagggttaattcttattccatcgcatttaaattcaattgatccaaatatggtcgcgacaatattttatttatttctatccacacctaatctttattttaaattatatttattttaccaatttgtttttagggtttattcctacttaactattctttactcatgattaatgaacttcgaaatcaaatcaaaataaaataggcaaacaagatcggcatgatgcaattaatttaaaaagtttttgaaaatccgtatttttagagttttgatttttgccggtcgaattttcagggtgttacaccgggagaaccccgatgtgttcccagacgatttacctggtataccgcctaaaagggatatagagttcagaatagatttggtaccaggaacaactccgatccataaacgaccttatggaatggcagccaatgaattagcagaagtcaagagacaagtagatgatctgcttcagaaaggatacatcagaccgagttcatctccatggggagctccggttatttttgtggaaaagaaagatcatacccagaggatgtgtgtggactatcatgcactaaatgatgtgactatcaagaataagtacccgctgcccagaattgatgatttgtttgatcagcttaaaggtgccaccgttttctccaagatagatctccgatcagggtatcaccagttgagaatcaaagaggaagatatacctaagacggcttttaccactaggtatgggttgtttgaatgtactgttatgtcttttggacttaccaatgcccccgctttcttcatgaacttgatgaataaggtatttatggaatacctagacaagttcgtggtggtctttattgatgacattcttatctactcctgaaccaaagaagagcatgaagaacatcttcgccttgcactagagaagctacgagaacatcaattgtatgccaagtttagcaagtgtgaattttggttgtctgaagtgaagttccttggtcacgtcatctcagccggaggagttgccgttgatcctagtaatgtggaatccataaccaactagaaacaaccaaagacaatctcagagattcgcagtttcctgggtcttgtaggttattaccggaggtttatagagaatttctccaagattgctaagcccattacacggctgcttcagaaagatgtgaagtacaagtggtcagaagaatgtgagcagagttttcaagagttgaaaagtcgcttaatatcagcacccattttgattttgcctgatccaaagaagggtttccaagtgtattgcgatgcatctaagcttggcttaggttgtgttctgatgcaagatgggaaagtggttgcctatgcatctcgtcagttacatccgcatgagaagaactaccctactcatgatcttgagttagctgcagtggttcatgcgttgaagatttggcgtcattatcttttcggtactcgtacagaggtgtacaccgatcataagagtttaaagtatatctttactcagccggatctgaacatgagacaacggagatggttggaattaattaaggattataacatgggaattcattatcaccagggaaaggctaatgttgtagcagatgctcttagcaggaaaggctattgcaatgctacggaaggacgacagttgccattggagttatgcaaggaatttgaaagattaaatttgggaattgtcagtagtggtttcgttgcagccttagaagcaaagcccactctaattgatcaagttagagaagctcaaattaacgaccctgatgttcaagaaattaagaagaatatgagaagaggaaaagctatcggtttcttggaagacgagcaaggaactgtatggttgggtgagaggatctgtgtccccgacaacaaagatttaaaagatgcaattctggaagaagctcatgatactttatactccattcaccctggtagtaccaagatgtaccaagatctcaaggaaggattttggtgggcaagtatgaagcgtgagatagcagaatatgtagcagtatgtgatgtttgtcagtgagtaaaggcagaacatcagaaacccgcaggtttgttgcagcctttgaagataccagaatggaagtgggaggaaatcggtatggatttcatcactggcctacccagaacgtcgtcaggccatgactctatttgggtaatagtcgacagacttaccaaagtggctcatttcatcccagtaaagacaacatattccggaagtcggttggcagaattgtatatggcaaggattgtgtgtttgcatggcgttcctaagaaaatagtgtccgatcgaggtagtcagtttacttcaaagttttggaagaaacttcaagaagagatgggttataagctgaacttcagtactgcttatcatccgcagacagacggacaaaccgaaagggtaaatcagattttggaagacatgttgagagcttgtgctttagacttcggtggaagttgggataagaatctaccttatgcggaattctcgtacaacaacagttatcaaactagtcttcagatggctccttacgaagcactgtatggtcggaagtgccgtactccgcttttgtgggatcaaacgggagaacgtcaggttttcgggactgatatcctaagggaagcagaagagaaggtaaagatcattcaagaaagattgcgtgtggcatagtctcgccataagagttatgctgacaatcgccgcagagatttgagttttgaagaaggagattatgtgtaccttcgtgtcacgcctcttcgaggggttcatcgttttcacaccaaaggaaaattggcaccgcgtttcatgggaccttacaagattgtcagtagaagaggagaggtcgcttatcagttggagttacctcaatctttggcaggagtccatgatgtgttccatgtgtcacagttgaaaacgtgtttaagggtacccaccgaggaagctagtcttgaacagatagaaatctaagaggatctgacatatgttgagaaaccaatccgtatcttggaaacagatgagagaagaaccaggaatcgagttatccgtttttgtaaagttcaatggagtaatcactcggaagaagaatcaacttgggaacgagaagatgaattaaagtcagctcatccgcatctgttcgccagttcttccaaatctcgaggacgagattccgtttaagggggtaggtttgtcataccctaaaaatcctaaatatataaattgttgtctaaattggaattattagaatttattttaaaagcctagaagagaagatcttattttaattaataaattccaatataaaatggggccagataaaatttcattaaatactttgcttaattctataattcctagatttttctgggatttatttgagctaaggaagtatttttaataaatagaattgtatttaatgaataatttaaattgaaaaaggtttttaaaatcctcttttggctttgggccgaaagtcggcccaaaaccttctctctctctccccggcccaagccggcccagtccgcccgcgacaaccgcgtgcgcgcgccctcggacgctgactggtagggcccgcctgtcaggtcgtcgtctacctccggccgcccgccgcccgagccctagcgccacgccgccgcaatctccttccaaatccggccgcccctttctgtttccgatgaaattaatagaggggaaatgatccccgggatcccctctatcttttctcttatggaatcgtcggctaatttcgtttggaaatccgtggattcgatctcgaatcggattcatctctctccccaaaccctagaccttccttcgccgtcgccagtcgctgtgggcctccgacgccgcctccttgcccctataaaaggacccccggtgtctccgctacctaccgccaccctcgccttcgcctctcgtcgcccctagagccctagcctcatgcagcctagcgtcaccgtcccgtcgccgccgtcgctccagccgtgcgccgccgtcgcttcggtcgtcgccgtcgctcggggaggtcaccattgtggtcgccaagtcgtcgcagtccttgtccgcccctccgccgtcgctgtcgaccgacggatccccgtcgccgtcgtcaagccgaagagcgccgccgcttcttcctcgtcgccgacgtcgtccggtcaccgtccgtcgccgtttaggtcatcagtgagttcgccgcgtcgcccgcattgttttggtgctctctgttcgcatcgccgcgccgtcgttcgccgacgggcatgcgtgcccgagtcgtcgccagtgatgacgtcactgctgacgtcatcgttgtcgttccccctggcccagtcatggaccgatggatcttggccgtctgttttggatggatcaatctcggccgttcgtttccgtgagccgctgctgtgcacccggttcaccgcgaaccctagccactgacgcaataaacccctttttccttttcaaaaataattcattattgcgtcataattcaattaaaatctaaataaatgatttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgttttgctcctttctatttagattccgacatttccggagagtccgttttcgcagcagaagaatttgaagagttccaaggccagcaaggcaagtcacacagatcccaaacaaccctttgagcatgttgatcccgtttaaagttgttgtttttattcaactattacatttattatcgaatgtcattgggtggaattaacctattgtttgttatagcccttttgttcttgattactttattgcttgataccttgggttattataacttgactagttgagctttatatattggttcagctatatattagatatgattgcttagccatgcttagaaactttagcacactattgggataacttataattcactattatttaatgctggcttaatgatagctcacgatggtcaatcgtgattggttaattaattaaattgccaactaaaacttgataatggtgggttgtg

SEQ ID NO: 61273 - DNA, 4837 bp, Oryza sativa
  unsure (1)..(4837): unsure at all n locations
cgcagaacgaccagagcacagcgacaaggcgaccaccacaaagancgggccatcaacaagacacaaanaaananannannnnaccccccacccctccccctttccaacaagaaccaaacggacggcgaggaagaagaagaagaagaagaagaagaaggaggaggaggagaaggaggaggagaaaggaatttgcttttgctgttgctgccgcagcggctgccgatgccgcggtggtggtggtggtgcgcgtggccccccgggggtagcgtaggcagcgtatgacgcgtgaggctacagtggtgaaggtgaaggtggtggtggtgcctggttggagccactgttatatatactgccattgttgctcctgctgctgccaatcttgggtgtttttggggtggttttttggttttggttttggtttatagggttctttggtttggtttaggagggggtggagggaattggaggaacagtctgtctggacgagtgccaactgtgtgccgacatagtatgcgctgggattaacggacggacgccgatgcctgcccagggtatcgggcggtttctggttcacttcctacgtcttgtatgcctgcccaaggtatcgggtggtttctggtgcacttcctacggctgatatggtgctggcgggtgggggtgggagcgtcgtgatatgcgccgatggtttttccggcgcctatgtaaatctgggggccgtgagagaggttttgttttcgtgcgctggattcactggcgtgtaagtatgcgtattaggctatgagtaattgacggcttgtccgcttccttcttagtgaagtaatgatactgtaataatgagatatgcttccaaaacaacgagaggtcgagagcgatcaaggtgaaagttttaattaaccatgcctagcttcctggtattcatgaatggtattctatgctacgatagtccaaaggcctatggaacctgtttcacatgtgtataccgagtctatataagtaattgtgtgttccttatcaatgttgcattgaggatgctatagaagacaataatatttttttaatgaatgaaccagccttgatcttctttttgtttaagataaaagaagaaggaaacctgtgataatgtggtgtacgcccaaaggaagaaaagtataagcatgaaggggttgaaaggtgcaaatgatgaaagctttctgctgcagccaagggggagagagagagggggatcgatgaatgatgctagggggaaaggtaacatcaacctactaccatggccactctctctctctctctctacatatcgctctctctcgtatggtgtgttttggtgttgcatgttgtccctgctggctgatgcagctagcggagctcaaaccaaaccactggcccggcccggctcttgggccaccatctcctgcgcagattcctcttctgccaaaccgaggaaaggttccccccttgtccctccctcctcctctctctttctctctctccttccttgaatcaacctgaccatttcaaaaactccatcacaactagctgaatttgtctcttggaaaatggcattagcttagcagcaaaatgtggcaataaaattatagaaaacatgcagtgttatgtacagtgtaactgtgtagagagagagagagagagagagtgtgtgtgtgtgtgtgtggaggaagaagaagctgagagcctgagagcaagcacggtcagtggcctctgatgtctttgacctactagcatgcatgcatgtacaccactgttgcaacatcagacgagatggatggatcgagctgggacgcatgcgagttaatacttttttttattctatattgatcatcatatatataagttttttcatgaaaaccaatgtgagttgagaacatttgaaacgttgtagagagttttagcaaaatttgttaagtcttctgaatgtgtaacacatctggtcgtcgccttcatataatttgacaggcacatatcaagctgaagttgactggatatgtgagattgtctcacatgttcactactcgatatcacatattttatttaatgtaattaagttgtgatggaaaaaatgaaagcttaacaacctctaaatgcgtgcatgcatacatgcatgcttaatttgcatgcatgcataaatcgcatcacttaacattgggtgagtatgaattatcccaagatctgaaatcagacatctttcatgctcaattattaatatcggatgaagaacctctaacttaatccggagtggttatgatcttagttggtagtcaagtcagcattttatttaaaaacaatatgcggaatccacctatcagattctctccgtttcacccctctctaacagatggatcccaccgatttcttaaaaaatgctacctagactgtcatgtaggaccaaaaccactctagattaagttaggagagttcttcacttgatattaatagttgagggtaaaaaatatctagttttcagatctaggtgtaattcgtactcacctaatagtttagaggtgtaatttagactttctcctaaatacaatactgttgcacgtcaaaccaaagggcactggttatataatgatcaatttaaattttttagtattatatgatgatcaatatgtgaagggatcgatgatgtcacactacgtattatgttagtttattttagaaagaaaggagcatggagaatctcttattaccatgtagcttgtctctgtcctctcctctccggcatgcatgcacgcgcttgcgttgcttcgtttcgcttggttgcttgcacgcttgtccatgcatgcatgcacgcgtggtgtaccgcgaaaatcttttggatggctgcgcctagctcgtgttcgtgcatctatctatctatctatctatctatctgtctatcttgcatcatcatcacgtactctatctgcctatcttgcatcatcatcacgtactggatcgatgtatgtatctctttcctcctcctcctcctttttttgatctagcatatagcttaatttgttctcgttctcgttgttgcggtgtacgctctgctagattccaatgcagatgcgtggtagtactcctacgtgggtaacatgggacatggccgttgttgcttgctcgctttgctgatctctggtggtttctctcacgcccaatgacgacgacgaccatgatgatgattgatggaactccggaaagggggagattgttttgtagggccgtagctgtctctggaacagatatgctgcatcgatctcggaccaaccctgctactagtagtggtagtggtggtagcggagatcggtcgatttttttgggccctgttgattcaagtggacgggcaaatgcgaccctccccacacggttgtgcatgggatcgacgttttcctcctcccacgtactacctccttccctaaatgtttgacgtcattgatttttttaaatatgtttgaccattcgtcttattaaaaaacttttgtgaaatatgtaaaactatatgtatacataaaagtatatttaacaataaatcaaatgataggaaaagaattaataaatacttgatttttttaaataaaataaacggtcaaacatatttaaaaaagtcaacggtgtcaaatattttgggatggagggagtacgtacgtactacctccatatatttcgatagaatcgactaaggcagtgtttgtttctatggaaggaagataaagttagtgcacagaaaacacgaaaaggacccgtaaaaaaacacgaaaagtcattattaactcataatttattaataagttttcattattacaaaaaaattgtgcaacaactttcatttatcaccgctacataacaggtttttccatacggtccaatcccaattttcacggatggcagggcgatccacatgcaccaaatggtctgtgaaaatcgttcacgcgaaaatccgactttttacgtgcgggtgcttatgtcgcccgctcgcaaaaataaaaatccaaaaaaattaaaacccaaaaatggcgaaacctaacctgccctcctcgtcgtcgttgtgggggcataggggcctagcggcggctgggtccgcccgctcccgtcgccggagccagagccagatccaccgccactgtgcctcccactgccgccgcgcggggtagggcagccgctgcccctccccaccgttgtatccgccgccgccgcgcctcactgttggtatttattatgaccacggaataatctataagcgcacaaataccgttgtagccttcacccaagagtattccagtgtatcgtatccacagtaaacgtgtgtgtataatctaagaacgaaattcttcgaaggacaacaactaaatgataggcttgggatagagtggactcctgtgggttagttatcttaattaagttaacgtaaaactctatcacatgggcaagataacttgtcaaaaaaccaaatcagtgccaggtccattggtgaaagactatcttagcacaattttccatttgaaaaaataatagtaaaaggacctcgacaatcctttgctagccaataattcacatacctattcatgtaaacaaatcacaactacgaaaaggattttttcgtgcggtggaaaagggttttcacgtgcgagtgggcgaaccgcacgcacccagttgtctgcgaaaatcgctattttttgcgtgcgggtggcgcaccctcatgcgaaaatctgattttcacgtgcgggtgcttatatcgnccgcnnacgcaaaataaaaancaaaaaaaaaaaaaaaaaaccgaaccctaaccttgcaccaataccgtcgttctcgtcagatccgncatcngcacgcctct

SEQ ID NO: 61274 - DNA, 551 bp, Oryza sativa
tttcaactataactataactatagtataattataatataatttcactataactatactataactataatataacttgtatataagtattaactagaaaaaaatatccgtgcgttgcaacgggtaaatattattttaattctattgttgttatacggtttagctagggtaaaattcactgtgggaattcgcttggatatttattttttagaaaatcataagctacaattagtagtccatatttcatctcaagttagcatgtgagttttttaaagagatttcttatcttttttatttccaaaagcaaatgagcttaaaatccaactcaaaaacatatctgtatttctaaaaatgagcgaacttaaaaaccgactcaaacacggacgacgtatcaaaatgccggcaaaaacatcctcaacttttataagtactagaaaaatacccgtgagttgcaacggatgaatactattttaatcttattatcattatacgggttagctaggataaaatttactggggaaatccgtttgaattttttttaagaaatcatgag

SEQ ID NO: 61275 - DNA, 15757 bp, Oryza sativa
ctcttatcacctggacactatggaatggttggactattgtggaattagattcacacctcccccactattcaaaatcttcaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcagagggccggtgtcctgctgctaggggctcagtcctgcctacctgtcccggaggttccggccgtaggtggggttgggtcggtactcttgtctatggctaggatgggttggaaactatgtcacgtcttcagtccgtataccgtggtggtatgcggcacgtggttacacgtgaggaagatgtgtcttgtgggtaaagatgtacacctctgatcagagtataatctattcgaatagccgcgcccttggttatgggcaagccgagcaatgtacccaagttagtgttttaattctcaaaacctgcttaacaactaaaatgtggaatggttggcctgggttggcttgggacgagctgggacccagcgtcgggttgccagaacgccgcactcctcgccatcggcactcttcaccagcgctacccggacgagttgcagcactcgccctaccgctaccaccctcgtcgtggaggagcccgcgactacgccatcttccgggatgctagctcggaggatgacgctaccatcatgcacctggcgcgcatggtggaggcgtacgacgcgacccgtatcgacttccatcagatggtgcgtcgtgggttggtcgagaacagcatgaagatcctggagctgcgtcaggagaatctgcagctgaagaaggacctagacgcagtggaggcgcagctgcatcagcttaagatcgcccagggagaggtctgtcgccccaagcgtcgccgcgtctgccgcagcctgaagatcaccgcccgcaagagtacctccgggcccgagcttgttcgtcagtccctggcgtggacctgcttcgtcgagacccctcgtgccgagcccgcgcccgtggttccttaggaggatggagcctccggcgttggcagcacggaggatgcgctgctactcaccttccgccctggcccgtcgcagcagtagacgagcagttagtaggcttgcgtgtgtgttcttctcgtttgtttttctgctagagtcgtatggggcatggttaagccggtgtgtggtataactgtgtcggagcctgtctttattttatttgcttaagcaacttgaactttaatgaaccaatttaatagcagtaataaattcaagaattatggtagtcatgagtggttagttttagttgtcagctctctctgtttgctggttctgtgtggggttttcagatggtgacaaccaggagaagtgctgctacaggtgaaggcagtcaccccgaaggcagcaaccacaacaaccatggcagcccacctccacctcctcctccgcttccaccaccaccaccagacaccaacgccatcctcacccaaatcctcgcccagcaggccaacatgatggctgctttcctccaccacatccaaaacccgccacaacataatgctccaccaccacccccacaacactctaaactcgccgagttcctccgcatccgtccgcctaccttctctagctccaataaccccgtggatgcgttggattggttgcatgccgtggggaaaaagttagacatcgtgcagtgcagcgatgaggagaaagtcatcttcgccgcccaccaactgcaggggcctgcatctctgtggtgggaccatttccaggctacgcagctagaggggcaacctattacttgggcccgcttcaccacgtctttccggagaacccatgtgcccgccggagtcatggcccttaagaaaagggaattccgagagttgaagcaaggcaaccgctccgtgatggagtacttgcatgagtttaacaacctggcctggtacgccccggaggatgttcgtgaagatgaggagaagcaagagaagttcttggcaggaatggaccctgagctgtccgtgcgtctggtctccggggactatccggatttccagcgtttggttgacaagagcatccgcttggaagccaagcagaaggaactggagtcgcacaagcgtcgcttggcgaatttccgcaaccaacggggggctaaccaaagggtccgctacaccaatccctatccagggggatcctcctcgcagcagcagcagcagcagcagcctcgctccgcgccccgacctcaattcgtggtgcgcgtcccacagccgcagcaacagcagagtcagcaagggactcgtgcgccccgtccccctacgccagctctgcagcctggtcaaggccacagggacgctcaaggtcagcagcgtctgtgcttcaactacttcgagcccgggcactttgcagctaaatgcccaaagacgaggcgccagcaaggccaagcgcctccccgctctaacaacggtggtaaggatgtcattcggggtcgtgtgaaccacgtgacggccgaggacgtgctgacaactccagacatcatcgttggtacgttcctcattcattccatccctgctaccattttgttcgactctggagcttcccactcgtttatatctgtgccattcgtggggagaaatcggttgggggtagaaaggcttaggaaccctctgctcatcaccacccctggaggggttatgacagcaaagtattatagccctgccgtttctatagaaattcagggaattcattttccctcggatctgattcttctagacaccaagaacttggatgtgatccttgggatgaattagttggctcaattccaaggagtagtgtattgtgcaagacgcactgtcactctgtaccgagggccggaacaaccggttgttttctttgcacccccaacctctgttggcagttcagaacttcatcagataagactgtcggaaatccccatcgtcagggagttcggtgacgtgtttccggaagaactacccggtatgccgccgaagcgagagattgagttccggatagatcttgctccaggaaccactcccctgtacaagcatccctaccgtatggcagcaaatgaactggccgaagttaagaaacagttggaagagttgaaagaaaaggggtatatacggccgagtacttccccctggggtgctcctgtgatttttgtggagaagaaagacaagacgaagaggaggtgcgttgactacagagctctcaatgaagttactatcaaaaacaagtaccctcttccccggatcgatgatctgttcgatcagcttaaaggtgccacggtattctccaagattgatcttcgttccggatatcaccagttgcgcatccgtgaagaagatatcccgaagaccgcattcaccacgtgatacggactgtatgaattcacggtgatgtcgttcggtttaaccaatgctcctgccttcttcatgaacttaatgaacaaagtgttcatggaatacttggataagtttgttgtggttttcattgacgacattctggtgtactcacaatcagaggaagaccatcagcaccatctccgtctggtgttgggaaagttgcggcaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaaattcgcagtttcttgggtttggcaggatactaccggaggttcatcgagaacttctccaaaatcgctcgacccatgacccagttgttgaagaaagaagagaaatttgtgtggagcccacaatgcgagaaggcgttccaaactctcaaggaaaagctggtttcctcgccggtgttaatcttaccggatactcgcaaggacttcatggtgtactgtgacgcttcacgccaaggactggggtgcgtgctcatgcaggaaggtcatgtggtagcctatgcctcacgccagctacggccccatgaaggcaactaccctacccatgatttggagttggccgctgtggttcatgctctaaaaatctggcggcattatctcatcgggaatcgctgcgaaatatatactgatcataagagtttgaaatacatattcactcagtcggatctgaatcttcggcagagaagatggttagagctcatcaaggattatgatgtgggaattcactatcatcctggtaaggccaacgtggtcgccgacgctctaagtcgaaaaagccattgcaacactcttgaagtccgtggcattccacccgaacttaatcaacagatggaagccctgaacctaagcatagttggtcgtagattcttggcaacgctggaagccaagcctaccttgctcgatcaaattcgcgaggctcagaagaatgatccggatatgcgtgaactcctcaagaatatgaaacagggtaaagccgctggtttcacagaggatgaacacggaaccctatggaacggaaatcggatatgtgttccagacgacagagaacttaaacagctgatacttcaggaagctcacgaaagtccttattccattcaccctggcagtacgaagatgtacttagacttgaaagggaaatactggtgggttagtatgaagcgggaaattgcagagttcgtggccctttgtgatgtgtgccagcatgtcaaggcagagcaccaacgaccggccgaacttctccaacctctccaagtaccagaatggaaatgggatgaaattgggatggatttcatcaccggacttccaaaaacccaaggcggatatgattctatatgggtagttgtggactgactaaccaaggtagctcggtttattcctgtgaagaccacctatggaggtaacaaactagccgagctctacttcgctaggatcgtgagtctccatggcattcctaagaaaattttatctgataggggaagccaattcacctctcacatttggaagaagctccaagaagagctgggtacccgattaaatttcagcaccgcgtatcacccgcagacagatggacagaccgagcgtctaaatcaggtcctagaagatatgcttcgcgcatgtgtcctagatttcaggaagacctgggataagagcctcccctatgccgagttctcctacaataacagctaccaagccagcatacaaatggcaccctatgaagcgttgtatggacgcaaatgccggacactgctattatgggaccaagttggggaaagccaagtgttcgggactgatatcctgagagaagctgaagctaaagtcagaaccattcgggataatctaaaggtggcacagtcccggcagaagagttatgcagataactgacgccgtaatctggaattcgcagtggacgattttgtgtaccttcgggtcacgccattgcgaggtgtacacaggtttcagacgaaagggaagctcgcacctcggtttgtgggtcctttccgtatcattgctcgacgcggggaagtcgcttaccagttggagctgcccgcctccttgggcaacgtgcatgatgtgttccatgtgtcgcaactcaagaaatgtcttcgagtgccatccgagcaggccgattcagagcaaattgaagttcgcgaagacttgacctacgtggaaaggccagtgaaaatgctggacaccatggagcgcaggaccaggaactgggtaatccgtttttgcaaggtccaatggagcaaccacgctgaggaagaaactacttgggagcgtgaagacgagatgaaagcaacccatcccgatctcttcgccagttcttccgaatctcggggtcgagattccgtttaaggggggtagctttgtcgcgtcccaaaacgactctaaaatacatcctctaaattatgcctagaataattaaaatccgtgtaaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtccccttcccctccctctctctctttggccggctcggcccatctccctccccctccctctcctctccccgcggcccatccggcctctccccgcacgcgcgccgctgacgggtgggcccgcccgccaccctcgctgacgggtggggcccacctgtcatccccttcctcccgccgctcccgccgcctcgcccgcgccctagcgccgccgccgtcctccccgcgtgaaatcaatagggtggaattattccccgtgattccttccccctttccccccaattttccctccctctctcccttggattcgtttgaaaaccctcccctaatcccgccggcgccattgatggagcccgagagcgccgcgccggtttccttcccctccggccgccctctcccccttccaaccctatataaaccctccccgcacctcctccgttcgtttccgcctctcgccgcccttcctcctcaccggaatcgatctcgcgccgtcgctctctctctccgccgtcgacgccgagcaccggtccgccgccgtcgtcgccccggaccacctcccacctcggcgccgcctccttcggcttcgccgcatcctcgccgacctcgtccacccctccgtttcgctcgtcgaccgccggagcaccgtcgaccccgtcgacccgagccgcaccgccgccttcctccgctccggccgcctttttcgtcgtcgccgtcgacctagggtgagccgtggaccgccgcttcttttcccccttcccttcccctctctcggccgccactccgccgcgccgcctcccgccggctgcgccggcttggccgccctcgggcgcgccgagtggctgccgcgtggggcccggccgtcagccgcccgcgcccttaggtgcggctgacgcgtgggacccacggcgccggccggtgtgagcccgggtgcacccggtccaccgtggaccgtaaggctgccgcgtgggtcccacccccatggacccggtccgcgtgccccctcccctcggctgacgcaataaacttttttttaaattaaaatttaaatgaggaaattcgcaaatattcatttaaagagcatataaacttcaaatggccataacttggccatatgaactcggaattggaccattcaagtctctaatttttccttaagaagtcaagaacccatttttgtgctttgttcctgcttgttatatggagttttttagagtaaaagacttttcttttccgttggtcatgtagacgctgcagcttcggaagatccgcttttcgtggaagttgaagccgacgtttgggaaagcgagcaaggcatgtcgcatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagagtaaacaaaaccccaactagtggatactctactcatggtaccactagtatcattttaggtagacgcttcgccgcttaattaggcaacattaggtggttttataactctagactttgggatactcttatcacctggacactatggaatggttggactattgtggaattagattcacacctcccccactattcaaaatcttcaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattctcaaaacctgcttaacaactaaaatgtggaatggttggcctgggttggcttgggacgagctgggacccagcgtcgggttgccagttcggtctgattcatcgtaggccttgggttaaggcaggttcgtgtgggttcacggccttgtttaataatatggtatagctctaggaccgtatttacaaaatagctttgagcaactaagtgtcttttaatgctgtttactgcaaaccctaaccctttatattataacccccttgtactcccttgcatttattctgcacttgtgggtgtgtcttgttgagtacggtggttgtactcagtgtcacgtcctgataaattcatcccgaaataaaaatcattttctaaaaggaataatagaattaattaaaattcggaaagaaattggcaaacactaaaatacgtacaagaaaaattcaaatgtggcccggagaatttttgttaaattctccttggtctaaaaagagccctcaaattttagtggaattttcagagcacaaataataattgagaagaaataaacaaagttaaaataattttataaaaagaaaatccctaaaagtcttctttccccccctttttccctcttgggccggctcggcccaactccctccctctctctcctctcccccgcggcccatcggcccctccccgcgcgcgcgctgctgacgggcgggcccgcccgccaccctcgctgacgggtggggcccacctgtcatcgcctacctcgcgccgcgtccgccgcccgcccgtgccctaacgccgccgccgccgccgaatctgccgcatcccgccgtccccgcgtgccataaagagggggaaatcactccccgtgattccctccctctttccccccactttcccctctctctctccctcggattcgcccggatttattcccaaaatcctcgccggcgtctttgatggagccgagatcgccgcgccggtttccttcctctccggccgccctctctcactctcgacgctatataatcgttcctcctgcttcgctcctccgtttccgccactcgccgcactctctccccgtcggattcgagctcgcgccgtcttcctctctctccgccgtcgccgccgagctccggttcgccgccgtcgtcgccccggacctcctcccgtctcggcgtcacctccttcggcttcgccgcgtccccgtcaacctcgtccaccccttcgtttcgcccgccgaccgtcggagcgccgccgtcctcgtcgatccgaaccgcgccgctaccttcctccgctccggtcgtcgtttccgccgtcctcgtcgtcccggggtgagccgaggaccgccgcttcgcttccctcttccctcccctctctcggccgccgctccgccgcgccgttggtcgccggcggcgaccatcggggcgcgggtgcgccgcctcccgtcggccgtgccggcgaggccgccttcgggcgcgccccgcggctgccaggtgggcccggccgtcagccgcccgcgcccgtgggtgcggctgacgcgtgggacccatggcgccggccggcgtcagccgcgtgcacccggtccaccgtggaccgagaggctgacgcgtgggccccactcccgtggacccggtccgcgcgccctctcccccggctgacgcaataaatgagtttttaattaaaatttaaatgaagaaattcgcaaatatccatttaaagagcatataaacttcaaatggccataacttggccatttgaactcggaattggaccgttcaagtctctaattttttccttaagaagtcaagaacccatttttgtgctttgtttctgcttgttatatggggtttagtagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttacaaaattatttttaatttaaattaatgcattatcgctttatttaaattcccgtgttatcactgttttatttagccatgcctatttacctttgttatgaccttattattattgctattgttattattaccttgttcaccctaggataaacaaaaccccaactagtgagtattctattcatggttccactagtatgaatttaggtagatgcttcgctgattaattaggcaatattaggtggttttataactttagactttgggaattctcatatcatttggacactttggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggggatggatgaagtcgggggtcgatggacattctccagggcaaatgaaggctacacgagctgcggcccggtagtcgagatgtcgtggcagagggttggtgccctgctgcttggggctcagtcctgcctgcctgtcccggaggttccggccgtaggcgggattgggtcggtactcttgtctatggctaggatgggttggaaactatgtcacgtcgtccgtctgtataccgtggtggtatgtggcacgtggttgcacgtgaggaagatgtgtcttgtgggtaaagatgtacacctctgatcagagtaaaacctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgtttaataatactgtgtagctctaggatcgtctttataaaatggctatgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagctttggagaagatgtcttaggtggagtcctggcttaaaccccagtggagcgcctgtgaagatggagccgtaggcccgctagtccgctggtgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttacaaataaaactatttgcgaaagttcctttttctccttcccgtaatgctatttgcaaaatggtttactcttttcttccttcttcaaatttcaactagtactagatggtcagctttgcgaagaagaagatgtcgtcagttgtttgccgaagctccagaagactgcaggatctgctagcgaagtataggaagcagtgaagccagctgtgaaggagtgaagatcttgggaacccatcgtagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagcctaacatacatcataacagcaaaagacttagatctgttaaggtcctatccttagttcctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcagatacaacctcaagtgcagttggaggcagtccaagcactcacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagaaaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcggatgatgaagatgagaagtctccccaaggtttcaaccagaataaaatggaacgtaaggcatgctctcgttgtggagaaatcggtcatgttgccagctcgtgtgccactacatgcgttcattgtgaggaagaccatccacccgacaggtgtccaacgagcaggatcacctgtttcttctgtgaaggaactgatcatgtaccaaaagattgtcaatccagttttctgctgacgaagaagatggccaaccaacccgccagttccaacggagagaagcatcaaggcaacacaaatcctcgccaagattacagtttcagcctaactccagtgccaggacagaggaatcaaaatgagaaaagaaaatgccgagtccgggaagatatctgttgcttcaattgtcaaggaatgggtcatttcaccgacaagtgcccaaaaccgagagacatagctgccagcacgtcagtccacgcaactccctgcaatcagaagcttgctcctcagcgaattgtcatccatgcatcccgaagcagtcctatagcccgcgttgcaacagctccaactccagcgagtgcattaccacaaggtgtcaatgctcaatttcagccccagccaccggttgacaagacagaggccagtatcggcattgtacctttggatgttccagcacagccgccaagaaatcaagtacaagatgaagaacccgagcgtaagaaagttatttacaactgtagtacctgttaaggaagcagacatgccaatcgccaagtggtcactggagcaaatgcagtacctgttaagcctagcgctagtcagaagcaaccataatactcttatatcagtgttcaaatacttttgttttatagttgttccccgtcaatcatgtaatgacagagaaacatgagattatgaaggagtttgataagtttatgaaggatccatgttaagattgcaagtgctgtgagttgtgtacattttgttgttgattagggagacctagggtctcatttccgtaaactcataatctattatgaatcaaataacctagcgattgatggcgaagaaaatcaagtgattaacccaagagacatttgtttggactaagagtttcagatgtgtcttcttcggatcaaaggcctgcacccgttgtggagaaattggacacgttgctagcatgtgtctcacactctgcactcactatgaagaagaccatccaccaggggagtgtcccactcgcaaggtgacatgttttctgtgcgaaggaacaaaccatgtgcccaaggattgccaactcagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataataccttcagcactaaccattctctgcaccgacggcctcagcaaagaattgtcgtcgatggaagaagttgtgtctctccccgacctactccaggccgagcgaagggcaatcaacctcaggagggtgataccaagcagaagaccgttattcgcctcaaccagcaatcagaaggaagcttctcctgtgaatgatagcaatatgcagtcccatcacatcatcacagaaccaatcaaggatgatgcagtcactagaacaatgccagctatacctctccagaatcagaatgagtagccatgtttgtgattttcagttcgctacttatcactgtaatcgaaagtttgcagcaatcatgtaataaataaatatattcatgtctataaacagtgagcttgctatgtttatggataattcctgttgaggatacaatgtaccgatgttaagcaccttccctttttgtttaaggcagggccttgtattcgtataataagggagaaatgtgtaatacagacaagttctaagaggattcttttggaagatgcggatatgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtatccgccatgcctctacattgataagttcggatatacctgcaaacagttaagaagatccaggagacatcaatatttgagaacatagtagtcgatggttggtgattagtctatcaggtatcagaaaaggggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacaaaccacatcaaggtttcactgaaaggcagcaagccaaaggacgtcatcgtccccagaagcgtccgcaatccacattaaagaataccacctgttagagataagccgaaagaagattgataaaagagattggcaaagatgttctctagcatgaaagaagtaggccgaaagg

SEQ ID NO: 61276 - DNA, 636 bp, Oryza sativa
atcagagaaaccaaaaaaaaggaaaaaaaagaacagcatgttactaccgatctagcaaaaatataatctgagagccaagtacaagtactactagtgttactgccaacacttgatcatatgttactgccaaaataaatgtttgttactgtctaagagccactgagtacatgtattttccatacaaagtgggaaggcaaaaagaaaactacaatactacttggtgtcaatctacggcctaaatttctcaagaatcgcaggcaataacggtttgttgttgttcaaccgatggtagaggaattcctgccgaaagtgtgttccatcctcctccataaaaaaacaacagaagatttggttcagttacttgggtttgagtacgattaagggaaatctccagattttcatcaccgtctctaaccacaacctttgttattgtcaaaatcttgccactcttcttatctgcatggaaaaggtagaaaaaaagatgtgttactacagagcaagaaggttgtcactgcaaattaagatatttgttactagaaatgtccatggaaattaaaatcagagtcatgcacaatataggctgcatattaagagaaaaggctccgctcccactgctgtcgcgcctagtggaaaggg

SEQ ID NO: 61277 - DNA, 711 bp, Oryza sativa
  unsure (1)..(711): unsure at all n locations
tcctcgtcgtcgcngttgtcctcgtcagatcagccaccgtnangcctcttcccacnnggcggcgggcngcngcacaaccaaataagtggcttcaagcaaagcatgctctgctgttcctcagaagtctcaaccaccgtattaatcagaagagtgcccaaaataccacgaacttccaagcgaactctatatggcaactctccattgaggggctcaataactgtgtactatggagcttcaatgtaaccggcaacaaatgtcatatttgcaagctccgcaacaaatccttccatgccttcaccatggtgagtacagggagaatcggccatctaaagaaaagatagaaggaacaaaactgactccgatcagaaacgagatgctggcattaaaactggaaacaaaaagaaagaaaaggcactaaactgaaatcaaaaatactgaagcaatataaatattttttaaaaaaatactatttttggcccaaatttttttttaaaaaacgaaactctccctttctttttaaaccgaaacccttccctttttttctgccaaaaccttttccttttttttgccaagaatttttttccgaaaatattatttttcttttgaaatgccgaaaacatttttttaaaaaaaaaatcaaaaggcacaaagaaaaatattttttttttgatgaaattcagaaacttgaaaacaaactcatttatttggact

SEQ ID NO: 61278 - DNA, 916 bp, Oryza sativa
tttagttcacgctaaaattaaaagtttggttgaaattggaacgatgtgacggaaaagttgaaagtttgtgtgtaggaaagttttgatgtaatgaaaaattagaaatttgaagaaaaagtttggaactaaactcggcctatcactatcacaaacaacctttaatagcagtatctcaaaatgattatttgctaatattctctccatatataacctagcatcgaatgaggcacattataatacattagtactacgaatctatccaacattagtactatggtgtgtctagatttgtaatactatcatatgtctattcagtccattatgtatcacattcaaccataatttcttatatttgggatagtagcacactattcattgtcacggattgattatatggtaaattaaatactttaagaaatacatttagttggaataaaatgaagtggataaaagttcgttaaagaatagtaagcgtggatcaaataattctgaacaataagtaaggtgaaaaagatggagcaaatattcccacgagatcatggctgatcaaggtcgtcgggtcgcaggtccagtggtggggtcaaagctgtccgtaccacggtacaataaagacaagcacggccaaagccgggtttcacattaccctttgcaggcttttcacattaaccctttccagctaatttgatttcatcacgtaggaggataacactgtccacgtcaccccctgcctgcgcttttatttgtggccacgcacgagtcgagccactagcgacgtgaacgaaagccataccacattaaaggcgttcacactacatcattacgtggtgccatcatcaccacggtggggttattacggcagctcaaattagcggatgaatcaagacacagtggtttagaactaattaagcatatcatt

SEQ ID NO: 61279 - DNA, 4655 bp, Oryza sativa
  unsure (1)..(4655): unsure at all n locations
ttaaacatagtctaataacaaaacaaattacagatttcacacgtaaactgcgagacgaatttattaagcttaattaatccatcattaggaaatatttactatagcgccacattgtcaaatcatgacgcaattaggcttaaaagatttgtctcacaatttacacgcaatatgtataattggtttttttttctacatttaatactccgtgcatgtgtcaaacatttgatgtgacagtataaaagttttcgcatgaaaactaaacagggccttaggctttaagagtatgtgatgattaaccaagctccttggaacatattcctcccagccatccccatgacaaagaatattctgtccaccaataattctataaaagtctcgtatgcatggtagctaaaaaggaaaccaaacaattaactgccccatcagttctaaaatataacaacttcttcaattaattttttatccaaaatatagcaacctagtaaatgtaatagttgatttttaacatcttttcttaatacttgtgccgaatgctaaaaattgatagattttaagatgggaggagtatctagtttgtgcagcaaacacccatcaacaatcaaacataattttacatccttaagtatcaaaaactggtaagaagaaaaaaaaaccctagtgcaatacaacctcacttatactaagtggttttcatgatttgacatccaaatatacgtgttttacttgcatttaactactcatcaattgtaaaaagaacaccttttgaatttcagaatcataaaaagcacgatatgaaacaagtttgtattctatattatattatctacttgtattagaatgtatataaacgcattagtgatttatatgcttcattttatagctatataaataatgtgaaaacttagttagaaccacatgctacataggatcctgccctcaaatatcctcgagtattcacatcattccatatgattgtcaagggacgtaaaatatctagttttatagttgataaatttttttaataaatagagaggtgtaatagggatttatcccacacgaagaaatacaaaagtggtcctgcaaagcgctcttttaaacgaagggtgttttttacttcacgccaaaattgaaagtttgattgaaattagaacaatgtgacgaaaaagttggaattttggccgtgtttagttcccccaaattcccaactttccattccatcacatcatatcgaaaactttcctacacacataaactaccaattttttcttcaaactaccaactttctcctaacttcccaactttttcaccatctaaacacaacctttgtatgtgtaggaaagttttgatgtgatgaaaatgttaaaagtttttaaaaaaaagttaggaactaaagcaggacgaaagcaaacggaaccgaatacttctatccgcacaatgcagcttttgatcctttcagaaaaaaaatgcgtgttccttttgacatgtttggtaccggccagtgacagcttcttctagacggcgtttcagcacaggaagcttttgagaaaattaaaaaaaaattagagaaggctgaacaattggagaagggcaagaggccagtggcatatttatttgtttggagggaaaaaaaaggaaaggaaaagttcatgaacaaatgaaatgtcttcagaaacaaaaacaatgaacaactgaaatgatcaactgggctgtttgcctgttggtaggttatggcgtttggtgtgagacgctgatggctaacaacgtcaaaccccaaatggaccgatgaaacagtagtgaacaaggttccccactcgcgtcttctgttgaaaacgatgttcttctctgttgtagctgcacttttttttttaccctatgtgagtgactggaaatattgcatgagaagattccaaatattggttttgtgtggaattacaggggtgtatctgcaggctgcgatattttactggaaaaaaaatatctaaagccattttttttgatatttcgaaccatttaattgactgaaacaaaatgtacatttagtcatatgctctctactaaacgtgcattaggatgctagggatgttctttttttaaacggtgggagtaaaatgtatatataggttgactttaactgattgaccttaaacatagagttgccataggctgtgttcggcattccctcttcccaacccctatccctcgttttccacgcacacgcttttaaaacggctaaacggtgcatttttttaaaaaagtttctatacgagagttgcttaaaaaatcaaattaattaattttttaaaaaatagctaatacttaattaatcacgcgctaatggaacgctccgtttttcgtacagacggttctagctgggaaccaggaatagcgaacacatccatagtctctaaatctccacgtagccctttctgaataaaataaagaccacaaaacgatcatcaaattttacgcttgttatctacttgtattagaatggatatagatgcattagtgatttatatgcttcattttatagctatataaataatgtgaaaacttagttagaaccacatactacataggatcctgcccccaaatatcctcgagtacattggaaacctaccaccaccactggcaattaacaattcctctattcaccactaaccaattgctaaccgagtgccaaaatccaccccaagaccttcttcagtgcaacagataatcatagaagagagagaagaaagataaggattagcagtaacactagaataaatttaagcatcagggcctaaaaaatgcaccatgaaaagagagaaaaggtgggaaagaaagcaagcacaaaaagaaaataaatatagattgagtaacaaacaagccaaagctaaagtctttcttctctctcctatgcctacccccttgctaatcccctctctctctccttatttgtgtgccttccaagtgcaaccctaacaagtctcctacttaaaaaaagaaaaaaatatatcgttttgctaatttacttttgtcattcttatttttgggattgctaaattctcctcctctaggagtacactagtacagtacttggatatcccaaaaacttttttttatatttatttgtagttggatatcccaaaaactatttttttaatatatatttatttaaggcaggggaggggaggagaaaaggaaaagagggagaagtaattaagcaacagtgaggccggagctatctatctatccatctatctatcatctactatccttcctctctttcctcctcctcgcgcagccgcgctcagatccaaagccgcgcgcgggggagggagggaggaatcgcggtgccaagaaacgaagccctagccccccctagatgcgcgccgccgcttgctgctgctgctgctgctagggttcttgtacggagatgcggggcgtcgagtcggatggcggcggcggcgcgcctttctcctcctcctcctccgcggccgctccaggtgaggcttttttttttttcttgaggcttcttgatctggtagctgctgctgctgcgagtagtttggggtgctgtgttggcgttgaatttggtttgcgggaaaagtcggcgccttgatctgttttgctgtctcttcccgatgcgaatcgttgggttatcgacggagaattgctcgaattccaactaggaaaggatgtctgttggttttctttttttgttggcttgattggtgtttcgtgatgttcttgctgttgttctttgttctcggttgtaattttgggggtaaaagatgtgggtttttactgcgtacgattagtatgatctgcgccatctgacgcttttttctcgatgcagataatttcgatgccgcgcagtactccttcttcgggaaggagccactggaggggctcgagctcagttgcttgaagaatggcggcgccgccggtggtgatgccaatggcggtggattcagtggaggagcagaagaagggctgtaccggctctcctctgttggagaagaggtgcgaggattcaggagccttcatgcccatagattgccgtctttgttgtgaactatcgtcgtgctattcgtttgtgttcttgggttcacatgcatgctttagctctttttctcgataacacagtcctttcggcatggcggcaagcgatagtggaggcttagtgctaggaggaatcaagaataaatgtccatgtgggcctctagggtcttactagtggagctgaggttcacatcagtagtgtccgggaagtggctatgttggaatgtttttgtgcttcaagtgagcccccccccccccccnnnnnnnctcnnnnnnntnncttnnntnttnnnncncatnctcccttctctcctctttttcctctctcctttcttctcttatatttcttttttttttccccnntttgctacagtagagttgagaatcactagaacagnggctggcgttttttgataattgatagggactatgaatgtttcatcaggatatgacagtgaaatcgataatgttcaaggtagccttttggctgcttcgtcaaaagcctattctttgctcgtttaagtccaattataattccttttgataagtcatcaagctatagctggatagcttcttgctatggaatcttggtttggctagttttc

SEQ ID NO: 61280 - DNA, 4063 bp, Oryza sativa
cttcgtcaaagtaaagaaatgcgggaaaaagcttttgaacggcagcagcatctttatctgtatcttgtactttatgtttccttgtccttctaatggtggggcccggcctccccagtgagttgcgggacccaccgctccagtggaagacaagattctttaggcctgttttacttcccaaaattcttttcctaaaaacgtcacatcgaatctttgacacatgcatagatcattaaatatatataaaaacaaaaactaattacacagtttgtatgaaaatcgtgagataaatgttttgagcataattaatccatgattagccataagtgatacagtaacccacatgtgctaatgacggcttaattgagctcaaaagattcgtctcgcggtttccaggcgagttatgaaattagcttttttattcgtgcccgaaaaccccttccgacatgcaatcaaatatctgatgtgacacctaaattttttttttcgcgaaataaacacacccttagtccatgagcacaggtgcagtagtagcttcgaaaaaaaatactaaaaaaaaactccgaaaagggagaactgaagacctaaatacgggaggaggtgaaattcagggggttcatgttcaggttcaggtggccaacacatggccttgacagtccagttcagcaaaaatgcatggaggattatgggggtatatacgagctctcatgctaagacattattgttagcaataatgcagccaaataattgggtcaaattctatctaaacttgccttctgcctttgggccctgggcatatgcgttttggattggggccaatagctcgtctcatcgcctgacattattttatgatgatgatcagtgccgaagctccgatttgccattgggaggggcgggggggtgtggctataatgctgtcatgccggccagactccataacaatcactgcagatatataagtatacaatctataatcgctgcagatatataagtaaacaatctatggctctgtagcttgataaatcaaccaacatatgttttgcgatacaaaagaagcccaaatgttcattataccattaggtagcaactagttccaagtctccaacatcaaataaacaatgtaacatggctgcatacgatttaccataaaaaaattacatctcaactaacttgaatttgcatctacgagaattagctagatcaaatgccttaataatatcattggaactaatcattgctgataaatccttttcaatatagactaccaaataatcacgcaaataggcatctcccattttacttcgaagacgagtcttgacaattttcatagctgaaaaggctctctcggtggttgcagttgacacaggaagagtcaagactaatctcaacaacctatccaccattggataagaagaatctttgccaagcttaacaagtccacttgttaaatcagccaaagatgataaaatttctagttccggatggttgcacacatcaagttgaaagtgtggcaattggcactctaattgcattcgttcttgatttgagaaatctgtgggatagtacttctccactagaatgcataccttttccatgtcaaatgagtcaagccttggatccaaggacacacaaagtgctaaaaggtctgtagcttgagaaccaaatcgatcttctaattcaatcagttgttgatcaattgcaacattaaacacatcaactttataatggtgtaaagttgaggtgttatcattcttgtttcgagattttgtcacatcaacaaacctaaaaatacaagggtaaataagattaatccatacaaaagaaatcaccattcagatttaacaatttaggcaaaagaacttacttcctattcagatctggaatatcaatctcatgcttctcacagaaggatttgacctcctgtagaagaggctcccaaccatcatttcttaagtcaccaagtaacattttggtgttagaaacagaatcaactgcatttaaaatatcaattgacttcttttggagagtttggcacagcacatcagtgattttcataatcttttccatcatgagcataataaacacaaaatcaaatgtgataatcattcgcagggcacatgaagcatctccacgtgaatactttgaaactgaatgatcatgtgcaatgttgcgtagaactgaaactattgcaccaaacattttctttaagctctgaattgacttgtaatgggaactccatctggtatcccctggcctttgtagagagctcatctgatttgcccctcttcctgtgtcaagctctcccaactcaatttcacgagatatttcttcagcttgtgtagctagtaactcattgttgcgcttaggagatacactcacaacatttatgatgaaatttgcatgctgaaagaagttatgtacctcatgtacttctcttgatgccgcgacaagagccaattggagctggtgagccatgcaatgaatgtaatatgcataagggcactcatttagaactagtgccttcaatccattccactcccctctcatgttgcttgtcccgtcataaccttgacctctaatgtcttgtatattcaagctattatcagataagacagcacaaattgagtttttaagagtcaatgcagcagtgtccttaacatgaacaaggtcaagaaaacgctccttgataagtccttctttggtaacaaagcgaaggactattgccatttgctcttttttagattcatctcgagcttcatcaaccatgatgcaaaacttgctattgccaatttcttctctaactgatttttgcacttttctagcaattatgcttagaatttccttttggacatcagatgaaatgtactttgcatttcttggagcattttccaacacaacttctttcacctccttgttaaatgaagccaaaagcttgaccatttcaagaaaattacctcgatttaacgaatttatagattcatcatggcctctaaatggacacccttgaagtgttaaccacctattatgatagacaatactaagtgctgttagatattaaattattgacatagtatagtcttacatataaataatatgcaaaagaaaaaagaacaaaacttattacctaatggactcaatggtagttgtaagccttagtcttgctcctgcaaacaatttttctttttgtgcaattactgccctgtcaatgtgagccatactatttttgagattattgaaacaaccaacagaatagttatgagcagatccagagttacccatatgttttagaaaagcacactcttttccttcattaactttcttccaattttggaaccccctcactgtgaatgtatctgatccaaacctcccaattggtttctttgaaaagagaaaacatggcttgacaataagcacgggccgtgtaaggtgaatactctagccaactaaattgtttaaaccaattgctttggaatcgacgagcatgagatgcatcattcaatgggtactcatccaatataaattgatatgggccttcagatatataaaatctttgagctttatcttgttgatcagcagggagtgcagagatttgaacacgtttacctgggtccctctcaaatgccgtaggtaccaatacttcttgttcagcttgcaaattttgctgatcaggaacttccacattggttgggctaggattttcaatttcaactgagacagccctagcaacaactggcttgtagaagcaatcaatcggttatcgttttcctcttcatcttggctgaaattaagatgggaaataacaaaactgagtactcataaactgattgaagtctaatggctaccagatacaacctacaaaacttttgttgtattggggatttggaagagaaaagggaaacttggagaaagaacctaccctaaacgggttgaacaccacctgttttttggaacttccgcagatagtgggcttgtgccctggcagagtccaattccggcttccaacgtgtttaacggggagaaaggcgaacgttgttgaaaggcgaaatcacacaaaagcttgcccccg

SEQ ID NO: 61281 - DNA, 1095 bp, Oryza sativa
atgtgtttatagctagcttatagcctactatttaagctgctcttagcaccaggtgaaaatacagatcaaaacaaaaataaacttcactaacaatggaccagccaaatgaagaaagacgagaagaacagaggaccacagccaacagtgggaggaaatggacaaacaacacgctaagcgagcaccaattcgtaccagttcaggagctaattcaacgttaatgttccatccaatccacagaatccgcacgcggaatgacgcaatccaactaactatccaatctactacaagccaaaaacgcggacaaatcgaatacccagatcttcagaaactcgtatgcatcgctcatccatcgtcagcgtttcttgccgcttctaacgcgtcggtggcgggcaaatcaatccatccacagtacgaaaagtactactaccaacatccacaaacagccaaacgtacctgattttgagccaacaaaacatgactgatattgtcttttgaccagcagaatagtcagggggtgagaacccaagaatcagggacgagcaacggcctactgtgaaaacgaccgcacaaaagtcttgaagaaaataaaaggtggccaaaattaacaccccaagaacgaaatcacgcgcctgaaaagttggcaagaacagatagatagatagatcgatcgatcgttcgtctaaaatgcaccggaatcatcggatcgaacatggaccaaatctctttctaccctaatctccctctacatatttcaaaggatgttcccaagcgcatagatgaaacttctctctcttttttgaaaaccttaaattgcggatcaagaacaatagatcaagaagaggaaaaattaaaccgagagatcgaggagggaggcagggaggggattggagacacgaatgggaccttggtgtcgagcatgacggcgcagaggatgccggtgctctccatggcggcgcggaggttgtcgagcgtctcctggtggtactcgtgggatccgtgggagaagttgaagcgcgcgacgcacatcccggcgcggagcagccgcccgatcatctccaccgacctcgacgccggccccagcgtgcacacgatctt

SEQ ID NO: 61282 - DNA, 1128 bp, Oryza sativa
  unsure (1)..(1128): unsure at all n locations
aactgaagaggaacttcacctgaacggctgaacacccctgtcttctggactccggcggatggtgggctggtgcctggcggcgtccagtccggcctccaacgtgctcaacggcgagataggcgatcgctgatgaagggcgaaatcacacaaaagcttgccgccggcgccccttttccgttttttggcttcgtcgctgatggttgctgctcctgctcgcctatggcattgcgcaatgcgaaggtgaagcaacggctagcggggtgatcgagacgaggaattaacgaagaaggcgaggcgtttttttcctaatggtgggctgagatgagaacttgccttgggctattgggcttaccactaccagggagatagaagagggttttggggggggggtcggcccaaatctgataggggggtgttggcccaccccggccccccctgtagcttcgccactgatgatgatgcaaaaggagaatcgaccatgttgattaattgtcgaagctgagcgttattcggatggatagggaagggtccatcagtctccatgcattggctcaacaagatatgagggcaaattggtccttcatcctctccgcgcgattaatattagtagcgcctttggcgagggcaaaatcggctattgtcctgcggtcacaaatagttccgcttgtttgctataatacattatgtcgattaaaattatatgttcggataatcaggcaaaagcagggtttagaatcttgttaaggatatcgaacaccaaggaatttcaatcagattaactatttcaaatttgggtttctcaaaaaacattcaaagttctcctagagaactgactttagcttggttcaagaagcttaaagttttaaaaaatcaaatggttttcgttgagattgttaaccctgggtgaaggaaggaaaggaagatgggttgatcatattatttcccttcatagaagtcagtcccataagtcatactcgcatacgtatttctttttgttaccaaatagttcttgtgacatatttagaaaacggatatatcaaatagagtgtccaagcgcatgtaaataaccgtcgtttttgtaaagttctantttnnaatnggggactcagtgtctcagntttcaccact

SEQ ID NO: 61283 - DNA, 1638 bp, Oryza sativa
gaggcgggcagtccagtaaggcgcggggcgccacattcggcccggactacaccggaaccgaccgagctggtagaacggcagccacctccctccaccggccaccgagcggcacagtgcgtgccgtccgccctgagccgacaagcgcgcgagagaggggaagagaaaaacatgagatagatacagtatatatatgccaggtgggccccaaaataaaatgctgactgaattgccacgtgtacgccacatagaccaaaaccaccccggattgggttgaggggggtaatttgtctggtttgcatagttggggttgaagaatatctggatttgtagtttagggagtaattcagacaaccgcgatagttcaggggggtaattcgtactttttccttatttgtataactgtgtatccaaatttatagccaaacgttattatatttaggacgaatgtagtagtttttagcataaaacttttatactactacttttagcctccaaaagccaaaactgaaaatagaaagcgacgaaaaagcctccatgtcaatctaaaattaggttctgaaatgcaaaggccgcaattcaaataagccaacatagattacctgcatatgccagattgttaggaattgcgcaccgacattaaaattgttattcttatgttaggggggccacaattgtctgcttgaaattgtaagaataccaaagataaaaatttgagattatgtttaagctcaaattacacaagcaggtaagccagtctgtaaaatcaaagatataacaactagtatatccgaaaggactggtacttgatcaactttccctatcaagcccactttttagtcccaatgcacataaaacacatatacccaagagaagagagtgaatgacacaaaaaattcctcccaacagggatctttctttccttactaacctgatctggcattatcaaatctcattacttgcaagcaactcacccagcaaacagtgacaactgacaactcgttgatccattccagttctgaaaccggagagaattgtaccaacagggatctttcttttctcactttcaggcttcaaccaccagccgctaattgcaatggattctttgttctgccatccccccacaaagccctactttatggaaaagaaatgagggaacaagtgcctatcttgcataggatatgtatttaattgcaggattaatattaatcaattagtaggtgagaacatgaggtgatagatgtaagtagatagatggtgtgtgtctgtgtagagatagggtggcttaattagaaaaggccaggtaggggatggttgttggtttgtcactttgttcagtgccacagctaagaccccacattattttgcactctctctgattggatggattaagtggttgggatcataaatggattgtgccactaatagtatcaaggggattaattctagcaagttgattagtatatgccatcagaaggtgattgtgtgctttctgtattcttgttcaagtatgttatggttttctgtttcttgtccaagccaagatctggtgattgtgtgctccctttttttcctcttcttgatcagatgacacatcatttgtgtatgttaaagaggaaaaatcatttatgtgtgatctgg

SEQ ID NO: 61284 - DNA, 3037 bp, Oryza sativa
ctcagctgatagtacatatccgatcacaatcacatgcggcgagatcactctacgtaccattcgaatattgacctatcacgtgccgaccgactgataaactaatgaaccgaattgtatgcttagtacaccattagtcgatcaccccacaaaattagtctatcatccatctaataaatacctataaaaatgaaaaatccttggctcaaatttattatccatacacaacaataaactagcataccttcaattgaatgcctataaattaatttatgcatatattcatgcattcgtttttcaacttaaaatttttaataacacctctatatctgaaaaattctaagagctagaagcacattacatacaagaaccaatacaagcctaaaatcccacattgggaggcctaaatttggggaaaaaaaagaagtttttagggttactctctaatctataaatttgaccaattaaatcgaaaaaaaagaggaatggtgtagtatatactgctcttcaacttccatgagaaattccgagaaaaataggtccaaatcgactggatttgaggaggagaggtataggtgctacttccttacttgctagatcacctcacttcaccatgcttgttctgacaataggtataggtgcaactgtacaagctagtgcaataagcatggtccgcatgcctgaatgtttctgcattatatccatccaaggaagcaaatttgtataggttataatatatatgcacgagatatgcatacacagattatattatcatctatcagagagctagcacttagatatttttataatataatttaattagtctattctttacatcactcagctgatagtacttatctgatcacaatcacatgcagcgagatcactctacgtaccattcgatcattgacctatcacgtgccgaccgactctgataaactgacgaacctaattgtatggtttgtacaccattagtgtatcatcccacaaaattagtctatcatccatataataaatacctatgaaaatgaaaaatccatggctcaaatctattatcaatacacaccaataaactaacacataccttcaattgaatgcctataaattaatttatgcatatattcatgcattcatttttcaacttaaaattttgaataacacctatatatctgaaaaattctaagagcttgaagcaagttacatacaagaaccaatacaagcctaaaatcccacattgggaggcctaaaatttggggggaaaacaaagtttttagggttactctctgatctctaaatacaagagaggaagggcgccaatcaggttgatgccaaaaagggtctattccagcaattattttatggaggggtctacttaattatcctctacctcaactctggtcatcactgaccagctcatgagctatactgtattctggcttctcaagtccttgccagtaattttcgcatgtggtcctctttagaccttgccagtaatttaacatttttttgctggcgaggacttaagacgttcgccagtaaatataggagcggcttaaaaaaattggatcacaaccaacgagcgcaccttgcccctcccacaccctaactgctcgacctctcagcccctcacccgtctcagctctctacctcaccttttccacttccctttccaccacagcccctccactctcttcctaatctggccaaaggggcggaagctagcggtggctgcactccctttccctccctgtccttgatctagttggagggaaggagggcgtcagtggcatcgactagatgcagctaattaggtgtaaccccaactatgtgattagatgaacaaactaaacatatagtcaaagagcaaacaaatcaaccagccgagtggttttattaaaaaaaaattaaagcatatgtggtgtcaaatctgacttaacaatactcatagtcactcatacaaaatatcaaataggtgttgccactataggtaacggaagtgattaaaccggcacctatagtgctgttcccaccttcataaaatgaaaaaaaaaataaaactaacacctttaaacgaagataggtgtcagttttacagaaaaaccggcacctagattttaggtgtcggttcacctataattaattataagtgccggtttttaaaaaaactgaaaccgataaaatcgagccgaaccagccaggggagatatttttcctccagatggggcccacacccacactggcaggagataaggccgagcccttctcccgccttctcctctctctctctctgcagcagcggtgggagaggtagcgacgcttcttctctctctgtgtctctctctctctgcggcagcggcgggagaggtagcgacgccctcccgtcaactagatcggggggaggggaggtgcagcggcggcggacgacatggaggcggcggcccggaccccccctccccccgccagatcgagcgagagaagaggtgtagcggtggtggcgggttggacctcgcctccgccagatccggtggcgtggaggcagcaagtttacactaacttcactcagacaatcacacaatagcatcatatatgaatagaaaccatctagaagtcatatccataaagcactgtagaaatcccacgaaaataatccgaaactaactcctacctggagtctgctaatctgaccgttgggcaacccggttagaccagtccaacaccactggtctgaccggcagtccccgcctagtctgaccagccaccaagagccgactaccgaaaacactattcaccgtattttcacaaagcactcacttttgacaattgttcatcaccacgattaaatcatcacatgattctacacatatctagagagaggaggcaagagaaggcaataatatatgttggtaaggacatagctacagtgacagaaagtgatgctgaactccatcggtatcgttagatttgtgctgatgtatatgtttcttttttcacaacagcttagtgccgttttcttttgatatgtcctccacgtgtgttgttg

SEQ ID NO: 61285 - DNA, 3441 bp, Oryza sativa
  unsure (1)..(3441): unsure at all n locations
gatgggccttgattgtcannttganaaccaccttgtacccccaattaagaagcctgaaaaacgtgtcattgaattattaaggaaaaagtcaatatataaccttaaactttacacagaattttatttagcacctaacttcaaaaccggatcgaacattcaacctgatgtaaaaccattcatattatctctaaagtagttttggatagttgttttacatatttcgaagcttcaacaagggttttgaatactccccccgtccttaaaaggaatgtagtaacgtttttgccttaaaaatttgtctatagaagggtgtagttttagagtgattcactacgcttctttaatagtgcttgaccatttcttatcatttgtaaccattgaaccaatagtactcgttcctccttgttttctcccattcttggtttctctccgtattaactccttgttttctcccattcttgttttctctccgtattaataaagggcatagaagtctttttaatctcttggttactatgtatttgattagttaaaactatattatattttttttgggctgagggagtaactaatataacataaaattgtcaacttccgtcctcaatttatacaatatagtaatgccaagtatgtgtttgcactcatttgtgggtgagagaaaaagaggtaaagatgaaatatttaagtagagattttaacatgtaccccaatgtgtatatcacatagtcaagtccattcaatatgtatgcaaatttgataaaaacaaaaatcatcttactataagtgtaaagtttggaggttgaatcttgggttttaaagtttagggcccctttaaaacataggaattttggagcatttcaatcctatagaaaaaattcctatgaatgcatttgaatcaaaggattgaattatatccattcatttgaaattcctatagaatggacaatcctatagagattttggaggaaacttagggccctttgaatcgcaggattgagaaaacgtgggaataggacaaacacggtattttgatataaatgtaagtgtaaaattgttgatatttctgaacgatgttaccaggaatataatcccccgcaatggtgccagaaatattagacgatattcttatggtttacaaatataaattcgcaagtgcacggatataccgttgtaatataaattcgcaagtgcacggatataccgttgtattattttacccgaaagtatttccagggtatcgtatttacttaatcccaaggaaagttatggtcagagagtactatgctataaattcatatcacacttatgcaaatcaaagtctaatgcagggtttaatcaagtcaaggtaaggataggttgacacatagaaggaacagtttagaatactcttactaattaataagtctaggcttagtgaagaagaaataagaaaagcatcgtttctatacttctagtatatcgtcattttagtatacgcttgctaatatacaactatgtggctaatacctcctaactatacccttctggtatatcgaaaaaccacccctaattgttgagttctttatgacaatccgtcatggctatccaaccagttatagatacggaggagtaactgcaccgggaacctttattagacctatatacgtacgtggaggaatacccgtattgagctgtcaccatcagcgtcctacctctacagatctgtggtgactagcaccacttaatgatatctaataatctaggcattgtgcttacattactaaatattactctatgtgtcgacgtttgatgtcgcgatttcggtatttgcatagtatggggatcgttggtactaggatatatgcgagattgtagtaaaagagatggagatgaggatttttatataggttcgggcccctgaattatcaggtaataaccctacatcctgttggccgaagccggccgttacttttattcatcataatcacaccagtacaatatttggggtagcctatctaactgttgtcgacatggcggtctgaaagtctgactcgtagtcgacaatagggtagccttttgttagtgatatgccctagaggcaatcatagagatgattgtatcacacactatgtttacatatttatccgactttgttccttgaaatagataaactcattattggttaatgaatatgtgattctttcatgagactctttatgttgtgtgttgctatttctaaaggatccctgatcaaatatcatatgtggaacaaatatgtttagatgatcagcacatgtattaattgatgatcatgtctcatggatcatggtatagagataccaaattaataatgtggacacatgttagtgaacatgttgttggatagacccaatatgagacactgcaagagccgtatgtgttgtatcatcagtgatctcatttagtgttggtgttgaatccttagacctgagattatcatggttcccaacatgtgtagtagcttacttagggactgctaaacgctactccgtaattgggtagttataaaagtagttttcaggtatgctatgaaacatgtagtgggatatgaatagtcaagatgggatttgcccctcctatggagagatatctctgggcccctcgatgttgtagattatagaagtgcatggccatgccaaaggtgattgaggagtcaatcacaagttatataatctatcaacaggttcgagtgaatgattgagctattagaggatgacacatatctagccttgagcttaatcgatatcgtgaggcaaaggggttcatacaagtatacactagaggttcagccgatatgatctttatgtatgcccggtgggtcaatacgttctgctaggggccgctgttgacgcgtggaacgaaaaggagtttttgggttacagccgagtatatatgaacctatagggtcgcacgcttaatgggtcggaataaggggattggatggagatccaatataagcttaattcggatagggatccgaataggagtcctacgggccttggaggtccgagtgatggatcctatatattcgtgaggggtgtgaccggcggaggcattgcatcacgtgagaaaccctagccgtcacttccctcctcgagcaaaaccctagctgcgcgcgggtgctagcacatctgcgcgtggcgttccgtccctgtacgtgtgggtaccggtagaggcgctgctggtttgcggtgctgatcggtgtgggagtacggcgaggagaacgcacgaggaggagaaggtcgagccggtgcgatcgactacttcctctacatcgacgcgcgctacttcacgagagttccttcgacttctcagcgtcttcttccgctgcgcagcgcgtcgagtggtaacgatctatgatctaatacttgcatggttcctggtttacgcgatagaaaattttgatttatgctatcgtagcct

SEQ ID NO: 61286 - DNA, 4713 bp, Oryza sativa
tactatcactttatcggatgaaaaaatgaccaaaataaaagttatagatcttgatgagttatacaactttgttgttgatgactttttgagttgaaataatttagtatatgaaaaatgttgtttgaagttgtcatatttttaaattcaaacttaaactgttaaaaaaaacgttagatagaaaaatgaccaaaataaaagttatagatcttgatgagttgtacaactttattgttaatgacatttttagttaaaatcatttagtatatgaaaatgctgtttgaagttgtcatattttcaaattcaaattcaaactattaaaaaaacgttatatagaaaaatgaccaaaataaaagttatagatcttgatgagttatacagctttattgttgacaattcttccatttaaaatcatttactacccgaaatttttttttgaatttcttgtattttaaaatacaaattttatacagttcaatcaaacccggatagagaaatgaccaaaataaaaatggtagatctcaatgagttctacaactttgcctacaactttgcttttgatagttttttcatatgggttcatttagtatcataaaattcaatttgaaattcattttttcctataagtctgatttgcatcttactcatgataatacttgcaaaatatatatttaatccaattaactcagatttgctggtgaaatatgtgatcaaaatggatgttatgtgaatgtggttgtgttatgtgaatgaatgtatatgaataggggatgctaggatgtgacatcctggcccaggccttaatatgattaatagaatactcatacaaatttttttcttggaagcagcttccaaagaaatatgaggttaagtgtgctcggcttagagtaatttcaggatgggtgaccgaccgggaatttgaggttacgcgtgctcggtttagagtagtttcgggatgggtgaccgaccgggaaattcgtcccaggtgtgcatgagtccggataggtgaccgaccgggaaggcacacgagtgagggcaaaggcctgaggccaaaaaaacaaaatttatttttttgcaaaggcctgaggctaacaaaaaatcaaaatttatttttttttggattatactcatctgtgacgggttataatctaggcccgttggagatatgagtcatccgtgacgggctataatctaggcccgttagagatgagagtcatctatgacgggctataatctaggtctgttagagatgagagtcatccatgacgtgctataatctaggcctgttagagatgagagtcatccgtgacgagcttttgtgttggcccgattgagatgcgtcatccgtgacagccggatgcccgattgagatattttctcacatcactaaccatgtccgaaagagatgatattttaagcccgttagagataaccaatctcgttccgttgaagaacaaattaattagcttctttttcccatcttcaaggaaaggagctagctagccaagaacttttgtgaagtttctgtttcgaaaaaaatgtgaataatgtaagtaataacacagacaacaaaaggatgtgataacgtaaacctgcacaaacggccaacctctgttttaccaccatgcacaaaacatggccaacgtaaacctgcaaaaatccgaaatcactaaaccaaacccatcaattctcatatccatcttaatccatcaatctttcgagaaaaaaaactaaagcaattacaatttactgagtgatagtttgggtcatcatctatatttttcttaaataagcttccaaataagcatgccttggcctcctatccaactgacgcaagtacaaaaaagaaagacacaaattaaattcctaaaattatgttattttcaatttacttatcggattattgttgtaaattttctctccactttgtaaaaatacgtttttatataaaaaaaactttcttttatgcatgcattgcttataccacttatttgaaatttatttttaagaacgaatttatcctacccttaaatgaagtaaaccctctatccaaaagtttaaggtatatttcattttttttctaaaaatctaagcatatttctgtctctatgtgttaaattaaattgttcattgtaccgatgagccatcttgatactaattggttatatgcatgtatataatttttttcatttttatcacatgatgaatgagttaatttcttcttatatttggtgataaaagaaatatgtttttgacttttagatacagggagtagataattaatttatgataataatatctggtctgtcaaacgcgtttgtgcgagtagtactagtactacacatcttacattggtcgccatctctggattaattttagtccaagactttatcaaatcgaaagccatacatgatactaagagcaagtataatagcaaactataagccagctataaatacatatcgagaagatacatgaggagagataagagcagcggactataaattttgtagccagttgcagcacggattacaagatgtaatatgtttataacaggtgagattaggttttacttgtgtagatatgtttatatgtaactattgcataaattggctattaagttgactgtagttgattttgagccaacagtgcgctatactattaaacttgctctgaggccaactttgtcaaagcacctttccaacgccgcacagatctaactcacactgttcacccataaataattccatggaaaccctcactagctctccaactacggactctacactctaaaggagaaaattgacattgtgccatcatcaaaagtgggtttcgtccaaataccactctgcaaaatggattcgataaaatgccactgtcaacacttggttacacgctaaaatactatctcggaccaaattaccctcctctcatcttcttcctccctccatcaccatcagctctcaccggcggccaccatcccgccttcgcgtgagctctcctccatggctccatggagaaccacaggccacaggcccctgcgaggacccctcccatggctcccctccccgtgccccctcccatcgccccatcccagccccgcctccgcgagaccccgcaccccggctgccgccgccatcgcctccacctccgatgaccaccacgccacgccttcgccatggtcatgctcaccaacgactccaccgtgcgggcgcgcctccgccgcctggaagaacaggagcggctgggacggtgggttggcacgaaagatggagatcgccgacatcggcggcagcggcgcggatggtgtggagcgtgaccacggggtcgtcggttgggggtggtcgaggcggggaggaaggggagcggaggtggaggaggatgagtcaggcgtggtggaggaggggaggaaggggagtggaggtggaggaggatgaggcggaaggggagcggaggtggaggcgggcgcggtggagacggcgaggaaggcgagtggaggtggaggcgggcgtggtggagacggcgaggaaggcgagcggaggtggaggcgggcgcggtggaggcggggaggaaggggagcggaggtggaggcgggcgcggtggagacggcgaggaaggcgagcggaggtggaggcgggcgcggtggaggcggggaggaaggggagcgggggtggaggcggatgaggcgggcgcggcagaggcgagccggcaaggcatcccttgttagaggtggaagaaagtagtaacaggggcatttttctccgttcgggcattatagcgtgtagtctttaattgaaagtggcattttaacgaggcccactcccagcgtggcatttgggcgaaacccacttttgaggatggcataatgtcaattttctcactctaaagagtccctttcagtacagttaggcagtagccatgagagctatacgtacgtgcaagtgcaactgcacaagaagaaatcatggaattattaactaatgcccttgttgtgattaagaccatctaatccatctgatcagcgagtgacacgcatgagatgagcgagctgcgcgcagcagctagtagtagaagatgctagcgtagtccgtgtaataacctacccgacttaaattagcagcagttactaccacctgcttcgcaacccccaccgccattaatgcggtgatctactgcttgctgctgctgctactagcgtcttctttccttgagcttcagcttaattaagcttcatctccatcggtcgccacctgacctccccaactgtgaattgaaacggagggaaatggtggagcagcagcataaaatccaacgtgattctctcggctggctgtgcctgtgtgtgcagctaagctaagcttgcttgctctctcttcttcttcgtgttgttgtttctctctctgtctcgctgtctgttgccaccattaatggctggctccgtgggtagctgagctctttgctggccgagctgagctagcctacctagctggggggagagagagagagagagagagagagcataaggatcttggaggaggtggagatggagtacggcggcgggcgggaaggaggaggagggatgaacggcaacgggacggcgtacgcgggggcgctgtcgccggcggcgaggtacgcggagtcgggcggggcgagcctgacgtgggagaatctgacggcggtgctccccggcggcggcgggcgggcgacgaagaagct

SEQ ID NO: 61287 - DNA, 584 bp, Oryza sativa
aaaaaataaacaaaggaggatagcggcggatctcatcagagcggacctgaagccccaatttttttttgggaagaaactagtgtcgttagtggtagaacataagagtggagaaggttattagggcaaaataagttgcagatctggaagagaagatagggttaggggggcgcaaaagagaggagatgtagggacggggtggggcggggtggggtgagtgctcaccggtgggcgaggatgcggaggcacaaggacggcgacggcgagcggaggatggacggagatagatcggcgaaggaagtttcaggcgagggggatggacggggtagctagggcctaggggatggatggtcttggcgcgggcatacctgctgctggctgctgcttcttcgtcttcctcttcctcttccaccgccgccggcacaccaccactgcgaccgcgatgcggatgcgaaccggaaacaaaaacaaaaaaatagaaaataatttctccgtcgctgtttgtttgttgggttgggacttgggaggagaggagagacccccgccccggcatttattaggggtgggccccctgtctgtatgacgcg

SEQ ID NO: 61288 - DNA, 678 bp, Oryza sativa
ggagacaagcctgccaagggtatttggaggaattgcaccaatcaggcaagcagctggtaccctaagggcatatatgcgtgatcggtccggcgagcaagttacaccatgccatgagcacaaagaaatgtttacatcccaattgagtttgttcccacggtagactgcagaagcaaaagcaaggagcgcttgcttctcagaagcgatgtctgccacggccaatgaggtgaaaagaagtaacgacagtagacccaaagaaccttcaaaaattttatagcccataagaggtgtctctgaatcaactggactaaatgaacaatatcagcatctgtttatatcagtaactaccagtcctgctgcaatgaaaatggaaaacgtcagtgctaaaatcatgaaaagtaacagtagaactgtaaacataactctaattgtgtcttttaactcataaaccctcaagagaatatagcatacgagcaatcacgacagatgtgtgtgtgctgagtccaaaagaaagcacattccatgatcttcaaatgcagctatgcacttatgcagacaagcatgcctgtgtagtggaagcataaagctggcagtttgccccactagaggctcatgccaagaaaaagaccaaagcactttcaaaagaaaaaatgacccatcaaagcctaatgatttaagaaa

SEQ ID NO: 61289 - DNA, 10764 bp, Oryza sativa
agcagtgtgccgcaacaactagccatcctcgagccatacattgagggacacatgaacgagataagagcatgcaaccctagaagaccggcgacttggatctcaaaggaacagaagcgcaaatttcctgaatgcctgaaggaaaaaacatgtcgttcggtgaatcgcttgcacaggttggcaactggcccaagtagcctcatgaactcatggcaatggtacgacatcggcggatatacattttacacgataggcaagaacaagaaaagtgcagctcataatagtggagttcgtgtggaggcgttggacgcaataggcgagaagaagtcatactatggataatacaagacatttgggagcttgactatggcattaacatccaggtcccggtgctatgatgccagtgagtcaaagacacaacaggcgtatccatcgattactacggccttacggttgtggaatgtagtaaactaagccacaaggatgatccatgcgttctcgctgaatatgttggacaggttttctatgtgaaggacccatccaacgagcggatggacattactgtagtgggaaagcaacacattattggcatcgataacactaaagacgtgtcagattacaaccaatatgacgacgtcccattattcacagatattcctaaccagatcaagcgaattgagacaacccttgacgaagagaagttttcgtctgtgcggaaggatggtgctgcgaaaattgtgaaacattagtgtgtatatatatctatatatatatatatatatatatatatatatatatatatatatatatatatatatatatatgttgttgtgtacaacctgttttgaaaacgattaatgtatccaacttatagcctcttcaaacgattaatgtataaaacttatggttccatgtttatctgtactatatgtcgttctcaagttatatggttgaataattaagatgtggtttgatcaatatacaagcgatttaattagatgcgattgaaattcatttgtggttaaataattatatttctatggttgaataatttgttggcattaatcatatggatgaataattatattgattaattaattaagttgtggtttattaactataaccctttttagttatagttaaagaattatagttaaataatttatgggtttaattaactataactatatttaatttgtggttgaataattatattgattaattaactatatttagataggatttattaatttatctgcatttatttttgcgtccgggtggcttaagccgcccgcatgaaataatatcatcccgtgcgggcaacttaaaccgcccgcatgggaatatcgattacccgcaggtgataatatggttacataagcacggggcgggtgggcgaaattaccaccgacgctgcccagttgtttgccgccaccgccgccgcctcctcgctgagcccgaaacgccgccggtggcctcctcgcctcaccagcctccacctctgctgtcggctcctctcctcctcgcccttcatgctggcgacgtcctctccggccaccacctctgcctcctcctctactcctctcctcctctcgccatcaagatctgggccgctgccgcctcctctcctcctcgcgctcacgccggcctccccgacctccgccgcggccgtcgtcctcctgaaacaaccggcctccccaacctttgccgccgccgacctcctccccaagccgctggccttaccgacctctgccgccggccacctccttcccaagctgccggcttccccaaaatccgccgccagccacctccaccccaagccgctagcggtaagcgtgttttaggttttttgtgaaaatttgtgatatgtgcaatttgtgatatgtgaaatttgggacttagggtgatatttgtgaaatttgtgaaatgacaatttgtcaattttgtgcgatgtcaatttttattaaaaaatgtagatgcattttttttatatgtcaattttgtgatttttgggacttaggatatgtggtatatatgtaattttttttgataattattcatttatatatggatttagttcctaggttattaaatcatcacagaatatgaggtgctctaggtgccatgttggtttcgtcgagttagtgcattgacggagccaaccaagacaccttgggacgccgaggatcatattatgtcttttataggaaatatatatgtttacggttttttaggggtttagtgcaagtatgaaattgggctcgaataatttatatgtaactttacaattctaaaacacacacacaaaaaaaaggttaaagtgcgtagatatttccaaacggctagcatgattaattgagttacaattattacaaagatagaaatagatttatctaatatttttaaacaacttctatataaaaaaatttcacattaagtattttaaaattttgttaacataaatcggggtaaaaccaaagagtggggcagcggtcgttacatgggcttcaacgactagtacaatgcagaactattagttgctacttccttactagctagacctcacttcaccatgtttgttctgacaataggtataggtgcaactgtacaagctagtgcaataagcatggtccgcatgcctgcatgtccctgcattatatccatctacataatccaaggaagcaaatttgtataggtgataatatatatgcacgagatatgcatacacatattatattatcatcgatcagagagctagcacttagatatttttatactggaatttaattagtctattctttacatcactcagctgatagtacatatccgatcacaatcacatgcggcgagatcactctacgtaccattcgaatattgacctatcacgtgccgaccgactgataaactaatgaaccgaattgtatgcttagtacaccattagtcgatcaccccacaaaattagtctatcatccatctaataaatacctataaaaatgaaaaatccttggctcaaatttattatccatacacaacaataaactagcataccttcaattgaatgcatataaattaatttatgcatatattcatgcattcgtttttcaacttaaaatttttaataacacctatatatctgaaaaattctaagagctagaagcacattacatacaagaaccaatacaagcctaaaatcccacattgggaggcctaaaatttggggaaaaaaaaagaagtttttagggttactctccaatctctaaatttgaccaattaaatcgaaaaaaaagaggaatggtgtagtatatactgctcttcaacttccatgagaggatttgaggaggagaggtataggtgctacttccttactagctagatcacctcacttcaccatgcttgttctgacaataggtataggtgcaactgtacaagctagtgcaataagcatggtccgaatgcctgaatgtttctgcattatatccatccaaggaagcaaatttgtataggttataatatttatgcacgagatatgcatacacagattatattatcatctatcagagagctagcacttagatatttttataatataatttaattagtctattctttacatcactcagctgatagtacttatccgatcacaatcacatgcagcgagatcactctacgtaccattcgatcattgacctatcacgtgccgaccgactctgataaactgacgaacctaattgtatggtttgtacaccattagtgtatcatcccacaaaattagtctatcatccatataataaatacctatgaaaatgaaatatccatggctcaaatctattatcaatacacacgaataaactaacacataccttcaattgaatgcctataaattaatttatgcatatattcatgcattcatttttcaacttaaaattttgaataacacctatatatctgaaaaattctaagagcttgaagcaagttacatacaagaaccaatacaagcctaaaatcccacattgggaggcctcaaatttggggggaaaacgaagtttttagggttactctctgatctctaaatatttgaccaattaaaccgaaaaaaaagaggaatggtgtagtatatgctgctcttcaacttccatgagaaattccgagaaaaataggtccaaatcgactggaattgaggaggagaggagagggaggggagaactgctcctattcgggcacggactggggggaaggagggagggcgcgcgtgactaagtcctattcggatagtggtaatgatgctggtgctgcaagagaggaagggcgccaatgaggttgatgccaaaaagggtctattccagcaattagtttatggaggggtctacttaattatcctctacctcaactctggtcatcactgaccagctcatgagctacactgtattctggcttctcaagtccttgccagtaattttcgcatgtggtcctctttagaccttgccagtaatttaacatttttttgcaggcgaggacttaagacgttcgccagtaaatataggagcggcttaaaaaaattggatcacaaccaacgagcgcaccttgcccctcccacaccctaactgctcgacctctcagcccctcacccgtctcagctctctccctcaccttttccacttccctttccaccacagcccctccactctcttcctagtctggccgaaggggcggaagctggcggcggctgcacttcctttccctccctgtccttgatctagttggagggaaggagggtgtcagtggcatcgactagatgcagctaattaggtgtaacctcaactatgtgattagatgaacaaactaaacatatagtcaaagagcaaataaatcaaccagccgagtggttttattaaaaaaaattaaagcatatgtgatgtcaaatctgacttaacaatactcatagtcactcatacaaaatatcaaataggtgttgccactataggtaacggaagtgattaaaccggtacctatagtgcttttcccaccttcataaaatgaaaaaaaaaaaactaacacctttaaacgaagataggtgtcagttttacagaaaaactggcacctatattttaggtgtcggttcacctataattaattataagtgccggtttttaaaaaaactgaaaccgataaaatcgagccgaaccagctaggggagatatttttcctccagatggggcccacacccacactggcaggagataaggccgagcccttctctcggcttctcctctctctctctgcggcagcggtgggagaggtagcgacgcttctcctctctctctctctgcggtagctgcaggagaggtagcgacgccctcccgtcaactagatcggggggaggggaggtgcagcggcggcggacgacatggaggcggcggcccggaccccccctccccccgccagatcgagcgagagaagaggtgtagcggtggtggcgggttggacctcgcctccgccagatccggtggcgtggaggcagcaagttcacactaacttcactcagaccatcacacaatagcatcatatacgaatagaaatcatctagaagtcatatccataaagcactgtagaaatcccatgaaaacaatccgaaactgactccaacctggagtctgctaatctgaccgttgggcaacccggttagaccggtccaacaccactggtctgaccggcagtccccgcctggtctgaccagccaccaagagccgactaccgaaaacactattcaccgtattttcacaaagcactcacctttgacaattgttcatcaccacgattaaatcatcacatgattctacacatatctagagagaggaggcaagagaaggcaataatatatgttggtaaggacatagctacagtgacagaaagtgatgatgaactccatcggtatcgttagatttgtgctgatgtatatgtttcttttttcacaacagcttagtgccgttttcttttgatatgtcctccacgtgtgttgttgctgtcaagtggccatcgacttaaatttgctagtgtgtgaaataatcactgctagtatacaacattaactggcagcagtactattatcgattggatacatgcgattctaaaatttgggtgttgtaaacagctatacccataggttagcctaatgtgtagtagcgacattttttttagtaaaatttttaacagccacctagctaccaggccagtactactagctatagatgctagtaaggcagaagatgccatgtgattaagcttctatttctcatcacgttcaccacatgggcagcaaaagttttgcatgaaatgggatcagttgcagtctacagaacacagtacacactcggtcttctatatttcgctggacgatagcagttaagcatgtaccaagccatccatatacatgtgtcatgcaataaagtagcttggtctctaaacaaacaaatacagagaacatatcatcaatataactattgtgaattaaaataacataatcatctctatcatgcaggtgcagcttgggcatgatgttggcttcaactataaatagacgcgtcgcactctccaatcagatgcacaaccacaagaccaaggaagcagtagcctttcagccctcttgctttagtttgttgatccccgactaaatctcattggaaaacaagctagaaaacatggaaggagtgaagagtttgatcatgtgtatgctagtgctaggcttagtcctgcaacaagagaagatccaggtggaagcaaagagttgttgcccatccaccacagcaagaaacgtctataactcatgccgtttcgcgggtggctcaagagacacctgtgctaaactttctggctgcaaaattgttgatgggaattgcaagcctccttacgttcaccatacccttcaccctgaagctggtaaattagaaacattaactctccttatctatatttctatcttgcattcaccacgcccttcaccccagctaacctaggcaaattaaaacatattaactctctttgtgtaaacttttgggctattaattttgtaatatctattggtacaagcatttattcatgcatatacatgattttgcagaggaatcggaggtacttgacttctgcaagctgggatgtgcttcgtctgtgtgcagcaccatgagcactcgtaagcaagaaaaaacatcatattaaattaccattgattttcaaccaaaaaaataaagattctttgttgtatatagctaatgtatagattgaatcatttgttttccttttcagtttctagcaatgaagaagcgaattatgccgtcgatcgttgcaacgatgcatgccaccgcttctgtaccaaggaagctgagactgtcaccgttgtttcctaagcaagtgcaacatgcaagcataagggcttcacacatcgaagcccatggaaggctatgccactctggagtactcattaataaaacggatatcatgatatccaagccagtgtgccatcgatcgatctatcttgatttctgtcactctttattttcaataagctatgataatcacgatctaccatcatatattatcttttcttgaggatgggagcatacgtagagtgatgatatcattgcctaataaataaatctttatcccttttgttaaaattttataatgcatgctacatatatcggaactgaggtggcaatgaatatacatgatcaattgagctggatagtccattacaggttttatacacatatacatggtgaagaaaataaattattttccttccttaattaaaaggatacttgaccaaaacacaatgaatgattaattattataaattgacctcatgaacagatggttaaacacacagttaataacgcataatgacttacttctcatctcttctatatgcttgaggaccatccaaaatattcaaatgttttcttggcgacaacacaatgagctcaacaattaccaggtaaccatatttatattcgccatcagaacttacagattcaacctggcaacctcttgtttattatatgcctaaggcctccttgggcattataaaactattacacctacaaacctgcaatgaacttacacctgtatttagatatacacctaatgttgctcagtacaagccaagttgatggaagtactgatgcttattaccttgaagaacaatatatacagtcattgtttaattgttttttgtactgcttgtttgggtaagcgcttatcaatcgtggtgggcagctggtaggtattttgctataacctcaaaattaggaattagggatggggtcgatgtatattcagcctgactgacttcgtcccgactccgagcaacactataacaagatgatggcagggatgtgactgccattcgagctacacgaaagatgagcagaaactactatgagagatgttggggtggggggctttgcagaaaaaaaaaagaaacaggccggaacttcatgcgaacaaagatgaagaattttaaaatcctcattaaaagactattgaagctaaaaattgagcaaattgtcaaaccaaatatcgttggtcttgcttttgggctgttaacaaatatgcaaaagaggtttgttattcctattatatgttttgatgaagagctagctgcaagtaattgctaactccctgccttgtgaggtgaaggacttcccttgatcttatttggttctccctttgacagtaaagaagccttctaaagcggactttctatcccttactgacagagttgctgatgaactccctttgtggaaggcctcactcataaacagtgccagtcgcttagttacggtgaaagcagtgctctcaactatacaagaggtaaccaaacctatagacaagagaaggagcttcttatgctcagagcaagagaaggccaatggtggcaattgtttggtcgattggaatagagtgtgccgactgtttacacccaaatttgacacctatggacaaaatagaggaaaattgccaatgtttggaaagtgctgggtttcctttacagggccggtcagaccatgggtatatgggctgtctgaccgactagtagggccggtctgaccgcaggtatgtgtgcagtcaaaccgtcatggtccaagtctgagtctgttttcgttgggcctcgggtttccttgctcgggaagactatgtttcgtgtttcctttggtcactatcccgagttgaacgtggagaagggcctgtacagggcaagaccaactcctatttaagggacaaggccggttcattgtaaacccccgaatacaatatatttgaatttttcttttaccatgttttctattttaacctaggtttagtccatctttgtcgatttgcgtcgtaaatcatccgccaccgctgcgacagtgcgacacctctatgtaggtttgtcctgaaaaccttccgttttgcccacgagatgggcagttatccccatatcgatctaaatcggcctagaggctgattttgatctctaaatcgaccccgctagtcggtttagctgtttttcgacaaaacccatcttgatttggctgtttgactagatcgaggtggttgacgactccatatcaccaggcgtttaggtgttgcaatcgtgcttgtcgacttatcacaaaaagttgccaacgcgatttttggtgactccattggagaacgatctaatcggccatatcacggtcgaatttcgtttaatctagtaatttctgtttcgtcaaatcgagagtttcggctaaacagccgaaatcaatctatctatctactgccactgtacatatctattgatcattgtgttgattgattcagatcggtgacattgttcttgtactaccgatctggccgcttattttgccggtctaaccgacatatttagtccggtcagaccggagaagtggagcagtagcatggccggcagcttctcagctgtacacggccaagagatcagaaacttaatccaattcggtttgtacgtgttaaaaaaaatcaggctatacaaagtcgatttaatcaataggcaaaactgaattggtttctgttagtacatacattagcacatctaccgaggaaaattacaaaaaatcaaagccgattcatattcggctgttctgtcaaaaattccaaatatttgctaggcctacacggttgattaccaaatagatcaaatatttttgataagtacagtaccatatcaagaaaaatcacgatcgtatattaatttattcggtcaaatatttcggttatgagctatgtggcccaaattaatcaaggaatttcttcatcaaccatggcgagcgggaacgagatcgacatggtcacattggacgatcttgatgagggagcacgcaaggccatataggaacatctcaaggcgtatagccaggagatattgatgaagacgtgcactaggacccgtcaaggtgtggttctcaagcctggttctctttacaaacccgtatttgacgataaggtaacctccaattcgcctgatccatgtcttgccattctaaaacatattgatcattgtatagatgcatcttttagtgcttattttgataaaaatatggtagaagatgcttgtaaaacttattctagtaagaaaattggctctaaaatagccagttgtcaacaatatcatgctacttctacttttgcgtctacacaacatattcataatactatggatggatcagcgggtgttcacacagccgattccacaggaatcggttatacgaa

SEQ ID NO: 61290 - DNA, 1384 bp, Oryza sativa
  unsure (1)..(1384): unsure at all n locations
aaaaactagacaaattttacacaaaaaatattatcttaaaaaataaaaattaaacttggtgaatatacattgtgatttccgttaccacacactaatagcaaatccctgttgccgaacgtaaaccgacgataatgcaaaccctggacacactatgccaattattgatccgatcgaatgggtgaaagcaaacaccccatgcatctttaccccttttgcacccatgcattgcttgtgaaaaactagtgactacaggcgaccaaagccccatcctgccatccgtatccaatgatcgatgtgactaatttttacacccgaaaaggcgaaaatataatgagcagctaggttgtcgcacgtctttgccgggataagatcggttagttgagagctgcacttcagctagctctcccctgatctgttcattcatcacagaggcgagatggatattcaccaacaaagctaaaacataagggatccgatcaacataatggatagacattgcactttggaggcattgtattattacacccnctagctaacataacatactacctctttntcaaattataagactttctagcattgcccgcattcatatagatattaatgaatctatgtatatgtatatgtctagattcattacatatatatgaatttaagcaatgctaaaaaatcttataatataaaacggaggaagtagcctacatacatgtacaacatgtgtgagtgcaacttccctccttttttttcagtatctttttttttttgcgccaaagtcaccatttggactctagctctcgcaaccccggcccctctccccccccggccggacaccgtctatacatacacgcacaacactgacgaccagctgaaacacgcgcgcgcgcgcccacacacacactcacattttttttgcacacacacaaacacaaacactaggaggagaagcttagttaattaacgtcgtaaagagagtcgtagtgagtgagagagagatggaggtgggcatggtggtggtggtggcggcaaaagtgttggtgagcctgtggtgcgtgggggcgtgctgcctcacggcgtacctgtaccgcgtcgtgtgggtggcgccccggcgggtgctcgccgagttcaggaggcagggcatcggggggccgcgccctttctttccctacgggaacctcgccgacatgcgggaggccgtcgcggccgccaggcattagctggcggaggcgcgacgccgacggcgagcacgcgacagcggcgatggcggcagcggcgccggcattgtgcacgactaccgccccggcgtgctgcccttctacgagaagtggagaaaagactacggtacgtacgtgctctctcgatcgcctcatcagctgctcgatcgaac

SEQ ID NO: 61291 - DNA, 3857 bp, Oryza sativa
ccaacagggacttgggcacgaaggtgaccacgttgtacttggtcgtcgacaccgagttggagcggtacccgtactccgggatgccgccgccgccgttggcgttgacgacgcgcgtgaaccccggcccgccgatcctgctggagctttcgtcgtcgactgccgtcggcctccgcccgcacgcgaaactgtacagcctgctcagcctcatcttgctcctccgccggcccctccgacgaccatcgccgccgccagttgccatcatatatatggatggattttgccaactactcctacttactagtagcgacgagctagatgatgttgagcttcttttcttgccggccggctattccttccttaatactccagtacgagctaggtagcaacccaagaagaagaagaagaagaagccgctgccgcagaggacgaagaaatcgagggaaaaccaggctcaagggcagcctatcctaccctcaggcctcagcagctgcttccaatatgtactactcctactacttctactactactactacaagggagggatggtttgttcctatacatatggccgggcagtgggcttcttctcaatttcttaggaagctccgcccctcccctcttttcaggtttcacgcgggtctctcggtcagcaacggagaccgcaacttcttccccttctcttcttgacaattcacaagaagaagaagatgatgaagatgaggagggagtgggagaggcggtccgtcttttggtcgtacaagtgcagctgcctcttccttcttcccttggtttggatttggagatggagggacggttgacttgcgggttttttcttttacttgtcaattgctcgcctaactagaaaagattcctacttctcatttttaaactaccccaatattttactaggttttaaggaacctgcaattgaggggaactaccaactactccatttttctttaatactcccttcgtagtttattttttttccataatcaaactttattaagtttgactaaatttataaaaagatttagcaacatctaaaaggtcaagttagttttattaaatctaaaattacatatattttgatatatgtttgttttgtgttgaaaatactgctcccttcgtcctataataaagtactaggatgggacatatactaatactacgaatttaaacaatagtcctaggatacgtcctattcggttgtaggttgttgtattctaggacgaagggagtattatattttatataaacttagtcaaacgacttgtaatatggaacatatgaagtatatgaagtatgtaggagtacttacaattcttagaaggaaatgctttagaaaattctagactagtgttcttttctttcattttgctttgggatttacgcacgatcaatgatggtactaaaatggtaaggccatttgaaacgaggatgggggaaaacacagtaatatgaaaagccagtaatagattgttatattcatttgattcatagaggattttgaaacatagtagttctaaaactgtcatttgattaacacaggaaaagcacatgaattttagatacatgataagtgtttattttccttcaaaattgctttagaatagtctatttcacaagaatttaaaaaggaatgggtagaaatcaatcctttgtttcaaaagtctccctagaattatttctcataggataaaatcctctgcaattcctatcatttttcttttatttcaaagaaggtctaaatggtgttcacgaacagtacttgcctcgtgacggtcacaacctgtacaaatggttagatttatcacatcgccgatacaggtgttcgtctcatcgtagatagaaaggagagtaacgatagtacattacgaacccagccatatgaatacatacttagaagtatcttaactgtattatttttctttgtccaggaattcaaagcagaattatcattttctaatgtttatattatattagggtataaatttgaatcacaaaaatatttatattttaagtgtatacaataaattgaaagaagttctacacaaatcgagaagttgactagtggttctctcagaattaccttttctcctctttcaggtacttacctcagaattagagctgcctgatacactcacatggccatgtcggacctagcttaactagtagcctcatttctttcaattctagcataaattttctgatttgctactgtgccttactctcacatgatcttggtaaaaaaatcatgtttactctcccagtctataaatcttcatattaagtaaagaagaaaaagtttcaaaccgtggattgaataaacagagtccaagtatagttacaattaaatatatgaatatttagaataaaatagaatacaattatgcatgtgaataattaaaatttagaataaaatataatgaagccaagcatttttacaacacaaattccaaagtaaaattttcacaaaaatacgaaaattagcaattggattgccatgcaaatttcataaaaattccaaatgatagaatctgggatataatattaggaatattaaaaatagttgatgttaaacatgaataatgggaattgataataaaaagtagaatatatatatgtgtgtgtatattactttgaaacctttaaattaaaattactctactctaaggaaaacattaagcatccgtagtatcgtgctatctattagaattaatgaaaataatgatggagaagagtatttgaaatcctgaaaatattacaaatctatgaagcttggtaataatgaagtgcttatagcgagggattttttttcttgtttgaaaagggttgtagactatcaagaatgtgcaatacaatatgccatcttttgtaagtggaagaatgccattaaagagaacaattagtttgaaggtggtgtatacaataaagttttatcttcaatctatcttattgctaagagaatactaaaaagagccatcacgtttacttaatggacataggaattgccatattaaatcggaatatttaaacgtaaaagttaaagtttgctccatggtctacaacttggaatggaaactatggagttgcaggttaaagtcttggacgaaggagatgtttagctgagaattggaatattcattcattcggaagaagcttgaatttttgaaatcttaagctgttcactagttagttaaataatgaacgtgctaaagcagtccaaattttgacttgagcaccgttataacttttttttttggaaaaagaagttctctctccggtcatgaatatctaaaatttaggataaaacttttgaaattttgacaatattttctcaaatgcttaaactaaaaaaatggtaggcacacatttgcaacaccataaactcgttagatattataagttattttaatataaaatttataaatagcgttatcctatatgtcaaatattgatgactcaaaggagtattgagcagatttattcgtgccgtttttacaatatactcccccgtctctaaatatttgatcgttcgtcttattcaaatagtaattattaattcttttttttatcatttaattcattgttaaatatatttttatgtatacatatagttttatatatttcacaaaagtttatgaataagacgaatgatcaaacatattttaaaaagtcaacggcgttaaatattactacaatatgttatcaagatcaagtatgcggttgaagaaaagaatcacattacaaaactgcagtagtactgtatatcatctttcaaggctctacttaaccccctcgaatattcgcgctctcgaatattagcatttttgaaacccaaagcactcaagaatac

SEQ ID NO: 61292 - DNA, 5198 bp, Oryza sativa
acggcggaaacgacgaccggagcggaggaaggtggcggcgcgtgtcacgtcctgataaattcatcccgaattaaaaatcattcgctaaaaggaataatagaattaattaaaattcgaaaagaaattggcaaacactaaaatacgtaccagaaaaattcgaatgtggcccggagaatttttgttaaattctccttggtctaaaaagagccctcaaattttacttgaattttcagagcaccggaaataattattaagcaacaaaaacaattaacaaagtttattaaaaagaaaaacctaaaaataaccttccttcctcctttgggccaagtttggcccaaagtcctccctctctcccctcggcccgcggccgaagtctccctttcctccctctctttctctccctctccttctctccctgctcttgggcccctcttcccctcccggcccactccctcctcctccctctttctcccaggccgccttcccccctcctctcctcctgggccagccgcccggcccaaaccgcgccacccagccgccccggcccaagctgagccgctcccctcccgcgcacgtgcgtcgcacgcgcgctgagcgcgcgcctggccgcgcggggcccacacgccaggccgccgtcgtcttcttcctcctcccgcacggccctctctctctcccgtgaaaaccctacttcgttcctccctcgaatccgcgcgatttaagcgttggattccaaaattaattgggggcttttaatccccattgaatcctcttcaattccccccaatttcccccttgaatggtgcccccaatcgccgggaacgcccgcgccaactccggccaccaaccatggccgccggccgtgcttcctgccgccgttcccgctcctcccgtggccggctccctcccccatcctataaaatgcaaccccctccgtgcgttctcttgttttagccccttcccgagctcccccacggccgcagcacctctccccgccgtcctcctctctctcccgtgccgccggccgcctccagccgcctctcccgcctcgcccgagcgccgtccggtcgcgccgtcgcctcctacagcatcgcagccgcctcctctcccacggcctaccctccgtttcgcgcggtgaccgccggaggcgcgttcccgccgtcgccctcctctttccttcgcgccggccgcctccagccgcctctgtctccctgcctgagcgccggtcgacgtcgccaccacctccctcggctccgcgacgccgccctcatccccggcatcacctcctcctcgcccgattttcgccggaacaccgtcgcccgcgccggcctcaccttcctcctcgtcgacgtctcctccggcaacccctttcgccatgcccgtgcatcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcgcccgtgcaccggtcggccacacctccaccacctccggcatcgcagcggcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccacctccgtcatcgtcgttgtagcggcgtgttccacgtcatcctcgtccccgtgcagccgctgccggctgtcctcgtcgcctcctcgccggtcctggtcatcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagccccgtgccggccgcgtctcgccttcgttcaaggatcgccgccgaagccgtcccctcgccgttcgtctccgttgtgcccgtctgtctccgctgcgcccgttcgtcgttgtcgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacggggtccgcctccgtcgacccgtggaccgtctctgtgtacccggtctaccgcggtccttttggttgacatgtggggtccgcatgtcaacggcgcagccttcctgtcttttccaggctagcgcttacacatgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgcgttctttttatgtattgttattgcttctttataggcttgtagctttgcttgtgtgcttcgcgtagctttcgtcgttccggaggttcccgaagcgtggttcgcggtcgtcgctgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttaagacattattattgctattgttattattaccttgttcaccctagaataaacaaaaccccaactagtggacactctatttatggttctactagtatgaattagggtagatgcttcgctgattaataggacaacattaggtggtttttataactttagactttgggaattctcatatcatttggacactatggaatggttggcttatggtggaattggacatacccctctcttcctctttcaaaacccctaaaacctgtttttcggtggggtttgggtgcatgccagttgtgggaagtggcaccccggccaatataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgctgaacaactaaaatgtggaatggttggcctgggttggcttgggacgagctgggacccagggtcgggttgccagttcggtctgaatcatcgtaggccttgggttaaggcaggttcgtgtgggttcatgaccttgattaataatatcatatagctctaggatcgtgtttacaaaatagctttgggtaactaagtgacttttaaatgctgtttactgcaaaacttaacccctatattattatccccttgtactcccttgcattaattatgcatctgccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgcgctgtaccccggcttttcctgggacggggattaatacactagcgttcgggaaaaggcaattttcccggtcgcgacagcgcggttcggatcgacgaggacggcggcgctccgacggtcggcgggcgaaacgaaggggtggacgaggttgacggggacgcggcgaagccgaaggaggtgacgccgagacgggaggaggtccggggcgacgacggcggcgaaccggagctcggcggcgacggcggagagagaggaagacggcgcgagctcgaatccgaccgggagagagtgcggcgagtggcggaaacggaggagcgaagcaggaggaacgattatatagcgtcgagagtgagagagggcggccggagaggaaggaaaccggcgcggcgatctcggctccatcaaagacgccggcgaggatttcgggaataaatccgggcgaatccgagggagagagagaggggaaagtggggggaaagagggagggaatcacggggagtgatttccccctctttatggcgcgcggggacggcgggatgcggcagattcggcggcggcggcggcgttagggcacgggcgggcggcggacgcggcgcgaggtaggcgatgacaggtgggccccacccgtcagcgagggtggcgggcgggcccgcccgtcagcagcgcgcgcgcggggaggggccgatgggccgcgggggagaggagagagagggagggagttgggccgagccggcccaagagggaaaaagggggggaaagaagacttttagggattttctttttataaaattattttaactttgtttatttcttctcaattattatttgtgctctgaaaattccactaaaatttgagggctctttttagaccaaggagaatttaacaaaaattctccgggccacatttgaatttttcttgtacgtattttagtgtttgccaatttctttccgaattttaattaattctattattccttttagaaaatga

SEQ ID NO: 61293 - DNA, 11929 bp, Oryza sativa
  unsure (1)..(11929): unsure at all n locations
atccctttccttatcaaacctgcatgctaatcaaataagacaagcaataacaaggtagataacaactcaattgcataaaaatgattaaacactcgaattaggggttccacaaaccgaactagcgatgaaatttcaatggcagaaataatccaagcaaaacccaactctagactattatggctacataataaatatgattagggatgtcctagggttgccgcacacccccctaggtttagcctacgacacaattacaaggccaaaggcccaaatcagattcggactggatgaggtacatggcttgttttgtcgattccagacaacaaattaggaatattgacgtgtgaccaaaatcatataaaagtagactccattagctttccatcaagttatcatagaccccaaaattccttcctgaacggcagctaggtccgtttgaagttgatgctgtcaggaggctcaaattcaaatcccactagtacagatccttccatctgtgacggcccctaacaagactggaatttgggggccgtcacaagtaagtaatctcaatcgagccgaagtttcgcccgattgagatatggtcgcacagccatggtagatcggcataaaactaaagcccgtcacggatgacacttttctgtgatgggccatagttgaggcccgattgagatgagggttccatatctcaatcgggccctaaaagaagcccgtcacagatgacagtcatctgtgacgggcaccaactgtaacgccccgattttcgttcgggattaaaaatcatttaataatccatttcctagatattaaataaaagttagagaaatttaatcaagtaaattatagagggaattaaaaatttcctttaaaaatcgttggctgggaatattttgtaatattctttgtgccctaaaatactctctgaaatttcccgtgaattttcggagctcaagaagtaattttaatagcccaagccctcctctctccttggcctgtttccccctccctccttcctctcgggtaggcctctctccctcggcccgctcgtccttgaagtctaaataacccccggctccctctctctctcaggccgacaagtgggaccgcgggacccactgacgtagccgccatgccgcccatttgccgcccacgtcgctaccgattctggctcctcccgctcgcaccctcgcgcccaaactgcatgaaatcggttcccgtccacctcctctacactctccccacgtttcccccgaaaatcgcactgggatcgagctccacttcacccacgatgtcgcccacgtcgccggccgttgccgctccaaattctccactccccggcctccccgttgctccctcgcgctataaaaagccttcccgtgctctcctcttccgtttccccttcctccctgagctcctcgtgccctttcccgtgctccccatgcgagcccaagtgccgccgctcgccggggaccctccagccggccgctgccgccgtccccgcgccgggccgcttgcgccatcgcgttcgccgctctttgccacaccccggcagccactccatattccccaatagccaccggaaagccaccccaccgngccaccaacctcncgcgctcgccgtatcgttcagccgcccaccaccgccattctcgtcgccgccgtgctgtgccgtttccaccgatggcttcgccgcatcaagctccaccccgacctccacttcgaacccacaaaaccaccgccaaacgccattccaccgtgcatccgagccaccaccgcctcccgtcgcgtccagccggccaccactactaccctaatggccgctgcgctgcgccgccgccgccgtcagcatcgccatgccgagctccaccccggcagccgctcgtcttccttcaaccaccaccgaaaaaccacccccaccaccaacctgaggccgccgccgcatttgccgcctcctgttgctgtcccagaccacctcgcgatgcgccgtcgcctccttcggctctgcaatgacgaggagtcccttggctgcctcctcaccatcgccatcccccaccggaacgccatctgccccgcgcgaggtgagctccgtcgccgtgcttgttgcctccggctgcccaccccgcgctcgcctaacccatccatcaccttcctcaggtcacggcgccccttggccgcccctctgttggcgccgcccgtcgccggagcgccgccgccccctctccgcccgagctctgtcgtaccgtcaccggcgccactcggtgaggaccccctccgtctcctctccctttcccctctttccgccgctgcgtcgcgccaccgccgccggtggccgtccggccttgtgccaccgacgcctggcaagccagctccctccgttgccgattttgggcgctgcctgtggaccgcccgtgctcttggtccacggcgccgcctaggccgcggtggacttggtccaccgtgtgccctccccttggagccgctgacgtgcggggcccgcgtgtcggcgccggcttcccctgctcacatcagcggcagcccttttcctttgcgaaaatatttaattaatgcgtcataaaccgataataattataaaaattcatttaatggctcaacaacttctaaaattcatatctaattcattcgaactccaaatagggcgattcaacttgcaaaattcatctaaaattgagctgtacgtgtttgtttactttttatgtactgttttcttggtttttattagagtttttcctcgttttgcatgctagagtgtagtttctgccgttttggaagtccgctgttgtgaggaaaggagtttagaagatcaaagtgaagaagtaaggcaagtcacacattccccttgagcattttgatcctactttacaaatgttttaccgtttggaaataaaattgcatgtcttgctaatacatgggatcagggtttacctatcttctcgcttgtgccatgtttacttgatatctatcctttgtcaacattgggtaataaattgactagctcatgttacttttgtgacctagctagaactatatgcttaaccatgcttaattaccactagcctagttgatgggataattgcagtattagaccttgttagtatcagaacgagctgcgtgctcgagacacccggacatgtttaattggtcataattatccaactaaaatgcgactgaatggtgggctgtggatgcatggttttgtgagtcgcacccatggcaattaaggaccggttcacgggaaaccctggaagacttacagtgctaccacaagcaggagtggataattgcttgatctgaagtatagctcgaccctttcctaggcaccagtggcgagggtgggcgtaatggagttgggtcggccggggtgtccggttgtccagctgccggattcaccgtggcgcatgaggggactgcccgctgacttgcgaggagtgggggtgaaaccttagcgtggtgtggatggttatgggagagttatatgaagggtcttgtcacaatcactcgacgtggtgacgtgttcgtcatgggcacatgatggcacggtgacatgccagtggattgtgtcttgtgggtatagttgtgcacctctggctagagtaaaactatttgaatagccgtgcccacggttatgggcgatcgaccagattcaccgtgattagtcccacacttaataaatcgacccaatgcactgtagttcaggtgggttggttgggcctgttcaacatggtgtagcgttgatcagtggagattcaatattactataattactcaactgttttaccagtttgctcaataaaatgttttacaactacctttatgcaaatagccacaagccattcttgaataaaatccccttgcacgtctgcatcagtttgctcaataaaatccccttgcacgtctgcatcattggtgtggcttgctgagtacggtggttgtactcagccttgcttttattccccccttttcagaagtgtagtgcttctgagctggagatgaagttagaagaccaaggctccgaccccagttgagttttgcctatggagtggagctaaagtcccgctaggatcacctttttccactgctgctgctttcttttcgatgtgaggactaagagcctcttctgtaagtatttacgctttatttacatttggaactgtttattacttgtcattttgtgtaccctggctgattcctggacagggatttaatacacaaaatagtctggaaatttgggctaaatttcggggcgtgacaaactagaggcccgattgagatatctaatgcccatcacagatgacactcttctttgacgggcttttattaaggcccgatagatattacttgtatgcccgtcacggttgattgttttagggccgttacagatatttgatgcacggtataaataccccccaccacctagtgtaactgtatcccactgttcactattttggtgggaggatgtagggggcgattttttgtcttttttccaaggaaaacacaaaatttccaaaagtgatcaaaatggagcaatcaagttagtaatattaatcattaattgagcaatttcatcatgtcttgcttttgcaatactgatcttataagatgtgcctctaatttatttttttttattttgtaattgatcacgtcttacttttacaattgatcgaagttggatgtatgcgaaaaatttgaaacatcattctacggagtacagaaagggcgtaataatttttatgaacgccgcggaggaggatcggaaaagaagaaacagtgattacatgtgctcatgtgcagattgcaagaatgagaatatgtttgatagcggagaggattcatgaagggctatacatgttgggttaaggatggagagcaagaatcaggaagtggagcagtagcagacagaagtggtgcgcataatcaggaagatgaagatgagcatgacatgtttataccttgtccattgggcggtgaaatggttgatgtggatcacgatctgctgcaagacatattacgtgacgttgaggacctagcccagaatgagagagattccatgaagttcagcacattggtcagtgattccgagacgtctctgtacactggatgcaaagcaaaacacactaagttgtcagttacgttggacctaatgaagctgaaggcaagtagtggatggacagacaagagtttcactgatcttttaggaattttgaaggctatgcttcctgctgagaacacattgcccgagacgacatacgaagcaaagcaggttctgtgtccactgggcttagaggtccgtagaattcacgcttgtccaaacgactgcatattgtaccacaagcaatatgcggacttggatgcttgtcctgtctgcaaggcttctcgatacaagcgaaagaaaagtgctgacgaaggaaagaagtcaaagaggggtggtccggcaaaggttgtgtggtatctacctatcattgatcgtttcaagagaactttgccaacttgaacgaagcgaacttagtacgttggcacgccacggagagaaggaatgacggtatgcttagacacccagctgattcgattgaatggaggaatatcgatcgaaaacacaaagactttgctgccgaccctagaaacatgaggatatgtctgtgtacggatggcatgaatccttttggtgacatgagtagtactcacagcacttggctagttcttattgcgaactataacctcccgccatggttatgctttaaacggaaatatattatgttgtgcttattaatccaaggtccgaggcaactcgacaatgatatcgatgtattcctggagcctgttatcgacgatcttgagattctttggaaagaaagtatggaaacttgggatgcatattgttcaagctaagagttctattgttctgcaccattaatgactaccctgcactcggtgatctttccagacaaactataaaaggaaagaaggcatgctccgattgcaaggaacatacacaaagccagtagctgaagaaatcacgaaagatggtatacatgagtcatcggaggtgggtcccgctacgtcacgcatttagaagaaagaagaaatattttaacggtaagagagaacttcagcctactcccaaagatttgttcggagatgaggtccacaatatggtcaaggacataagcaatgagtgtgggaagaaaagaaaacgtaacaacacaaaggagaagggtatgtggaagaaaaaatccatattttggcggctaccttactggaaagatcctgatgtccatcattgcattgatcttatgcatatagaaaagaatgtgtgtgagagtttggttggcctgatgttgaatattctcgggaagacaaaggatgggttgaacacgcgccttgatctacaggacatgaatattcgcagtgaactccagcccatatgagatgcagagacaggtagagtgtacctccctccagcctgccacacattgtcgaaagatgagaaaatcgcaatgttatcatgcttgaaggatattaaagttccatcgggctattaagcgaggataagtaagtatgttaaattggacgatctaaaacttgttggaatgaagtctcacgattgccacgtgctaatcacacaaatcttgccagttcctatcagaggcattctaccaccgaaagtgcgtcgcacgatccaatgtctgtgcgccttcttcaatgcaattggacagaaggttatagatccaaaagatctagatgggttgcagaccgatattgtgaataccctctgtcacctggagatgtttttacccctgtctttctttgatatataatggttcatctccctgttcatctggtgaagcaaacaaaactatgtggcccggcttttctaagggaaatgtggccgcttggaaggtacatgggagttctgaagtcgtacgttcgtaacagagctaaacgcaaggggagcatcattgaaggttacacgaccgaggaggctattgagttctgcgtcaattacctgtccgatgccgatcctatcggagttcctgcgtctcatcacgagggaaggttgtcaggtgttggcacaatcggaaggaaaagaattaggcctgatcaagtgtcctatgcgcaggctcattacgctgtgatccaacatatggcggaagttggcccatactttgaggagcacttagcgaaaatccgagatgagaacttggggcgatctgatgaatggattaactgataacataattctcggttcaacgaatggttcaagaatcgtgtgacaatgtccatggatgtcccaaatgtgacaatgtccatgtgtcttggaccgtagacacatggcaaggatatgatataaatggatacacattttacaccgtcaaacaagatgacaaaaacacagtgcaaaacagcggcgtccgtatatccattccaggatcaagttgggtcaaacacatacactacggccgcattgaggagatctaggagctaaacttcgtcaagttcaaggttcctttgttccgttgccgttgggtgaatctacgcgctggtgtcaaagccgacaaggaaggtttcactttagttgatctatcaaaggtgggatacgaaatttcatactaatgcccgattgagatgaaaatcaggcccgtcagggatcactcatctgtgacgggccatcagtaatactcgattgagatagattaatctctatcgggctataactaagcccgtcaccgatgactatttttccatttgaagtatttgtatctatgagtgcaaaatatatagctgttgtgtaataattcattttattagtcataatatatttttggatagtaaaagatttcaaatggaaatatggtcaacaacaaagttgtagagcctttcaagatctacaagttttattttggtcatttttctatataacatttttcccaacagtttgaaattgaatttgaatatatgacaaaactaaatagcaattgtaaatactaaatgatttcaaatggaaatattgtcaacaacaacgttgattctctcatcaagatctacaacttttattttggtctttttctaaataactatggtcaatcacatttctctcatctggtttataaacatcaacacaaatatgtcaattttgtaaacattggtactatcactttgttggatgaagaagtgaccaaaataaaagttgtagaccttgataagttgtacaacttttctttttatggcttttccatttgaaatcatttagtatttacaaatgttgtttaaatttgtcatatattcaaattcaatttcaggttgatgggaacaaagttatatagaaaagtgaccaaaaaaaaagttgtagatcttgttgttgactttttcatttgaaatcatttactatttacaaatgctgtttaaattagtcatattgtgaaaatcaatttcaagctgttgggaacaaagttatctagacaaatgaccaaaataaaagttgtagatcttgataacctctacaattttgttgttgaccatatttcgatttgaaatcatttactatccgaaaatgtattatgactaataaaatgaattattatatagctgctatatattttgtactaacaaatataaagacttgattggaaaaatgcaaaaaaagtcatcggtgacgggccttagttaaagcccgatagagattaatctatctctatcgggcattatcttagagcccgtcacagatgacttatctgtgacgggcctgaatgtcatctcaatcaagcattagtatggagcccgtcaccaatgagtcatctgtgacgggccctacggcaatgcccgattgagatgacttatcactctactataacaagggtttctcatatcggatcgaaaaattttctaagtcctgctacagtttcccgcctccttagaaccctagcgccgccgccttcgtcctccctcgccaccaccgccaccgagcccgccgcttccaccgagcctctacaccgaccagcgtcggccttcctcgtcgtggtcgcctgcctcttcaccgacgcgaatagctgacccccaccgagcccggcgacgtccttcctcatcgtcgtcgcctactcctcaccgacgcccgacgccgacctgcccgaccggcgccgccctccaccgagcccagagctaccgccgcgaactccttcgccgagcccggcaccaccgccaccgagcccagcgccgcctccaccaaccggcgacgccctccaccgaacccggcgccaccaccaccgagcccctcccccccccccccggccgtcctcaggtgagtcctccatcgcgccgccctctgctacctgtggtgaatgatgaaatgtggatgttgggatgaatttagtgatagatgattttagtgattgatgacatgttgatgaatagatgaaatgtggtgcattaatgaatttagttatagatgattttagtgattgatgatatgtggtgaacgaatgattttttttattgatgacatgttgatgaatagatgaaatgtggtgcattaataaatttagtgatagatgcatgatatgtggatgaatagatgatatgaggtgaatttatgattttaggatttgatgatatgtttatgtcgcgtcccaaaacgactctaaaatacatcctctaaattatgcctagaataattaaaatccatgtgaaagcctccaacaattaaaatgtgcaaagttaaaagtcaaataaggcttggaggatttttctatatttcctaaaagcctaaaatgcgtaaataaattttagtggaattttcagagcacaaataataattattaagaaataaacaaagttaaaatgattttataaaaagaaaaactctaaaaagaccccttcccctccctctccctcttgggccagctcggcccatctccctccccctccctctcctctccccgcggcccatccggcctctccccgcacgcgcgccgctgacgggcgggcccgcccgccaccctcgctgacgggtggggcccacccgtcatccccttcctcccgccgctcccgccgcctcgcccgcgccctagcgctgccgccgccgcgaatcccgccgccctcgtcctccccgcgtgcaatcaataggggggaattattccctgtgattccctccccctttcccccaattttccctccctctctcccttggattcatttggaaaccctcccctaatcccgccggccccattgatggagcccgagagcgccgcgccggtttccttcccctccggccgccctctcccccttccaatcctatataaaccctccccgcacctcctccgttcatttccgcctctcgccgcccttcctcctcgccggaatcgagctcgcgccgtcgctctctctctccgccgtcaccgccgagctccggtccgccgccgtcgtcgccccggaccacctcccacctcggcgccgcctccttcggctttcgccgcatcctcgccgacctcgtccacccctccgtttcgctcgtcgaccgccggagcgcccggtccccgtgacccgagccgcgccgccgccttcctccactccggccgccttttggtcgtcgctgtcgacctagggtgagccgtggaccgccgcctcgtttccccctttccctcccttctctcggccgccgctccgccgtgcctatggtcgccgccggcgaccataggagcgcgggcgcgccgcctcccgccggccgcgccgcagtggccgccttcgggcgcaccgagcggctgcctagtggggcccggctgtcagccgcccgcgccgtcgggtgcagctgacgcgtggggcccacggcgccggccggtgtgagccctggtgcacccggtccaccgtggaccgtgaggctgccgcgtgggtcccacccccatggacccgctcggcgcgcccccttcccttggctgacgcaataaacttttttttaaattaaaatttaaatgaggaaattcgcaaatattcatttaaagagcatataaacttcaaatggccataacttggctatttgaactcggaattggaccattcaagtctctaatttttccttaagaagtcaagaacccatttttgtgctttgttcctgcttgttatatggagtttattagagtaaaagccttttcttttccgttggtcgtgtagacgctgcagcttcgcaagatccgcttttcgtggaagttgaagccgacgtttgggaaagcgagcaaggcaagtcgcatcatccttgaacatatagaatcccagtttataaaattatgttgatttaaattattgcaatatcgctttatttaaattctcgcgttatcactgttttatcttgccatgcctatttacatttgttatgaccttattattgttattgttattatttccttgttcacctgagagtaatcaaaaccccaactagtggatactctactcatggtaccactagtatgattttaggtagatgcttcaccgcttaattaggcaacattaggtggttttacaactctagactttgggatactcttatcacctagacactatggaatggttggactattgtggaattagattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatgaacatctctagggcaaatgaaggctacacgggctgcggcccggtagtcgagatgtcatggcacagggccggtgtcctgctgctaggggctcagtcctgcctacctgtccccgag

SEQ ID NO: 61294 - DNA, 1692 bp, Oryza sativa
ggtgtgtcgaaacatgaattcggcaataataaaagagggtagcgtacgagacctaaagtggatggatgcggagacaaaggatttagacaggttcaggccctctcaatgaaaggtaataccctactcctgtttggggatttgaatccgccgggtgtatatagatctgacgatctagttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgcatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaaatgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgacatagaaaatagactcatgactatgaatccatgtgaaaatgtatccggaataagtccaaattggagatataatcctcacgcttgagttgatgagcc

SEQ ID NO: 61295 - DNA, 646 bp, Oryza sativa
cgcctcatgtttcccctttctattaattctactcaaatgatctattttatcttaatatgaggtgctctgctgatcctttatcaggccaggtcctttgatcaaacgcttgtgttaagaagacgcacggactaatcaggtcgttcaacccaggccttgatctcatagttggcttgtcattctgcaatccgataatctactcaaccatgttagtgttgtttctctgcatgacaaggtgcaactctgctcatgtacacatgatgttatggctcagtagttccctctgcctcccaggcctagctagctacatgcagttttggtatatctaaactgtaatgttcatgcatggctactggacaaatggacatggaggatgctgcttgatatagataaaattcatcgagaaggaaacgaagtagttggtctggtccatccatatgtccacctaaggtaattatagaccactcaagaggattttcgggcaggctcttcatcctgcactgttgtcatgtaaagtactcgttctgaactagctagcaatgcgcgacatattccaacaatttttaggatgcaactttcgaagtcttccactttcagactatcaaactttagcaatacaacaaaaattacattaatagatttatcaaac

SEQ ID NO: 61296 - DNA, 2376 bp, Oryza sativa
tctcccttccatcgctgccgcctgttcccgcccgagcagagacaacgccgccgccgagctttcctctcctctccacagctgccagctcctctctcaccgtcgcctctctcctgcgctgccgctaggtccgacgcggccacggtctcctcacaccggtcggccgctgcctctccccaccttcttcggatctcagccggagaaaaaagaaggaagaaagagaaaaaagaaggaagaagggagaaaaaataaaaaaaaaattccatgtcatcgtccacgtggcatgccacgtaggctagaccacggtcaaacgcggctttggaccgggatgatacaataaaccaagtttagggatctcgatgtgcgctttacaagttcgtggacctaagtgaaaccacatgacaagtttaaggcccgctggcgcatttaactcttctcaaaattatccacaaaatcatccccaaatcttaaaaaaatctacaaatcattcacaaaatctaaaaaaaatccacaaagccacagccgccgctgccgctgcttccgccgggccgccacccggcctcccctcccactggatctggcggaggatgaacgtgcagagatgtaacctagagggggggtgaataggctttcctgaaaaattactcgtacaatcgcatcggtcaaattcaacagggcctggaacctcctggtgatgaacaccggaacttccgggtagtgatgtgtaggccggaatttctggagttcttgagccaggaacttccgggtgacataatagattgaaaacagcaaggaaatttaggtcctagctaagtaacttcaagcacagagaaatacagagtactatcaaacacaaccacataacatgcacaagagagacaaatgagattttttcctgaagttcggatcacacggatcctactctccgttgaggtgctccaatgagccaggtctcgattaacccttgcctcacttatgcaaagatcctagaagaagtccacagccttgaactcaacacctctaggtcattttctagaatgagagaatccattctataccaccgagtttgttagagttcaacgatatgccatcgacattgtttctttctataatataccgacgacgttatcaattgttctataatacgccattgggctaggtcttattttcaaaaatacccaaaatacccttacaaacataaaattaacaattgatttaactcattacaagtctcacaaaaatatgaaattttttatgtggcccccgtacacaacatagaagtttgtatacaagtttcaagtttttctggtatatttaatttttagaaaaaaaatattttgtgtcgtatatgagagaaaatatgcttatataagagataatagcacaaaaatatcttatatagtttatgaaagatgatttatattaaaaacaacaataaaaaagtattttatatggcatataacaaataagttatattttttataaaaaaatagaaatgtaaaaaacttgaaacttctttacgaatttccatgttgtataaggaggccacataaaagttttcatatttttctgaaacttctaatgaggtaaatgaattgttaaccttgtatgtctataagggcattttgggtatttttttaaaaaaggctcagcccaatggtgtatcgtagaacaattgataaagtcaccggtatattatagaaagagacaatgttgatggcaaatcattgaactcgaacaaactcagtggtatagaatggattctctcttctagaattgagtgaccaccaagatccaactcacaattccttctagaaaagaccacaagtgcaagttgctctacctaggacaacctctgaaaactcagcacaagaatctttactcacttacctcgtttccttgcggaggtgagaaaaaccttcacaaaccttcctgggacatccacaagatctttggaagttcacaggcgacacctaaccgtctaggagaagatcaccaagagtaataagcccaaggtatccaaagtgctcaatcaaacctactccaaatcactcctacactctcatctattctctcaatatcttaagataggctctagatttgagtggaggaagcaaagggaccttgggaaaggctagaaaaccctaggacttgaaagaactgaagtggaatggccaaaaggtgagctggggacgatatccataaatataacggctaggtgacatcatctaaccactactcacaggtttgaactggaaacctgccaggaagttccgggccaaagtgctaggaacttccgcgcaacacttaggaaaattctcgctatacttcagcgcccggaagttccgaacagaaccccgggtgggactctctgtcccg

SEQ ID NO: 61297 - DNA, 687 bp, Oryza sativa
tgttcttcattgtaatctgtggttttccatatcaatctcataaaaaatggattatggctattaccttacgagggacctgaagcagtataatccttgttttcttgtttgcttgatgtcgtatcgtgtagatcctcataccaacgtaccccaataccctatacatctggtctacgggtatcccccgtcaacaaccctatactaatctaattccctccttcctctccctcttcccaatcccatctcaatgagaatgctcatgctatcacattgcacgacccatggctatgcctctctccaccccacttcctttcgtacatcgagaaccgcccctgatagtgatctctcaaatgtcttcctcccttccttcttctccacacaccactctcactagtcttcttccattccgatgcctttcccctatcatgcctctcctgccccggtctatcaccgtaacccctctccctaaccaatccaacaaatcacccctgcctctagcgctgccccaatcaccgtcctccatccctacagctctagcgccaccgtgacaccctcatcacctacttgtctccaccgcctgctacccattgcctatctttctccatccaggccatccctttaacatcaccctcactcactgccccataccccgtaccatctcttggtatgagaatctcacagggctgcagg

SEQ ID NO: 61298 - DNA, 5356 bp, Oryza sativa
gaccggttcacgggaaaccctgggagacttaccgtgcttaccacaagcgggagtgggtaactgcttgatctgaagtatagctcgaccctttcctaggcaccggtggcgagggtgggcgtgatggagttgggtccgccgaggtattcggttgtctaggccggattcaccgcggcgcaagaggggaccgcccactgccttttgaggggtgggggtgaaaccttagtgtggtgtggatggttagggaagaagggttatgtggagggtcttgtcacgatttccccctttgcagtatcatggtgatacttcggggcatggcgacatgtgtggaatcgtgtcttgtgggtacagttgtacatctctggccagagtaaaactattcgaatagccgtgcccgcggttatgggcgatcaaccagattcaccgtgattagtctcacccctagtttagcttattgaactggtgtagtacaggtggttggttgggcctgttgcaacgtggtgtagcgttggacagtgattggttaatattgattaattactacagctgttttactgctatcaactactgctttgaaatgcctgctttatgcaaaagaacccctagcttcctttggttatatcctgcatcatacctcctcttccggtatgacttgctgagtacagtgggtagtactcagtcttgctctcttttcccctacactagagttgaagttcttctcagttggagccgtctcagagaggttggtttcgtcgctgccgtcaaggtttgcctgtggagtagagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctagacagggatttaatgcacattcagcttagaaattctggttcgagaatttctgggggtgacaagttggtatcagagccgaccttgaccgtaggacaagccaactggaaacctaagagccttctgaaccctttttttttcatatgcatatgcccttttgcacttggattttgtttcgggaaaattttggggtttgttcttttgatttgtgggaaaaatcttggtcgcttatttaattggatttctcgactagggacagtctagggatttagtaaaagtttattcgaaatttattcggcagtcggtcgggaattgtcgggtgatatgcattaggtcgtgtctatgttcggtggggtaagtttatgcgtatcagtatgactatgcatctatttcatgcattaagttattgtttagtcagttgcattagtgtcttttgtctcggttcgtgaaaaatgttgttctatgtataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacatatccccttcagatggagacaaggaatggttcacgcgactccaacaacgccagtggcagcgaagagccgatcaatggagcacgtgccaatagtgcatctgacaacagtctgtccccaccgcccgagaacccaacaattgctcaggtgttggacaatcagactcagatgatgacaatgatgatgcaacagatgcagcaacagtaccatcaggtgttgcagcaggtgcagcagcaagcacagcagaagcagcagaacctgcagtttggtcctccacgccctcagtccaaactgttagaatttcttcgtgtcaagccgcccactttctcaagcaccaccaacccaatcgaggcccacgactagcttcatgccattgagaagaagctgaatcttttgcaatgcaacgagcaagagaaggttgcttttgctacacaccagctgcaaggtcccgcttctgtttggtgggacaactacatggtgacccgtccagctggggcagaggttacttggacagagttttgccatagtttcaataaagcacaggttcctgagggaattgtggcacaaaagaagagagagttccgttccctgcaacaaggaaccagaacagttatagagtatttgcatgagttcaaccgcctcgcgcgctacgcccctgaggacgtgcgtaccgatgacgggaggcaggagaagtttctgtctagtcttgatgatgaattgactaaccagttgatctctagagattatgaggactttgagaagctggtggataaggctatccatcaggaggagcactgtaacaaaataaaccgtaagaggaaggcaactcagttcaggactcccaggggaagagttagaagcctcgtttcacgatgggacgtcacggtggaccttccaccatgattatccggcagcaccgtccctaccacccgggtagcttcaacaagaaccaccatagtggcagtcacaacaacagtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagatgtgctggacccaagttcgttcaggcccgtgtcaatcatgcatctgcagaggaggcgcagtcagcaccagaggttatattgggcacattccccgtcaactcgacaccggcagtaatattgtttgattctggtgcaacacattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttgacaaggcacagaggagtgattgattgcgctagccgtaccatcaagttaaccaatgcaaaaggagaggtggtaaccttccagtctccagtgccgcagaagccagggatcagtttaaaccaggctgctggtgaagaacaagaggtagcagtggagaaaaccactaagaagctggaggatattcccatagtcagagagtatccaaaggtttttccagacgatctgacaacaatgccaccaaaaagggatatcgagttccggattgacttggtacctggaactgcaccgatccacaagaggccttacagaatgggagccaacgagttggcggaagtcaagaagcaagtcgatgaacagttacagaagggatacatccgcctgagcacgtcgccttggggtgctccggttatctttgtggagaagaaagacaaaaccaagaggatgtgcgttgactaccgcacactcaatgaggtcaccatcaagaacgagtatcctttaccaaggattgatgatctgtttgatcagttgaaaggagctactgtgttctctaagatagacctacaatcaggctatcaccagttgaggatccgcgaagaggatattccaaagacagcattcatcactcggtacgggttgtttgaatgcacagttatgtctttcggactcactaatgcacctgacttcttcatgaatttgatgaacaaggtgtttatggaatttctagacaagtttgtcgtggttttcatcgatgacatacttatctactccaagtccgaggaagaacatgagcagcatctccggttggtacttgaaaagttaaaagagcaccagctatatgccaagtttagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattcagaacttctctaaaattgctaagccaatgacacagctattgaagaaggaagaaaagtttatctggtctgctgaatgcaataggagttttgaagaactcaaacgatggttggtgtctgcaccagtcttaatcctgcctgatcagacaaaagatttccaggtctattgtgatgcatctcgccaggggctaggatgtgtgttgatgcaggatggcaaagtggtctcttatgcttcacggcagttgcgttctcatgaaggcaactacccgacgcatgatctggaattggccgcagttgttcatgctttaaagatttggcggcactatctcatcggtaaccgttgtgaggtatatacagatcacaaaagtctaaagtacatcttcactcaacctgatttgaatctcagacagcaaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggttgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcagtattccattcatcccggtagtactaagatgtaccaagacctcaaagagaagttctggtgggtcagcatgagaagggaaatagctgaattcgtagcactctgtaacgtctatcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaag

SEQ ID NO: 61299 - DNA, 669 bp, Oryza sativa
ctagcagcttatttatacggtcttgtaaagtaaagaattaagatcagagcagagtatttctacacaaacgataattttagtgcaaggcattgaactagtcagaagacgtatgaacaaaattgaattaaaacattctcatgattagtacatatatacaagctgtaactacatctttgatattataatagggtttgtgtgaactaaaattttgtgtttcattatttgcttcagacattgtatgcagatattgttgtatatatgcttctttaattcccatggttgtaaaacttataagtgattactaattgctttgttcatatctcccggccgtcagaattttcatttcattatctaataaaaaaatgatgaggagacgttgcataggggtacacacttacgagttacgatgtatatttgattcccaactacctgttactagtttacaatctagcaactttggagacatctcttggcatgggcaacctgtgagcccagaaaaggagacaagtaagtgtcgagtatcgagagatgttatgataggatggggatactaacagatttagaaagtacatatttttacttaaaaatataatatgttgcataaattaaagcatataaattgcttttagtaaatctaattgatttttatgtgaacttaagcatatttat

SEQ ID NO: 61300 - DNA, 35999 bp, Oryza sativa
acgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgccggcgaggacaccactcggcggcggacgaggcaggccggtcggtgaagtcgtagacgcccaacagcggcggcataataggccagccgtgtaggcggaggcaccagtcggcggcggacgaggcaggccggcggtgaagtcgtagacgcctaacagcggcggcataataggccagccgtgcaggcggaggcaccactcggcggcgacggaggcgggccggcggtgaagtcgtagatgcccaacagcggcggcataataggccagccgtgtaggcggaggcaccactcagcggtaacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcgggccggtcggtgaagtcgttgttgttatcagcaatggcggtggcgaagacaagccggcagagtggactcgcggccgatcgaccggaaagctgagacgcttcgagtccatgaccagcatcaatcgcctcaatagtgccgcgtaattatatgtgaacaacaacaaaaaatagcaagagattaatctgagattaaaaatcaatatgataaataatgataaaaatcagattgagtttccccctgactgatttggatcaagtcagagaagaggagcttgaagaagtgatcgacggaaaggaagtgaaaactcccaaagcgaaaacgaagtcggcgactcatgaaattgattccatcgcgctcgttgataggaaactcgacgcaacccctacctggcgcgccaactgtcgaaacatgaattcggcaataataaaagagggtagcgtacgagacctaaagtggatggatgcggagacaaaggatttagacaggttcaggccctctcaatgaaaggtaataccctactcctgtttggggatttgaatccgccgggtgtatatagatctgacgatctagttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctatgactagtcggataaccatgccgtatgggtatggggtacccataatatccacatggtgagtctctcatgagaagtctttagctcctcatacaagacctccaaagaagcatgatccttctttagggccatgaacttgacaatctttttctcactataagcatggagctcctcaaacatactcacaagctcatcataggaaacatcattacaattatcattactctcactatcactaagagatgttaccttagaggaaccctttgccatgagacaaagtggagcgaagagtgatagagcctccttgatggcaacaacggccatcttcttcttcttggagcttgcatcatcaccaccttcttcctcggacccggatgaggcggagctctcctcatttgagtcccattccccgatgaaggcttcaatcttcttgccttccttcttgagcttcttcatgagcttgtatcctccactcttcttcttggatgacttgtctccatcatcatctttggaagggcacttggaagcaaagtgtcccttctcaccacactcaaagcacctcaagttggagagagtcttgttgggtcttctatttcttctcctatttgagtttgagccccttcctctctcctttctccttcccaagagatcattgaaccttctagcaagaagggcaatctcttcctccaagtcctcattggcttcattcaccttgcccttgcccttgtcctcaacttcagcttggagagcaatgcacttcttggaaggtgaggcttcctccatctccttcttcttcaacttgtacatgtcattggtgttgatcttccccaagaggcttgccggtgtcatccttgacttgtcggagttgatgagcatggtgacaagggtctcatacttctctggtagagccctaagcatcttttgggcaacctcaagatcggtgtagtttgccccaagccccttgagatcattcacaataacattgagcctcccatacatgtcattcacactctcatgaggcaacatggagaatgtctcatattggatcttgacgaaatgaagcttggcatccttgtactcacttgtgccctcatggatctccgccaacttgttccaaatctcatatgcggtctcaaggttgctcactctatcaaactcctcttggctcaaagagttgaacaaagcattcatggcttgggcattgagttggaggttgcggtgatcaatctccgtcaagggtgtgccgttgatagcaaagcctacatccacaatactccaaatatggaagctcatagctttgaggtgagtagacattttaattttccaagtggaatagtttgtgccattaaacatgggagccttccctacatggttcacctcgttcgacatcttctctctaggcggtgaagcccaatcaagagagaccaagccctgataccacttgtaggatcgagaggtcaactagaggggggtgaataggcgatttaaaactaaatgacacctaatcaaaactaacctaagttgctaggcttggtaagggtcaactctaactaagtaactaagttatgttttgcaaacctaaggtgatagtggctcaattatatctctaggaaaagtaaatcacactcctatgtcaatgtttagcaatcctagggtgatatgatctcaagtatgtctctagaaatgtaaattgcacaaatgtaaatgcgacaatcaaattagacaagtagacaagagatttttcaccgaggttcggaaactcgcctgtttcctacaccccgttgaggcgagcccaactccaccgctcaaccacgaaaccaccgcacgcccctttcgtcaaggggtgggcaaggcgggagcggcccatggagaggactacccaagcctcgatcactagggtagttcttccttcactccgaaggtgctgaactccaaaccactcacaaaccgacgccgggcctcctccacaatcttctcggagaggtcaccgggcaactcctccacaagccgtctaggaggcggcaacctctaagagtaacaagcaatgacccggcgtggagatgatcaatcaagtgccacactagctctacaaatggaagcaatgcacttgactcttggctaatcaaccctctaacacactagatggatgaacacaaagctcaagtgggtgtgagagaggtgcaagggatgtatgcaattgaattgggtgccaagagagtccccttgctgctggtggggaagtatttatactcccacccaccaaaactagccgttaggggtgaaatcccccaactttgtgctctgccggtctgaccggaggtatgtggccggtcagaccgtgctactgtgcaacggctagaaaactagccgttgaagtgctatcagagggccccatcggcctggctggtcagaccggcgttgagtgggcggtcagaccggcctcggctcggtcagaccgccatcggctcggtctgaccgactacggctccatcggctctgtatcggccacccggagcagcaccatcccggcctccagtgggccggtctgaccgcgcatgtactgccggtcagaccggctttatgcgccggtcagaccgccttcttgcggccgttcagactggccaaggtacgccggtcagaccgccactatgtggccggtctgaccgcccctgttcaggccgagcccagtgaaatcccaagtgattgtgtgtgtgtgatgaaaagcgagcacacgtctaaatgcataatgacctaatgtggcaatttaatcatctctttgctaggtcattacccctcttaatagtacggcgaaactagaaaataaactagcaaatttgatcgccctacacctcgatcaattctaaatttgatcgccctacacctcgatcaattggaaaataaactagcaaattttaatccatcgatagtcatccatgcacacacatgatgtggatctaacttaaaatattatcccaatagcaacggttagtccacaattagcgcttgtcattaattaccaaaattaacaacgggggcctagatgcttcaaagcgtatcgacgaagccctgaagcaggagtgccgtcgatcgagccgatatgccggagggcacgtgttggcttgcatacgacatcatcgtccgcaactgcacctcgagttcctccacgaagggttttctcgttctcggtgaactccggtggagatagatcacctggcgaagtcgatggcgctgctggcagggaaggacttccagtctatggactggcattggccttcctggtagtctctgtaccctgtgacaaatatcttagggaaaagtgtaatatagttttgggtttttacggaattgtaagaagtacttgtgaaatagaaaagaaatctatcttaactaagctctcttactctggatgtagtgtgtaagagtgtcttattacttagcgacttcgatcagtcatttgagtcatacactctccctagccccagccttgtcatcggagaattcttctcggaagataaggctcttggacctttgacctacctcggttgaacaagcactgatcctagccccagccgtgaagttagaaaattgattttcgattacatggcttggttaatacgcacgacgagaactcttacacgaccagatcttacatggtctttcgtctctacaggatccgacaaggccttatcggctttgggcgtccccagccaaagatctcttaggttcctcggaggccttgtcaagacggcgtaaagggacatgaggatagatttcaacgctaggtgtcatctgggtaagggatcatcgggaaggaacactttggttgtaatctgtacctgaaaataggctttattgaagctgtaagatgtcttacaagtatggatactattgacttatacatagaatttacgtaattgatcaatgttccagaaatttgccatctcacgaccatcgccgtctgcaattttgaatgcgcctggccgcaagacatgtgtgatcgtgtacggtccttcccatttgggtgagagcttgtttcgccctgcttggctttgaacccgtcggaggacgtagtcaccgatcaaaagcgtgcgtgctcggatgcgcttctcgtggtaacggcgaagggcctgttggtagctggtttctcggacgacaactcgttcacgatgttcctcgagtagattcacatcgtcgtttcactgctcctcctgattctcatcgaaatacttctgtactcgtgtactttgatgtcgtagctcggtggggagcatggcctctgagctgtacacgaggaagaagggtgtttccttgttagacgttgtcggtgtggtacgcacggcccatagtactgatgggagttcttcgacccacttcttgtcctgtgacatgagcctgtcatagacgcgggtcttcattccttctagtactatgccatttgccctctcgacctatccgttgctctgagggtgagaaaccgaggcaaagcagatcttgactcccagcccgatacaataatcctggaagtcggcgctaatgaactgggagccgttgtcggttatgatgtggtgcggcagtccatatctgcaaaatatccctttgatgaatttgatggcgtcggccttgattttccccgtgggtgtcgcttcgatccacttagtgaatttgtcgatcgccacgaataggaacctgtagccgccctatcctcgtgggaatggtccgagtatgtcgagcccccaggacgagaacggccaagtaagagggatagtctggagtgcttgcgctggtagctttgtgtgtttactgtgaaattgacaggcttcgcaccgctgaaccatgtcgcaagcgtctttgagggcggttggccagaaaaacccttgccgaaaagcttttccaaccaatgtgcgaccggctgcgtgtgacccgcagatcccttcatgtatgtcgaggaggagatgtctatcgtcgtcggacgagacgcatttgagaagtaccccatttggcgctttcttgtatagatcgttgccgatcatacagtagatttttgctttacaggttattttgtcggcttcttcgtcgtcctcgggcaactcttcgctgcatatgaatttcatcagtggggtgcgccagtcatctgtggtctcgatatcggcaacggcgcgctctgcctctgtagcccccaagctgatgtcgggggcgactgggctatcttcgtcgcttgcctctttcactgatggctttgtcaggacgtccagaagagtaccgggttcgagtggctctcgtctggatgcacgccatgctagatcatccggctcgatgttgtccttgcggtatgtcatgaccggaattaatccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgagaaacaacggaagactagggcgacgaccacaggcgcttgacggcaggcacgagctagacaccaacgccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagtcaacccaggccaaccattccacattttagttgttaagcaggttttaagaattaaaacactaacttgggtacattgctcggcttgcccataaccgagggcgcagctattcgaatagattatactctgatcagaggtgtacatctttacccacaagacacatcttcctcatgtgtaaccacgtgccgcataccaccacggtatacggacggaagacgtgacatagtttccaacccatcctagccatagacaagagtaccgacccaaccccacctacggccggaacccccgggacaggtaggcaagactgagccccttgcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccaaccattccatagtgtccaggtgatatgaatatcccaaagtctagagttgtaaaaccacctaatgctgcctaattaagcggcgaaacatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaaccgataatgcaataatttaaatcaacataattttataaactgggattcaatatgttcaaggatgatgtgacttgccttgctcgctttcccaaccgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccatgttatggctatttgaagtttatatgctctttaagtgaatatttgcgaatttcttcatttaaattttaatttaaaaaaaagtttattgcgccagccgaggggagggggcgcgcggaccgggtccacgggagtggggcccacgcggcagcctcacggtccacggtggactgggtgcacccgggctcacaccggccggcgccgtgggccccacgcgtcagccgcacccgagggcgcgggcggctgacagccgggccccacgcggcagccgctcgatgcgcccgaaggcggccacggcggcacggccggcgggaggcggcgcgcccgcgcccctatggtcgccggcggcggccataggcacggcggagcggcggccgagagaagggagggaaagggggaaacgaggcggcggtccacggctcaccctaggtcgacggagacgacgaaaaggcggctggagcggaggaaggcggcggcgcggctcgggtcgacggggacggcggcgctccggcggtcgacgagcgaaacggagggtggacgaggtcggcaaggatgcggcgggaggaaggggatgacgggtgggccccacccatcagcgagggtggcgggcgggcccgcccgtcagtggcgcgcgcgcggggagaggccggatgggccgcggggagaggagagggagggggagggagatgggccgagccagcccaagagggagagggagggaaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttagaggatgtattttagagtcgttttgggacgtgacacggtatacgtgtcggacctcgatcccatcgaaccttttttccagcttcctgacttctgcgagatacttggataactcggggctagagcacttatagtctttgtgcacctggttcgcgactagttcggaatcccctttcacgacgagtgtggctgcagctcttatcccggcgagtagtccttcgtactcggctgtgttattggtcgctttgaagttgaggtgaattgcatgcttgaattgatctcctgaaggtgatgtcaagatgaatcctgcccctgctcccctgtgggtttggaagtagtggcgtagctttcttgatgtcatgattaccgcgtagagcagtttttggatctgtggatatcttgtctttgcgtcgtggagagcttcgctgatgtagtagattggtcgttgtaccttctctctctcgacgacaatgacagtgctaacggaatatggcgtggcgacaatatagagaaataattcttcattaggttggggagcaacaagtatagggggatttgatagttagcacttgagtgcaatgaatgcctcttcggcttcctatgtccatataaatttgttttgtttcttgagtagagcgaagaaaggttgtcctcgctctcccatcctagcgacaaacctacttagtgccgccatgcatccggatagcttctgtacttccttgagtcttgtgggcgacttcatattatcgattgccttgatcttctcgggatttgcttctattcctctgctagagatgagaaaaccgagtagcttgcccgatggtactccgaacgtgcacttctctggattgagcatgaggcgatatcgtcggaggttgtcgaacgtttcccgcagatcgtcaatcaatgagtcgcttgtcttggtcttgacaacaatgtcatcgacgtaggcctcgacattgtttccaagttggtcgctaagtgcgccctggaccgtgcgctggaaagtatttcctgcggttatcagtctgaacggcatcttaacatagtagaataccccgaatggcgtgatgaatgttgttttctcctcgtcctcttttgccatgctgatttggtggtaaccggagtaagcgtcgagaaaactcaacaactcacaaccggctgttgagtccacccgttggtctattcgagaaagagggaagtgatccttgggacacgccttgttgaggtcggtgaaatcgacgcacattctccatttcccgttggccttccgcaccatgactggattggctagccactctggatggagtacctctctgatgaaactagctttgagaagtttgtcgagctcttctcatatgtcttgtttttaatctggtgcaaatctccgtagtttttgttttactggcttggcgtcgggtcgcaccatgagtttgtgctcaatcacctccctgggaacccccggcatgtcggacggctgccaagcgaaaacgccagcattgtcgcggaggaaggtgatgagcgcgagttcctatttctcgcctagtgatgccccgatcttgacggtcctgtcggggttagcactggagagtggaacgatcctgattgcgccgtctggtttcggcgtcttgtttgttttgctcactttcttgagtggctcagctgtggcgggtgggctgggcgtgtgctcgaccatgtcgaggctccgcttgtcgcattgcactgccagcttagcgttcccttgaatagtgattgttccctttggtcccggcatattgagcacttgatacgcgtagtgagatgcggccatgtacttcgcgagtgcagttctcccaatgatggcattgtatgctgtatcgaattcagtgacatgaaaggtgatctgctccgttcggaagttacttgcttggccgaaagtcacaggcaacgtaattttgcccaatggttcggacgatgactggggagtgattccatggaagggttgatcggttggtgtcaattcgcttcgtgggatccccatcgcgtccaatgtgctggcgaagagaaggttgattgagctgccgccgtcgatcagaactcgtgcgaccttgatattccgaatagtaggttcgaccacgatcggatatcgccatgggatgacggcagtcttggggtggtcttcttctgagaattctatcttctgttcagaccacttcatcttgggtgtagccccctgccacgtcgaacagacttcacgtttcactttcttgtattctcgctttgaggagtatgccgtggaacctccaaagatgtgcgagacatggagatcggagtctgggtatgatgagtccgattcctaagtagccgtctcagtgtccttctctaccacacgtactcgcttgcttttttccgatgccatgtgctttccgagcgactttttgaagacgaggcaatcttccagagagtgtctgtccgacttgtgtatagcgcaccatgcttccttcgcgtcactaccttgtaggtctgggcgtttgggagggtccgcgtattctgctgcgagaacttccgcttgagctttctttttcccactcttgtgatttttctttttgcttgactcaggtgcgtccttggctggtttcttctctcctgcggtcttcggcttgtcgttcttgcgtctcagtgcgtcatctgcgtgggcgcatcgatcgacaatctcgaataatctccaagtagttgtgatgcgcctcgttgccaactcctgggtagtatagcgatctctggcaccggacttgaaagcgcggattacagaagcgtcggtgatttcggggattgtatttctgcactcattaaagcgctgaacataatctctcaaggattcacctgggttttgtgtcaacgcatgtaggtcgtctttgatagcgtggcgcttgtaagttccttggaagttgacgacgaactgctgccacaggtctgcccacgaagaaatcgagtagggcgggagatgcatcagccatgaacgtgcagagcctttcaatgcagttggcaaataattcgaaaacgcgttgtcatctactccggtgtgcgattacaagggcgtcggccgggttctcgagaatcctgtcgtcgcctcccgttgttgtcccagcgccgatctccattgtcgtcgtcattatggcggcgtcctcgacctgtatcgcccggcacccgccattcgcgatcgtcgtgatcgtggtagttgtggcggttatcacggtctcggtcttcacttgagcggcctcctcgttcttcgttatcgtgacgtcgtgaagagacgcgatgtcaggaacggttcccgttgtctcgtgtgcgtcgtgcctctcggcggccattcaggtgatcgcggagatcgccggtgccgcgaggtggaggggtggctcgatgaggcgattcccgctgttcagggttttcgccattagcaccaccagttggtggctgttccgggtgcgctgtagcgacggcctcttcaaacgcgttactgaggttggttactgattcctgtagccgttctgtccaccgtgcgagatcgtcgttcagaacgggatcgtagggggcctccctcagtattgcgttgatggccctgatatgctgggccagtgtagtcacttgattttctacttccgcattagcgcgcgctgacgtgctagtcctgtcgatagccaatacctcgcgtggcgtacttgttgatgatgagccatagtcttcgagcaagtgtagaactgacggcttgtgaggatcgatgtcgattaccccaacgaatcgatccgagatcagtgtcgctccttgttccttgtccgcatccctaggagagatacatgactgctggaccttaggaggcgccgtcttcatggcgctgagaaagaccttgcagcttgagaggtcgtgattctttgtcttgtggataggacaatagatatcacgggttggagaagtacgctgaattccacgctctttgcaggcacgaatttcggcatgtacgttgagaaaaacccagcaggcttgcaaggtgtgttttctggttttgtggatagggcaccaggaccttatcacctcggaagttatcctcgtcggctcgtgattcttgttgaagagacaaggtttggccgcattaggatccttctcgggctcggatgtcgtcgacgttccgttctccgcttcggcgggaggatccttcgacatgaagtcgtcctgggttgtagccactgtgttctcgcttccagtcactgatggaccagccgagatcggcaccgtggtgtaaatcgggaagacgatttcgccgacttgagtacacaccagcattgttgaagcaggaactccttggtcgaggttggtgttgacgctgttgtcgacgaagctagatgaaatagtagtagaaccttgagcaccaaggccccctacatggcgcgccactgtcgatgggggataccggatatagtgggtactgtggtacgctggtacgaggatctacgtaatacgacatcaagcagacaaaaagcacagattatactggttcaggccccttgatacgtaatagccctaatccagttgatatgggattatatgatggaaatcacaggttacaaagggaacaatggaactcaatgataccggcgagatcgtaatcgagctggttcgactaaatctcccgacgacttggctcctgtagattccgacttcgtaggctgtggtggatgtgttggctatgagattcgatgccttaggtcctcccagggggtcccttttatatcgcaggtcaggcggtttccaagtagaactcggagacatcggaccttgcacgatacagtgacgacccagtcctgtccgagtaggactccttccatctgtgaactccatgatgaatttccttaatgtatgcagagaacgtctgtatacgcgcaggtataccatatcgatatgtgacgtatatcgaagggtaaagggtataccttacccgtaaccctgacatagatagcatgtaagtatgggaaatgggcgatatggtcattttggaaaaaatctaacgatcaactcacggtcaactaatggaatagagatagaggagatcaaaatgaaaactcaatggcatgtaggaatgggacaaaatttaggggtatagaagaaattgtgaaacttttaaggggtatgttgggaattttctcttacttgaaagggatgtccacaaaaatacacaacatacatattcaaattcaactcatgcaagtagaaaaaaaatttaactttaaaaataacatgtaatttggagtcaaatctatttttttattattttagttatactagttttgttcctatccagcaaaaagtaccgcctagtactagtacctacaacctataggtgccaaaacaaatccgactgttcaattcattgggggtatgatgggaatcgaagttagggtggttgcctcgacgcctttgcccttcctagcgtgcgctgcctcgccctttcgcccttcccaacccgcgccgccgtcacttctctgcttccattccccgtgcgcccttctccccttccatcccctttcgcattcccagcgcacgccacccatccctttgcgccgcttctccccttccatcccctcgtagcgccgcggcagcagggtgcaaaatggtggcgcggcagcgagggaaagagagatgacgagcaagaaaagaagaataggggaacggcggtggaggataaacatagcagcggcgagttcgatccaatcctattctaggatttttttttttggcccacctcaacccctcacccatccattcagcctcatccatccctactaagcgaaattactatcttaccttttcacctctcttcaccgtacggtactagataagggacaaaagtggtacctcgcggtactgtacactggcagccgttggatttggtccgatcaatgatcagtatttggtcccgtctctcagtgctgaacggtaaaaaaaaactctaattatataggtcgtacttaaaacttatatatttgtataataatatattacatattaatctattttatcaatcgtttaaaaattttgtgatgacttttatactacatggacaaacgataggatgtccctcaagtgaaaaaaaaatccatcagctacagtagttatagtaacaaagaagaggataaaagcatgctaccactatacagctagggatgaaaacggagcggatagtttccatccgctccggacaaaaacggatacggatacttttcggatcggataattctcggatagttcggaagacatggtatgtggtgggtcatgctgagatttagtcaactactattaggtatgtggtatccataaccctgacagtagcccccgacttcaatgcaaatgaacaaattcatattctcaaccgcagaccctagagtaactgttgtcgtgctcacgtgactgttcttgatgagttcagagataatgttagacttcctttatcagcctcgtgcgggcacctaaagggtttgtctgagtcaatctccaacgtcaaccaagaaagtacagaatatacgactaagtctcttgtcttgctgtaatcgagaatttggattgaaatcaagaaattttatctcggcgggtacaccctctcttcattccgtattccttgtcgagatccaccaatcgttctcgagtgatcgagaaggcgcagagtctgcgatggagccttgtcaacatttgtcgtactcgccttagtcgatcttggtataaaaccatagagacatggagacttcaacaatgtcgaatagaattttcctgaaattaatactcagaaaagaatattagatagaaatagcccccgagcgaatgctcaaagggtgacatgttataatatgtatggaaaactgaaaatgaattaaatttacagaccaatgttttgtatgtgagcgtcttctctcttaccgacttcgatcagtcagtttgttaagtcatacactctgcctagcccccagccttatcgtcagagaatcgttctcgaaggagaaggcttttggacccttgacctgccttggttgaacaagcactgatcctagcccccagccatgaagttggaaaactcaatttccgattacacggcttggttaatacgcacggcgagaactcttacacgaccagatcttacatggtcttttgtctctacaggctctgacaaggccttatcggctctgggcgtccccagccgaagttcccttaggttactcgaaggccttgtcaagacggcgtaaaggaacagtaggataggttttaacgctaggtgtcgtcgtggtaagggatctctgggtaaaacacttggcgatattatgtacctgatatcagttttgttggagtagaggtagtgggagaatcgctacacctctggtcgaggaccaggtagtagtcgtaacttgaccacttaaagtggaaatagtgggagaatcgctacaccgttggtcgagaaccaggtagtagttgtaactcgaccattagatgtagatgtacgagagatcgctacgattaattggttgagaaccagtgaataggtgtctctcgatcatttcgactcgtggtacgaggaccactatgctgtcggtcgaagatcagtcgtagctgttcctcaaccatctgaagttaaggtgcgagagattgctacgttttactagttcgagaaccagcgagcgagtagaattatctctcgaacaccaatagaagtttgtggtgcgagagattgctacgtactagttcgagaaccagcaagcgagtagaattatctctcgaacaccaatggaagtttgtggtgcgagagattgctacatactggttcgagaaccagcgagcgagtagaattatctctcgaataccaatggaagttacggtgggagggattgctacgactggttcgagaaccagcgaacgagtagaattatctctcgaacaccaatggaagtttgcggtgcgagagattgctacgtactggttcgagaaccagcgagcgagtagaattatctttcgaacaccaatggaagtttgcggtgcgagagattgctacgtactggttcgagaaccagtgagcgattagaattatctctcgtacaccaatggaagtttgcggtgagagagattgctacgtactagttcgagaaccagcgagcgagtagaattatctctcgaacaccaatggaagttgcggtgcgagagattactacgtactggttcgggaaccagtgtctcgcccagaaatttaacccaaatttccagactattttgtgtattaaatccctatccaggaccagccagggtacacaaaacgacaaataataaacagttccaaacataaataaagcgtaaaatacttatagaagaggcacttagtcctcacaccaaaagaaaacagcagcagcggaaaaaggcgatcctagcggggcttcagctccactccataggcaaaactcaactgggttctaagccttggtcttctaactttgtcttcagctcagaagtactacacttctgaaaagggggaataatagcaaggctgactacaaccaccgtactcagcaagccacaccaatgatgcaaacgtgcaaggggatacaagaatggcttgtggctatttgcgtaaaggcagttgtaaaacatttcattgagcaaaatagtaaaacagttgagtaattaaggtaatattaaatctccacatatcaacgctacaccacgttgaacaggcccaaccaacccacttgaactacagtgcattgggtcgatttattaagtgtgagactaatcacggtgaatctggtcgatcgcccataaccgcaggcacggctattcgaatagttttactctggctagaggtgcacaactgtacccacaagacacaatccaccggcatgtcaccatgtcatcatgtgcccatgatgaacatgtcaccacgtcgagtgattgtgacaagacccttcatataaccctcccctaaccatccacaccacgctaaggtttcacccccactcctcgcaaggcagcgggcagtcccctcgtgcgccgtggtgaatccggcagctggacaaccggtctccccggccgacccaactccatcacgcccacccttgccaccggtgcctaggaaagggtcgagctatacttcagattaagcagttacccgctcccgcttgtgttaagcactgtaagtcttccagggtttcccgtgaaccggtccttaattgccatggatgcgaccagcaaaaccatgcacccacagcccaccattcagtcgcattttagttggataattacgaccaatgcaacatggtcaggtgtctcgagcacacagctcgttctgatactaaaaaggtctaatactgcaattatcccatcaactgagctagtggtaattaagcatgactaagcatatagttctagctatgtcacataagtaacatgagctagtcgatctattacccacggttgacaaaggatatatatcaagtaaacatggcacaagcgagcagataggtaatacccagatcccatgtaataagcaaaacaattcatatttatttgcaaacggtaaaacatttgtaaagtaggatcaaaatgctcaaggggaatgtatgacttgccttgcttcttcaagcaatcttccgaactcttatcctcgcgaccgcgaacttccgaaacagcgaattctacacgctggcacgtaaaatgaggaaaagctctcataaacaacaaggaaacagtacataaaaagtaaacaaacatgtagatctcaattttagatgaattttgcaagttgaatggcctaatttggagttcgaatgaattagatatgaattttagaagttttgagccattttaatggatttctggaattattaattatttatcgtgcaattattaaatattttctcaaaggaaaagaccatcgctaacgtcagaaaggagcggccggcgccgacacgtggaccccgcacgtcagcgggcaatggggacgggtgcatggttgactcggtccaccgcggccggggcagcaccgtggacccggaccacgggagtggtccacgggaccgacggcctaggcagcatggctagggcacggcacggctcaaagccggccagccgaacgacggcgatgggcagcgcgcggccactggcggtgtggaatggtggcaagcggccgagaggcggcgggaagggggacaggaaaggaagggggacgggggaggagggatcctcaccggaagcagcagccggcacggaggaagacgatgacggcgacgattcggtggcttccgacgaaggaggaggggaggccgaggggcggctacacctggggaagctattggagggattagggaaaagggagaaggcgtgagcatggccggccgaagaggaaaaagaaagaagggactcaccggcgacggaaaacatgttttggtggggttccggcgatgaaaaaaagcaaccgaggtgctcctcggcgttgcgaagcgagtggcgcaggcggcgcggtgcggcgacggctgaggcgatggaggtgcgcggctggaggcgacaggcggtggtggagctcgggatgtgaggtggaaaggtggttgcggtggggtttgggggcggaggagtggatgccggggtggagctcggtacggcgatgccgatagtggtagtggcacagcacgggcgcagctagagtggcggcggtaggtggctgaacgacgccgacgagcagcggaggttggtggcgcggtggggcggctttccggtggctattggggaaaatggagcggctgcagggttgcggcagagagcggcgaacgcggtagcgcaagcggcgtggcgcggggacgtcaggagcggcagcagcggccgaccgaagagctcccgcgagcggcggcgcacggcctcaaggggaggagggggttccgggcatgggggagcttgggagagagggggaaacggaggaggggagcccggggatcttttttatgggcgcgggggagggagatcatggctgagaggggtggaatcaggcggcaaccgaccggcgacgtgggcgacatcgtgggtgaagtggagctcaaattggcgccaaaaattggggaaaagtgggggaaaatgtgtaggagatggtggggagccgatttcatgtggtttgggtgcgagggcgcgggcgggagaacccggaatcggcggcgacgtgggcggcaacggccgtccatggcagcttctgctctagagactgcaggtagaggaagggcctgacaggtggggttgccgggcccacctgtcgggaacggagaaagggaggagaacccagggggttatttagactttgcgcgaggggaaggaagatgggtcgatggcccaaggaggaaggaaggaagaggggagggaacgggtcgtggggagggaaggagggctttgggccggaagtggcccaaagtgaaggaggggagatttaacttggtttttctatttattttaattgattaaatgaactttgtgacttttaaaattatttctcgagctccgaaaattctcgggaaatttttagaaaatatttagggcacaaagaatattacaaaatattcctggccgatgattttcaagggaaaattttaatcctcccattatttcacttgatgaatttgttttaacttttatttaatttctagaaaatgcattattaaacgatttttaatcccgaacgaaaatcggggcgttacaactagcgagcgagtagaattatctctcgaacaccactggaagtttgcggtgcgagagattgctacgtactggttcgagaaccagcgagcaagtagaattatctctcgaacaccaatggaagtttgcggtgcgagagattgctacgtactggttcgagaacctgcgagcgagtaggattatctctcgaacaccaatggaagtttgcggtgtgagagattgttacgtactggttcaagaaccagcgagcgagtagaattatctctcgaacaccaatggagacgctagagttggtttattacatgtgcatctcatgtggccagcatgactcacatacccaacttatagcatatccggatatctgttcgcaatcatgtcgggcaatcaagccgacgacattcgcgaggaattatccgttaacaaccttttctcgactattccagccatggccggtgctatgagataggtcgttggtcttcgttggcaggttgggtgcgataactccgcatttgtcgagaatgttctcgataatggagtgtactcgatgacaacctactcatgtgctcaattgttcctgaaaaatattttctagaaggcaagacatatagcagagaatatcgagtatgtactcgaataactgtatggatcttctagcattatcaggatataacgagcagattaaatatcaagcattatataaaccgtgaacaagcatgatttatacagaagaaaataaagcgagcccccagtattagaccgcggtggtctaatattgaagacgctcgtataacagagattgtataaaaaacatgctctaggtaaacataataaattatagatctgacaatattatattatctgaaaaataagtacagtacattgcatataaaatattgcgtacctgtgtagatatctacgaaattagtagattaattcaaaaaactaatccactaattacccttttctttttacagtctgagcatcaagatcaacaagtagacaagaagccacgtgcatgtaactccttcacgtgccctggtcacgtatacgagtgtatatcctggtttttaccaacaagtgccgtgtacagacatctgttggctaccagtccgactcggtgactcatggacaggatctggacgcacacgcacagtgatatgcatgataatcgatcgatgtcgacttctgtcttccgcgtgctgatgtcctcctgatctctggcagctacatgcaagatggcgggtggctggcgcgccgtcctcctgctgtatatgtctgcatctctcgaaaaccaacgtagggccgaccagtcagggcgtcgcgaggagcactttcccttgtagtcgacgagaagatggttcggagatctcgtcgagtaatatgttgtcggagaatccatctcttgaacccatctcgtcgaaatcctgaagcaccaaaacccccctacctggcgcgccactgtcgacgtttgatgtcgcgattccggtatttgcatagtatggggattgttggtactaggatatatgcgagactgaggtaaaatagatggagacaggatttttatataggttcgagcccttgaattgtcaggtaataaccctacatcctgttggccggagccggtcgttgctctttattcaccataatcataccagtacaatatttggggtagcctatctaactgttgtcgacatggcggtctgaagctctgactcgaagtcgacaacagagtagtcttcctcctcgaatccgtgcccggcaagatcagagatagcgctttcatctctcctgacagtatccggagacaccgtaggagactagctgtgcttatccctgaagtcgatatctggcatcttgtcttggcgtatgttgacttgtatattgatcttgtggtttgatctattgttccgtgtatgttgattgtggtggtcgtgtcccctcttctcctagagggccttgtatttatacccataggtgtcccatttccaagtagaactagggaaaccaaaatggatacaatccgagtagtccttgtcgtttccatgtagaactctggttgtctttccttatccaaaactgcctccatatctgaagtcagtttccgtataagacatggtgtgtggtgggtcctgccgagatttagtcaactactattaggtatatggtatccataaccctgacatcttggtaatcctgttagagacttagaccagagaaaaaaagaggaatctggaggtcaccgtcggaaaacgctgcgaacaacaggggcggcagatggggtgggagctgcctagatctgcgccgacggcaacggccgaagaagaagaggagaaaacgacggttagggagagagccatcctccattcgcgtgatggtgacggccaggtagggagccgcctcaatagggctgctacggtggccgaagaaggagagaatacgatggcagctaggaagggagtcaccttgatctgggccacgcgatggtcgacgaaggagaggaggcgatggagtcgcctcaatttgcgccgcctggatcccgccgtgatggtcgggaaggagcctcgatccgctccgatctcgtcaccctcggcctatgagcttgtcgaccgatagtggtccgttttgcgggaagagcgaagggagaggcggcaccactggtggaaaaaatgaagagggagagaggcggagaagagcaccaacagtgggggattccgtgaggagagcgagcaaggatgggtaaggacaatgaaagtgagaggctcacagtagaactaccaggagtatagggtttatatgtgtttttttattgttatagggtgtgaagtataaaagttttagttatctgaaaataaaaaaattagcagaggctgacatgtaagactgtaggagctaaaataaaaaaccactttacaatagtttccattgtaggggagaattttcactatatgccactcaattcgcagcactatcagattttgccactcagttcgtcacactttcagaatataccatggaggatgcaaattgtttcattccgtaccactccgtccatccaatgtggcatccgtcaatcggtccatgcaagcgccatcgttcgtccatcgggcggggagcagcttgtcggtcctccccgcgtgcgccgccagccgctgagttccttcctgcacgcggcgtcggctgccgtcgaagtggacaaagaaggagtcggatttcccgcgctgccgacgagggcattcatctcctccggcgcgcactcgccgctccggccgcgcagcacgcacccaacggccccatccctgtgtcactagcaccctcctcgtccccatatcgcgtcgcctctgaccatggtcacgagcaagaacaacatgctcacaagcaagaacaccccatgaacgctatgaagtaatgtgtgcatgctcgctgataatgtccaggatgttgaggccatgcattggagaagcgaccgacgcggctggacgactggacctcgtcggccagcacgctgcgtgtgaggggaccccgccggccaatgccgtgcgcgaggagtaactcgtcgatggcggccgaacatcccaatgagcccatcgggagtacctcggtagctggcggttctcgatggcgaccggatgcgtacgctgggcaagacatcgactgctgatggcttacgcgaggaggagctcgccgacggcggccacccatggaggacctcggcggccggctgcgctcgacggcagccagatacgcgtgtgtacgtccttgctggccggcggagcgctgggaggacctcgtcggccgatgggacgagcgagctgctccccgcccgatggacgaacgacagcgcttgcacggaccaattgacgggtgcggcatcggatggacggagtgtcacggaataaaacaattcgcgtctctggtggtatgttctgaaggtgttacgaattaagtggcaacagctgaaagtgctgcgaataggatgacatatactgaaaattctactacgggtggtgtacgagtcgtggaatatagaatatgccagtatgtacggtaaagctccatatacgataagaaaatcggcatgaggttatggaaataattcttatgggcaagtacatagtagagtactactcgaaaaggattgagactagatataccatatcgtgcaacattcacatggatgatagaacgctttcagaagcataagaacttaacatttgccttctgcatcactacgttcagtcaaaaatttatgaacattgctgcgtatttcatggaagcttagcaagtaggtagtgattcgattttggcacaataaacaacctttttgttcctacgctaatgcaaatgcaagaacaaacagcacctttgtccgacccgtcctcctgctccaggcgccagagcacgaggcggccgtgggcgtcggcctgctcgagaagaggcaccaccatgtcgaacaacccggcggtctctacgatgtggagcacccggagcctccgggacgcgtcctcctcattggcgtcgagggagaagagcgccatggtgcccgcgcggtcctgccgctcctcaccctgctcctgcagcgtacgtgtaggtggtggcggcgaggacgtggcggaaggggtggtgcgggcagatccaccgcgtcagcattgccgcccaagtagcacgaccccaaatccatccctccaacgacccctcgccttcccgcacgacgcatctctcggtggcgatagcgccaggagggcatcgtcattgggagaagccattgttgcctgcctcggcgagaaggagaggagagacgcggggagaagcacgcgagggaagattgggagctcgctctccctcaaatccaccgagcgaagaaaacggggaagagaactccaaaacattccaccgagcaaataaaacaagaaagggaactctaaaacttttgtggatatgttggatccgaatttttcaaaaaaaaaatccctcaaatttaattttgggaagaaagtaggatcattggtgatgctcttagtgagatggcaaagaatacacttttcacatgccatacagcaagcatataggttgcttcatgtgagtgatggagggtttgaaaatgttgtgtgcgcaaagagtgactaaaataattactatcgtgatctaatggaaaaataaataaataatgcagatgctcaaatgtttgtggcccaactacgtagaaagaaggagatcaattcatctttcttccaagattttgaagtggacgaaaatggtaggttggtccgtgtgttttgggcagattccataagtagaaagaattatagtcactttggtgatattgtatccttcgattctacatacaccactgttgatgaaaaaacatacactggcctaggagatctgcttagcttcaatgcaggtccaaatcttggtgaggtgcgggtgtgccagtcagtttgatcctgcaactgacaagatatgtaaatagtagatcaaatagacgatcggctgacaagccaatgaagtaattccagccgatagcaatagggtttcgagcaatcggctataattcggatgtggagtctgacactatatgtaaataatgatataaaaacaatcggctgatgatgataaataataatatgatccagtagaaaccaatcggctaacaatgatatgatagataagcatcgatctgaaggttaaagcatatatcgactgaagtttcgatgtcataaaatccacaagattagacaaacagtaaaatctttgttgtgatcggctaaatccaatatgtatgcaatccttgtaagccgatgcaacatctagataactcatcagctgaagccccgatgaaatccttattggcaatcaagaagcaggctagagaatatggttctaaacacaacttagtagatcaaacttaactgatgcagcactaagtataaaaagaaatataatatctagacaatcaagccctggactgatttttagggtggtagatgccttagctaatctaatatagtaaaacaatttagccgataccgacaaaaaccctaaagcgaaaggcaaccgatagagctaaattgagatactaagacaagattaactaagacacatgataaataggaaggcaaatatattaatcaaactggagcaatccaagaggtcaaatgtactgatgcagccttgagcaacaccgacgtagacgatacaattgcccgagccggcgaaacattggacttaccccttcgccggagatcggaaagcgatgcagccccgcgtcaggtgccaaatcccgctggacgatgaaataaagtagaaaaggtaaaaggtggcgatgcactgaaatgtattgatcatggagatagattacaacgaccccgggtgtacatatttatacccatgggtagatactatttcttataggacaagaaagaaactttcctaaagataaaaagaaaacataaagtccttatgggacactaaacacactttcctaaaggtaaaaggaaactaacaaatactggctaattaatagataaactgccatgccgcatactccttgaacacggtcacttctagataagcttcctttaacagattaatttccttaacggaatatagcaggaatccgactattggagacgtgataattttcttaggggcttaccaaatttcattgttaacaaccactaaccaatacgacataatttttgctccatttattggagttaatcgtcatatgcaaagtgtgttctatggtgttacgtaatgagaagatcgagtcttacatttggttgtttaagacctttctaagagcaatgggagagaaatcacctagacttatcctaaacaataaagatgctagcatgaaaactgctactattcaagtcattcggaacacggttcataggttgtgcatgtgacatatcatggaaaagatgccgaacaagattggatcgcggtggagagagaattgtaatttaagagaaagtatgagtcatgtatttagcaatcagaaacacctgaggagtttgaatcacaatggcattctgtaattttcaaattcaacttggaggacaatgagtagttgtcaaataggtgcgatattcgtgtatcatggatactggcctacttcatggacatatctctggcaggtattcttagaaccacttcaagatcaaaaagcaaatttattttttaaccgtttcattcatcgtaagcttgttttcgttgagttttggcttagatttgtcacatcattggaatgccaacgtcatgaagacttaaaggcagacaacacaagcattcatacaacatacaaatctgtaacaccttgctagaagagtttttacacatgaggtttttgagaaagtccaagaagagtttgtagcaactagagacctttgttgtgttaaagacatgacacaaaatgatcgaataaaaattgtgaccttcagcgaggtgaaaatcatattattcaagtcatgagaggtgaaaatcaaaatgagctaccaaatgcatacattgtgaagagatgagagaaaagagtgaaaaggtaaatataagcataatattcaatgttctattttttaaaacaattccaattgtttgaccaccatgttattatagagggagtgtttatgatgaccaaggtaaccttctataagaaaaaactattgactccatagatatggcaatgagagtcagctgcacacgcaacaagtttgaagatctcattcaaaaggccaagcactcagtagaaggcattgactacttaacaacaagtgtgttcgaccttgaggcacctttggaccaaatggtcgctggtggcaaacaaactagttagcaagagtttgagtcttttctaggttgtaacatccaccaactgattgatattcatccaccaactgattactgatattcattaaggggaacaagtaagagaataagaagaagcaaggaaaataataatcagagaggtactacaagtaagaagcaaggtgacaaggaactaacaccatgcgtgtgcaagattttcaagaaaatggtgttttatgatagccacaactgtccaagtaaatcagaactaggtattgatactattaacttctctctatttttttctctaagagaatgacatgacttgcaaaattatttgggtaataatcttttcaggggtaacagaaaaagcacaatgagagatggttgcagcgggatatggaaactactgaaaaagaatgtagacgctaccagtagcactttagttgattagcgctaatgtgcttgccttgtttttattcctgacgtgctccagcctgtagaacatgtatgttattggtgatagttagtgctgattctattttagtgctgccttgggagagctagatgtgactcaactcatgtttaatgagcttgtatgcatgtaggggtatactagcacaatgtgacctctcaatagccaaaacattaacaatttgtatccaatgactctaaacctccaacgtcaattaaacagaaaccggaatgagcacatgtatctcatacttttattcgattagaatatgttcaaactttattgctatataaattaaaagtgtgttttatgtatacactgttgttctctctatatgtgatttttattatatttgtatattaatttgtttcttattcaggagctcaaggtttatcgtgaagtaccatactctttggcgcaccagaacgagacaattaatgagctgaacctagtggtcttgtccgagatcaatgccactgcttgtctatgctaagatgtcctacacaagctcttaatagtttggaggttgcaatctcgatagcccagaagaatgtcaagcttcctgggggagactcttacctatgccacagttctttaacaaatacccagctcagccaaacgagagagatcaaatttttaccatggattctaagttatgtgaataaatgtactaggtcagaattgttctcgtcggaagtagaacagctcactaccaggaccagcttacactcaccacttgcactcctagtggccttaacccctccttccttctgctaatcggcaattgcaatatgcatttccacaagtattcattctggcagttcagttatggccaaaaatctaagaatcccaagtttttattgtacaaatacgctcgtatgaatcataaggtgaatgaaactgaagtgcgtgatgactaaacaacaaactactgaagttgcagaccaactagtgcatgacatacacaattttaaagaacttcatgaacaaaaaagcctgacacgatgcgttgagacttatttgtttacgataaatcttcgtcatcaaaatgaggctcatacttgtccaacagaataaaaaaattaactagggtcagtagctatgattacaaccatgacttatctaaccagcactaactggttccaggcataagagcaactacttaacttcagcgacatagtgctaaacaaaaggagactacagggacacaagcaacaccaacagactaaaaagtaaagactattaggtagcaacatcattctctaaaagagtcaactaaatacctaattcaaatgcaccatatgatgatctaataaagaataaaagtgaaagaaattgttacatagtatacatatagtttatttaattgataaacaacagaatattggttttcctaacaatgatctaactataatgacgaccaccaagaaatgaaattgtaagtgaagaagcaaaacaattgttagtgttgttgaaacgacaatagcttcacgtcgaaggacgtgattctctcagtgggatgattgaacagtagaaacaatgttttaattgatgaatttttttggatctccccattacatggccctagggggctatttatagtcttagtataggctcattccttctaaggtttagtatgtaaaggggaatttacatggatacccttatgatatagacattagtgagggcatgcagtgtccattctagctatgggccctcaggtgggctccttgggccagcccacaggtggcgaacggccttcctaggtcgcaacgctccttaagccctttgtcaaaggtatcttaccttcgggcaaactccttctgcttcgtctcgtggctttgcccgaagtggagacatggcgacggggtcgcggacttggtggcgaatcctatggccttcgtcctttggcttcatccccactggttcgccttatggcttcgcctccaggcgaaaacctctaacttagtcgtcgtcttgtagatccgatggtttcggcaggtccagtcgaaggccctcgtgacatgcctccaacagtttgtaactataaatgaccacaaaattgaatttcttaccaatcatgaaaaactagctaataaacaatgtcacaactatcatgaatgatgcatctaacatgtacctatgttctggcttgcaccagctagaagattcaatcctcgaacttgtatacacaggagttgcatgaaaatatgggaattatgggcctgttcagattatagccaaaataaaccttaccaagttttggcaatgccaaaattttggcaagacggcaatattgccaaaattttggcaagatttcttatgtattgaccaaatttggcaacaaactaaacgtagacatttttttggtaactttgccaaaaaaatggtatggttgaaaatcgcatcaaagtgaacagcccctataatacaaaaatgtcaaaataggtgtaaaacatgacaaaaaaaagagtgacttttcatactgctaaaagcaccagagcaggaataatattattaaaaactcaatttcgaacaaaacgccaccaagtcgactccagtcagtatttgttcagtcaatctatgcaagaaaatgaccagtcccatacatttcggttggtaaagcaacaaaccaatggtcaatacataaattcgttctagaatgcaagctatcagttctgatatgattgaaggagcaacctgaacttgccatatatatgtctaaaattcaatactaaagccactggaattgaaaccatttgatgcactgatgagggagttaggtcccgatcttccaacaggtattaataaatagtcaatttgggcgaagttgcgacacaactcgatccagtttccgaacgaacacgctactgagccccgcaattgcagcaccacatgtcctctggttatcaaccgtgccgaaacccggttgacctcgccgagaaggctaatccctgcatgcgaatcgaagaatacaagcaagaacaagatagattgcaacacaattgcatatgaatgattaagcgctcgaatttggggttctacaaaccaatctagcggcgaactgttcttgacagattaatctaagcaaaacccaactttaaacgataacggctactgaataaatatgattagggatgtcctagggtttccctagggcgcacacccccttaggctaagcccacaacacaatttaaagccccaaaacccaaattagattcggactggatgagatacatggcttgttttgcagatttccggcagcttggcaggaattttgatgtgggaccaaaaccatctaaaagtagactccataagcttttcaacaagtactcatgggcccctaaattccttctagatcagcagctaggtctgtttgaagttgatgctatcaggaggccaaatccgaatccaaaacgcgcacaactttatctcttgtcttctatggaccaaaagtggtgtggtgatatgaaagaagacatggaggtcttggtttggtccccaaacaacttcttcaatcatccatgtatttcgtacgctcggtctcttttctttcacccaagcaagtacctctgcaaacgaaaaaacacaaaactcattatgtagcaacgtttgtttaaatatataacaagtaaatctaatgtagaacatatgcacctttggttgattaataaataagatagtcatggttatatccgagctagttgtgtccttatcatgcacatgcacttcaggaacaaataaatgaaaaaactaatagtatactcaacagttctaatcccagtgggcaaatatatgaaaatagaacaaaggaatttaacatagcagaatctaaaagcagggtcagtcacatatgaataataacagacatgaaattcaaagaggcatttttcatcatcattatgggactaagcagggcaaaagaataaaggaacaaccgacacacaaggacatcacacggcatccttaaaatagacagctctagaacatgacattaacatagaacattcaccagagaataaatctgcacatatttaacaatgagagagttactacccaaacggaattcattcatagcatataacatgtgtcccacatagcctccacattgtaccacattaacagataaggattagtagatagtcattaaaatggagatataacgaatagagacaaacataggtggtgtaactgcaagatagtaggtcacagagaggtataagataagctagaaacatagtttgctgatggacacagtaactgacagctaatacatattgatcgatcgatagataaatagatagataggggctaggctaggtgaatcatccatccacctaaggtcagtcagtcttgtccaccatgagacttgaggctgtgatcgtagcgaacccatacagttggggccattgaagtcatcccagtctgcagtctcgatgccgctccagtcgatcttggcccaaacttccttgaactgagcctcaagctccgcctgaatagtgaagtaggtctcgtcaaccatgtaactcaacttcgcggcggacctcatcctgtaattcctcgaggctgtcgtccgactcccggtcctcaggatgtaatcaaggtacccctctcaccgactccatatccatctgctgcttcggcggtcgtcttctctccttcgtcgaaagttgacgctcccatcggcaccacagagacgtccgaggcggccgcaatactgcttctcacacacttcttgatgattatcaagtgggacgctagctgctgacgttcaacgtcgtcatctccacctgtttcttgctccctcacttctatccctcctatagatttatatataggctgccactgtgttcagatagggatcgctgatcggagtcggagtcggcttcgactctgactcgagattcgggacaggatgcacggaaatcttttttaactctagaacacaaagaacacaaagacgtatttgtccttctaagttgactctagagtacaaatatgtatttacccttctaagttgttagacatacaagtgcatcaattggttataatatggcaattatttgaagttggttgatatgcacatgtatatatagctaaaagaatttgtttgaggaacatatatgtgtgatgatggtggttaaaaatcatgcgactgactaagaattcataccttcaatagctagattaatattgaaatgctatgcatacatgtacatgtcaatcaacttcaaataactgccatattacaaccaattggtacaattacatatctaacaagttagaagggcaaatacggtctttatactctagagttaacagtcaatgcatggccaacatacgggagtggcatgagagtttacgcgaatttgagctagtggcatataagtaattctctctgcataaatatgtgaacatggaaaatgcaataatacaataacaaatgattaaaactagataaaattaacacatttaacaggattaggcgtttggatgacgcacagaaaatgcccctgctgcttcacatcacacgcttctttctcttctctgctcagacatgaccattgtgaaggcaatggaataaaaccaggagaggtacagataacactatggatttttgtccggatgaatggaataatgcaacagaatgaaaggagattgaatagcacaagcaacaactgcgaacattttactttcacccgactgctcgcacgaaggccgcctggaagaaatgcagggatccaccatcaaggaaagcactggactcagcaccaggcgtctgtccacacaaaatcatagcaggcacataaaaaatagcaccattaacttttcagcacaaagaaagaaagtataccttatatgttagagcaatttacggtccttgagcaggtaacaataatttagtgtaaatttggtaccttatagtaactcatactacctaagtactaagaagtactaaatttacagtaaaacaagtgataccttatggtaccttcttaaggaccgtaaaattgctctatatggtatgtttgttggcttcaaccattttaggccattcacaatgcgtcacacaaatctgaggagcctcgaatggcacataggctagagcataggctagagctacaggtccaacatttgggttctatagtgcaagtgactttagtttgtatttcagcccctaacactttttgtttcagttctctttttttaatttatatgtaggtccaaaatttacaattaacaccctcaaatctagaaaaattatttaaaccccctctcccctctctctcccttatcttttaccccttatattgttccttcctcatctagctcgttgtagcgcacctcccctccatctccagctgccttgcgcctctccctcctcctcgggcacctccctccccccccttccgg

SEQ ID NO: 61301 - DNA, 2124 bp, Oryza sativa
agtatgaattagggtagatgcttcgctgattaatagaacaacattaggtggtttaataactttagactttgggaattctcatatcatttggacattatggaattgttggattatggtggaattggacatacccctctcttcctctctcaaaacccctaaaacctgttttccggtggggtttgggtgcatgccagttgtgggaagtagcaccccggccaatataaggattaagctcgggcctctgttgcaaagcactaccgtacttccacatgtctagtggataaggcttagtttgtggctcagtctggttataaacagaagtacacggatggagatggacgaagtcgggggtcgatggacatctctaggacaaatgaaggctacacgagctgcggcccggtagtcgagatgtcatggcacagggctggtgtcctgctgctgggggctcattcctgcctacctgtcccggaggttccggccgtaggtggggttgggtcggtactcttgtttatggctaagatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttaattcttaaaatttgcttaacaactaaaatgtggaatggttggcctgggttggcttgggacgagctgggacctagggtcgggttgccagttcggtctgaatcatcgtaggccttgggttaaggcaggttcgtgtgggttcacggccttgtttaataatatggtatagcgctaggaccgtatttacaaaatagctttgagcaactaagtgtcttttaatgctgtttactgcaaaccctaaccctttatattataacccccttgtactcccttgcatttattctgcacttgtgggtgtgtcttgttgagtatggtggttgtactcagtcttgctcaattttttcccaaacccagaagaggagttcctggaagatgaaggctttggtgtctagctcgtgcctgccgtcaagtgcctgtggtagctcgtgcctgccgtcaagtgcctgtggtcgtcgccctagtcttccgctgtttcccgtttgtctttgtgtgtgctgggccttcgccgcccatgtaataaattaactatttacgcttccgcttgttaaactctgagctatatcaacttttggtgttccttgcctcctgggacaaggaataatgcacgcacgtaaggaacgcccgttgggttatttccggtcgtgacaagttggtatcagagcccccccttgaccctaggacgagccgtagatcccaagccttagcaatattttcaaaataaaaatcctttcttatttgtgaaaatcctctagtctctctctgtcctgcttcatttatcgtcaaaatctgacctttaaaatgttgcttttctcttttgtttttgtttgtagatggccggcagcatcaaccgtcgtggtctggacctgactggcttcgttttggagctgcggggcatccgcatggagtggattactgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaaggtagagcaagaatgagtacaaccacagtactcagcaagtcacaccggcagatgcatgattaatgtaagggggtacaaggggataataatataggggttaagttttgcagtaaacagcatttaaaagtcacttagttgcccaaagccatttataaagacgatcctagagctacacagtattattaaacaaggccgtgaaccctcacgaacctgccttaacccaaggcct

SEQ ID NO: 61302 - DNA, 562 bp, Oryza sativa
tgggtgcaggttcaggctcgtttgaccctctactgctcgccgccgtcctcggactttgccggctggtggctcgctgcccggcaaactgttgcgaagatcgatcgcaagacgtttgacgccggggtcatcctcgttacatggttgatttggaaagagcgcaacgcacgggttttcgagggaacggcctcgtcggtcacgcagttgtgtgcgaccatgtgtgatgaatgggaaacttggaaatcagcagggctagttacctcgttgaatgttgctgcagtgccagctttagaaagattacagattttgtaatttgctttttgttgtaaaggcggtgctctgacgtactgcatttgtacagtttttccccttttccttaatatacatcggtcagcattcttcgccgtcccggcgaaaaaaaagattgaagattaattgtcccagaaacaattgaacacagctttattaatcattccttccaaatgcatcaatctgtttttgacttattaaaatcattatacaaatatatatatatatatatatatatatatatatatatatatat

SEQ ID NO: 61303 - DNA, 514 bp, Oryza sativa
tttgtgggaacacggtatgtgataatggcaggagagccctgaaacttgccctgcactttggtctccaagatgaagttgtgggaagcagtagcaccactgaaagcacaagaggtaaaaaggattgtcaaagggcaaatattggtgtgagaaagcataagtaactagtaagtgttgttactaacggatcaagtttttccacaatctttgatgtggttccagagataagttgaaaagcctcctgtggccaagagtcgtcgttcaagctaacatcataggcggtcctgtaaaaaatgagagagagagagagagagagtagtaaacaacatgatagaagaatagaagatgaatggttgatggcactggcagtgaagaatatagggcctgtttagatcccaccctaaaattttacaccctatcacatcgaacgtttgaacacctgtatgaagtattaaatataggctaaaaaaataaccaattgcacagattgcgactactttgcgagacgaaatctttt

SEQ ID NO: 61304 - DNA, 7045 bp, Oryza sativa
cacttgtcggcaaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctatcgggtggatggtcttcctcgcaatgaacgcatgtagtggcacacgagctggcaacatgaccgatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgtttggtcattcctggtggaggccattctgtgctggtaatgatcatcttacggacttcatcttcggttcgcattggtgtttttcttttctgctagggacagttccttgcatagtgcccttgctcatcacacataaaacaaatgatacttgcttcttttgagtcaacatgtggcacgccaccatgggtcttttgggatgctggcggcatgctgacttgtggtgtgagtgattggactgcctccaactgcacttgaggttgtatctgactcaggttcagaattggcgtctgatgctgctgtagtatctctataagcaatcggttctggttaattaggtgttggaccagtgtcacacaactgttgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttcggtgacgggttctcaagatcttcactcctgcttcacagctggcttcactgcttccttcgcttcgctagcggatcctgcagtcttccggagcttcggcaaacaactgacgacatcttcttcttcgcaaaactgaccatctagtactagttgaaattcgaagaaggaagaagggagtaaaccttttgcaaatagcattaggggaaggagaaaaaaggaactttcgcaaatagttttatttataaaacatgtccttaggtttatccacttggcttatcctacagtcgagatggctctgataccagcttgtcgcgaccgagaaaattgcattttcccgaacgctagtgtattaatccccgtcccaggaaaagccgggatacaccatacaaacatgatataaaagacacatctttattatatcgataatatttacattattacaaaggcacttaaggcctgacaatcaaaaataaacagcagcggactagtgggcctacggctccatcttcacaggcgctcagctggggtataagccaggactccacctaagacttcttctccaaagcttctcttactgaaggggggagaaaggtagagcaagaatgagtacaaccacagtactcagcaagtcacaccggcagatgcatgattaatgtaagggggtacaaggggataataatataggggttaagttttgcagtaaacagcatttaaaagtcacttagttgcccaaagccatttataaagacgatcctagagctacacagtattattaaacaaggccgtgaaccctcacgaacctgccttaacccaaggcctacgatgattcagaccgaaatggcaacccgaccctgggtcccagctcgtcccaagccaacccaggccaaccattccacattttagttgttaagcaaattttaagaattaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccggaaaacaggttttaggggttttgaaagaggaagagaggggtatgtccaattccaccataatccaacaattccataatgtccaaatgatatgagaattcccaaagtctaaagttataaaaccacctaatgttgtcctattaatcagcgaagcatctaccctaattcatactagtggaaccatgaatagagtacccactagttggggttttattttcctagggtgaacaaggtaataataacaatagcaataataatgtcttaacaaaggtaaataggcatggctaaataaaacagtgataacgcgggaaattaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacgatccacggtggaccgggtgcacgcggcttgcgccggccggcgccgtgggtcccacgcgtcagccgcacccgagggcgcgggcggctgacggccgggccccacatggcagccacggggcgcgcccgaaggcggcctcgccggcacggccgacgggaggcggcgcaccgagagaggggagggaagggggaagtgaaacggcggtccacggctcaccccgggtcgacggcgacgacgggaacggcgaccggagcggaaaaaggcggcggcgcggctcgggtcgacgaggacggcggcgttccggcggtcggcgaccgaaacggaggggtggacgaggtcggcgaggacgcggcgaagccgaaggaggcggcgccgaagcgggagaaggtccggggcgacggcggcggcggaccggagctcggcggcgacggcggagagagagagcgacggcgcgagctcgattccggcggagagagagggcggcgagcggcggaaacggtggagtgaggcacggggagcgtttatatagtgttgggagtgagagagggcgaccggaggggaaggaaaccggcgcggcgatctcgggctgcatcaatggcgccggcgaggtttgcgggagtatttccaaacgaatccgaggaagagagagagggaaaagtggggggaaagggagagggaatcacggggagtgatttccccctctttattgcgcgcgggggcggcgggatgcggcggaatccgcggcggcggcggcgctggggcacgggcgaggcggcgggtgcggcgcgaggtaggggatgacgggtgggccccacccgtcagcgagggtggcgggcgggcccgcccgtcagcggcgcgcgcgcgggggaaggccggatgggccgcgggggagaggagagagagggagggagctgggccgagccggcccaagaggagaaggggggaaaaaggacttttagggtttttctttttataaaacctttttaactttgtttatttcttaacaattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagaaaatgatttttatttcgggatgaatttatcaggacgtgacaaatccaccccccttacaagaatctcgtccccgagattcgaggaggctagcaagaagataggttgggcggtcttttcttcttgcctgacttcttccgctccgtcttctataacaaacttgcctagcacaacttctccactctggactgcttcgctcgatctcctgttgcagatggaatcttcttttcacctgacttgaaccagggtgcaccttttagctgacgctgactcggttgcggtagtttaatgatgcttccgttccagaacttctcacgattcatatcttcggcgtcaacctcacacaagttatcaacttcgtgtcatgtgtcgtaacctgcttgtctttactaggataccatgcttgtcatcatgagaataccatgctttgcgtttccttccagcttaccaccatatgctttaaactatgatatcccgcttactaaggataccatgattgacaacttgccattaactgtctcatattagctttcctggtctccggcgctaggtacttctgctattcgctgcaagggtcaaccattctaactatacattatgcttcccaagagaaccaacttatcccacttgacatgctttgacgtcttcccgaatgactttgctgctggacttgttattgtctgatcgtgatcctgccagatttgaagcttcgttgttagatgtgattttgatctgacctctatagattatcttcaaacatatcacttgttccataactgggaatagctctcacggacaagcaactcggattcactttctttacatttggttcacttcccactattctcttcatgttgtcctcagttagcattcaacgtattcctttacacctttgaccttgatgtgttctttcccgatttctcttatcaatcacctttcgacctacttctttgcctggtaataaacatctttttcgatatcttctatcaatcaccttttgacctttgtcaactaagtactcttcactccgagagttgtggatgcttctggtgacgatgtggtacttgagcctgctgcctttcagagaaaccttcaagtggttcgtcaaaagctagactggcggttgttgcctttgatccaaagaggacacatctgaaactctcagtccaaacaaaagtctctttgactttttaatccaacacagtttaattggttttcttttccatcaacaggttggttattaactcgagattagtatatgattcctctgaaatgagaccctaggtctcctttatcagtgagcaattatacacataatcacatatccgcatcttccaaaagaatcctagtagaacttgtctgtattacacatttctcccttattacatgaatactaagcactgcctaaaaggaaaggtgcttgacattggtacattgtttctgctatgggttctgattaacacgaggcctcacgggtacggcgcttgctccagtgaccacaatatgattgggaggtctgcttcgtgtaaattggcagtaatgtggaggtcgactttgccttggttgcaggcagtccctcgagtaatgccctggttctttgcaattgtagcaaatcaacgtcttctttgctgagctatccgtctggggacgatcattctgacttggagttggaattggtggctggaaatccttgctaacattggcatcagtggtaccatagttgctatcaccatcggagtctttctcagagtcacaattgctagggttgtcattttgggtgccatcattgatactatcgtcgacatcttagtgaatgatgttgacattgcacgcttgattcgagtggtcactaatggggcaagaagcatggttgttggtggtatcatcatcatcattagtattgctaatgttgttgtctgcattgtgtccatcttcttggggcggaaactcttgatgcgcaacagaagatccggtgatctgaagtggctcagtgcgctgtctttggttaccacatggaaatactgggattctgacaatccttctcttacagttcttcatccgattatgctcactttcgagttgtatggctttgtccacaagtttctcaaaatcttcataatcctctaggagtagttgcactgcaagctcatcttttaacccctggagaaacttctcttgtgtgtcttcatccgtctccacatcttctggtgcatagtgagccaaacgatagaactcgtgcaggtactctgtgacggtcaaatctccttgcttcaggtagcgaaactctcgttttctcagtgtgatcattcctgcgggaacatgtgatctcttgaatacagatgaaaactcgtcccaggtgatggtatgtccttctggccgtgatgcttcatagctatcccaccactctgaagccggcccaaccagctgaggagttgcgaagccaacccgctcctg

SEQ ID NO: 61305 - DNA, 4562 bp, Oryza sativa
agaccggtccttatacggccgaggtgctactatcaaaaccatgcaccccgagtccagcctaaaaccattttgaggattttgaatagagggggaggtgtgaatccaattccacaataatccatccattccatagtgtccaggtgatgagaatatcccaaagtctagagttgtaaaaccacctaatgttgcctaattaaccagcgaagcacctacctaaaatcatactagtggtaccatgagaagagtgtccactagttggggttctgtttattatagggtgaacaaggaaataataacaataacaataataaggtcataacaaaggtaaataggcatggctagataaaacagtgataacgcgggaatttaaataaagcgataatgcaataatttaaatcaacataattttataaactaggattcaatatgttcaaggatggtgtgacttgccttactcgctttcccaaacatcggcttcaacctccacgaagagcggatcttctgaagctgcagcgtctacacaaccaacggaaaagaaatgggcttttactctaataaactccatataacaagtaggaacaaagcacaaaaatgggttcttgacttcttaaggaaaaattagagacttgaacggtccaattccgagttcaaatggccaagttatggccatttgaagtttatatgctctttaaatgaatatttacgaatttcttcatttaaattctaatttaaaaaaaaatggatttattgcgtcagccggggagagggcgcgcggaccgggtccacgggagtgggacccacgcggcagtctcacggtccacggtggaccgggtgcacccggctcacaccggccggcgccgtgggccccacgcgtcagccgcacctgacggcgcgggcggctgacggccgggccccacgcggcagccgctaggcgtgcccggaggcggccacaccggtgcggccggcgggaggcggcacgcccgcgcccctatggtcgccggcggcggccataggaacggcggagcggcgcccgagagaggggagggaaagggggaaacgaagcggcggtccacggctcaccccgggtcgacggcgacgacggaaacggcgaccggagcggaggaaggcggcagcgcggctagggtggttggggtcgacggtgctccggcggtcggcgaccgaaacggagaggtggacgaggtcggcgaggatgcggcgaagccgaaggaggcggcgccgaggtgggaggtggtccggggcgacaacggcggcggaccggagctcggcggcgacggcggagagagagagtgacggcgcgagctcgattccggcggggagagagggcggctagtggcggaaacggtggtggggagctcggggagggtttatatagggttgggagtgagagagggcggccggaggagggggaaatgggcgcgggagacccggccgccattaatggcgccggcgaggttaggggaacggttttcaaaccaatccgagggagagagggagggaaaaatggggggaaagggagagggaatcacggggaataattccccccactttattgcgcgcggggacggcgggaggcggcgggattcgcggtggcggcggcgctaggcgcgggcgaggcggcgggagcggcgggaggaaggggatgacgggtgggccccacccgtcagcgagagtggcgggcgggcccgcccgtcagcggcgcgcgtgcggggagaggccggatgggccgcggggagaggagagggagggggagggagatgggccgagccggcccaagaaggagagggagggaaaggggactttttagagtttttgtttttataaaatcattttaactttgtttatttcttaataattattatttgtgctctgaaaattccactaaaatttatttacgcattttaggcttttaggaaatatacaaaaatcctctaagccttaattgacttttaactttgcacattttaattgttggaggctttcacacggtttttaattattctaggcatatcttagaggatgtattttagagtcgttttgagacgtgacagcagaagtggccgatgtgggaacaaagtcgtccattaatggtcaatgaaaacaccagtcggcggtgatgacggcagctggtagtgaaggtgtagatgcccaacaacggtggtgtgaccaaccaaccgtataggcgaggtcaccagtcggcggcgatggaggcaagccgacagtgaagtcgttgacgcccaacaacggcagcataataggccagccgtgtaggcggagataccagtcggcgatagatgagacggccggtcggtgaagacgtagacgcccatcaacggcagcataacaggccagccgtgtagacggagacaccagtcggcggcggcgaaggcaaccgcagccatcggcgaaggctgatcccggtgagatgtcctagctgactgccaacatgaataggcagccatgccgaatatatagatgaacatactgtagatagcttgatgtactgcattgttcctcagaaaattgcatggcatcgagtttggcccaattgatctgaacaaagatgaaaccaccaaagagggcgaaaactctgcctctgtgtgcacgtcgtcaaggccgtggtaagtgcagatcatcgtggcaaacaaaaactgcaaaaagtccggcagccgtgaccggcgctcggaaagctatgcatgtgtgattgttgattaagccttgcacgcacgtgagatggaggcgactggcggcgacttctgtggtgctgatgtggaggccccctggtcaactgaatgcatatatatatgcatcttagatagataaatcacttgactaatcaaattccttcctgattacttgatatgttacgtgcaattgctgatgacgtggcagctcgatagacaatgtcttcgagtattgctgatcagggaaatagcacggcgacgactgctctgattagttgcatccctgtgcaggctgactccgatttccgatcaaggaaagaaatctgcggcagctgagattggatccatcgaggtcaccgagattaatccttctgacaagattggatccgagatggagaagaaaagcttggcgaagtcatcggcaggcaagtccggggctcccaaagcggaaagcctatcctggagcgaagacgataccagcgacgtcgaagattggttccatcgcactcgtcgacggaaaactcggcgccacccctacctgacgcgccaactgtcaaaacatgaattcggcctaaaagtggatggatgcggagacaaaggatttagactggttcaggccctctcaataagaggtaataccctactcctatttggggatttgaatccgccgggtgtagtatagatctgacgatcatatgtgctcatgccccctagaggacctcctgcccaccttatataagatgggggacaggattacaagatagaaaccttaaccaatacggtatcgatttcctaaatctattttacaataatattaaattaggactttaggccgcttcataatataaaaggaaacgtaatacccaagtcatgatctgttacatattccatagatataagctaatcccctatgactagttggataaccatgccgtgtgggtatggggtacccataatctccacagataggttgaaggagaaaactgtcagtgagatagccccaaacttgataaactgatcaccaaaaagactatcaggtaatgtacagtggttcaagccttggacaatagaaaatggggcctttaacagtacaagtgattgttgagtatcttcgggtctgggacttggtcaagggggttgatgaggaactagatcctgatcttccgataggtattgataactcccgatttggtggaaacttaatgtcacgcccagaaatttagtcaaattttcggactattttgcgtataaattcttgtctaggaatcaagccagtgtacacaaaacgacaaattaatatatagatccaaatgtaaataaagcataaatacttactaaagtggtaccgaaaagaaagcagcagcaacggaaaaaggcgatgctagcggggcttttgctccactccgcaggcaaaactcagctagggtgtgagccttggtcctcgacaccttgctctatcctagaacacaacatgctcacaaaggttccatttttgcaaaaatatctcgattccgtaacaaatattagtcaccaccttctcaaacacaaagtataggcaccggacggagaaaacctcaaataggtcctgatgggttgccaaagtcagacttatcatggagtcaatctcggtctttacttgtcgtgcacggatgaaccaaaagtgcaaccgatccaatcgacacaactctcgtcctcttcctgcttccttacgtgcaatacaaaactgcaaaagcatatggcataaaccctagcaaccaagcaaatctaaatccgctcgatgaaaacttgtacaaaccataaaaacggaaactcgacgatgattagattcatttttcaaggtccccggcaacaaccaacgag

SEQ ID NO: 61306 - DNA, 677 bp, Oryza sativa
aagcacacctcaaaattacaacttgtggtcccattgatagagtagccacttgcttgaagctctcttccaggaaaagcttcacctgtgattcgtagcccttctatggctggtagtgggtcatcatctgcagctgcttattcatgaaaaatatgttttacaataagagccaaagaaatactaagaagaatattcaataaatataatatatataaatatgtaacaccttcagagaaagaagaactaggctcttcaaggacagtaggaagataagggtatggcgggttcgcatcatcaacaccagatgccaaattaggtgagccctccggaccccattgtgcaggaggttcttgtgaaatatgcgtttcagctccctccagattttctgggacatcattcctaacgaggtccttgaatgacggattctgattcttggattcaaagttaaatcggacagcacgagaatcatgttcagttccttgagctactacatccttcttaatttggttgctgtaaaaaaaacagattgggcatggtaagatatctactttgccaatttgactatctgattattcaaaaatatttgatcatcaaagcgcattgctacatttatgtgtaacagaaaaaaaacacaaattacacaatggcaaaccatatcttggcccatggtgggatatgac

SEQ ID NO: 61307 - DNA, 7456 bp, Oryza sativa
aatccgtgtgattcgctcatgggattccaaaattaaagtaggggaaattaatccccattgaatcctcttcaatcccccccaatttcccccttgaatggtgcccccaatcgccgggaacgcccgcgtcttcctcggccgccctccattgccgccggccgtggttcccgccgccgttcccgctcctcccgtggccggctctctcccccatcctataaaatgggatcctcatcccccgttcactcgttttagccccctcccgagcctccccgtggtccctctccacctccccgtcgccctcctctctctcccacgctgccggccgcctccagccgcctgtgccgcctcgaccgtgcgccggccggccgcgccgtcgcctcctccagcgtcgccgccacctcctccaccccggcttgccctccgtttcccgcggagacccccggagctgcctccccgccgtcgcccttctcgtttctccgcgccggccgcctccagtcgcctctcccgcctcgcccgtgcgccgtccggtcgcgccgtcttctccctcggcctcgcagccacctcctctccctcggtcagccctccgtttcgcggggaaagcaccggagacgcgtcctcgccggtgtccagtggcgtcgccaccacctctccgtctccggccggctgctgttcgtcgccggtacgccgaccgacgtcgccgtctcctccgttgacgtcgcagcgtcgccctccaccccggctgctcctcggtttcgccggaacaccgtcgcccgcgccggcttctccttcctcctcggcggcatctcctccggctgcccctttcgccatgcccgtgcgtcagccggcgctgccgtcccctccctcggcacggtgacgtagccctccacctcgtccacccctcggtttcgcccggaagccgccgcacatcgccgcgaatctctccatccgcctcgccggagttgttcggccgcccgttcctcctctcccgtgcaccggtcggccacacctccaccacctccggcatcgcagcggcaaagccgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgttccacgccgtcctcgtctccgtgcagccgctgccggctgccctcgtcgcctcctcgccggccccggtcgtcgccgtcgtcgtcctctcgtcgttcccggtcgtcgtggcgttcgtccctccgtcaagccgttcttgtccgtcgtccgcgtccgtcaagtgtgtcgctgcagcccccgtcctcgtcttcgtcctcgcctccgcgtcgtcaagccccgtgccggccgcgtctcgccttcgtccaaggatcgccgccgaagtcgttccctcgccgtccgtctccgccgcgccagttcgtcgttgtcgttccctcgcctcgtcgcgtggtggtaaggttccctctccctcgctgccccgtcctcgtcctttcggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtctttccaggctagcgcttacgcatgttttataattgcaaagcttaattataataatccgcaaatctctatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagctttcgtcgttccggaggttccagaagcatggttcgcggtcgtcgccaaaggttcggaaggccgttctctctgagcaaggcaagtcacatcatcgttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaataaaaccccaactagtgggtactctattcatggttccactagtatgaatttaggtagatgcttcgctgattaattaggcaacattaggtggttttataactttagactttgggaattctcatatcatttggacattatggaattgttggattatggtggaattggacatacccctctcttcctctttcaaagcccctaaaacctgtttttcggtggggtttgggtgcatgccagttgtgggaagtagcaccccggccactataaggtttaagctcgggcctctgttgcaaagcactaccgtacttccacatgtctagtgggtaaggcgtagtttgtggctcagtctggttataaacaaaagtacacggattagagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgggggttcacggccttgattaataatactgtgtagctctaggatcgtctttataaaatggctttgggcaactaagtgacttttaaatgctgtttactgcaaaacttaatccctacattatgatccccttgcactcccttgcattaattgtgcatttccggtgtggcttgctgagtactgtgattgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtatggtgtaccccggcttttcctgggacggggattaatacactagcgttcgggaaaatgcaattttctcggtagcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcggatttcaactagtactagatggtcaggtcagtgaagaagaagacatcgtcagttgtttgccgaagctccggaagactgcaagatccgctagcgaagtggaggaagcagtgaagccagctgtgaagcagtgaagatcttggagaacccgtcgcagaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagtgaaacaaacaacacatcagcaagaagagttagttcctttaaggtcctgtccctagttctggtctattcttccctggcttgtttcctctctcacctcaatccctgtgacagatgtttaacagagaaaaaggaaagaatgtcagcaggtatgcctccagtaactcaagttttcaactcaatccaccactggcctcaagagagttaacaagggcacacccttggtccattccaagcatgctgctgagttcacagctaccattggttggaagtccagaccaaaatcagtatgtgtttgatcgagcatttgccacccaggtcgatgagcttccaatgccagaagaggatgtccccttttgtcacgattgtagagagcaaggacactatgccctgaattgtccatgggtatatgccaaagaagccccttcctttggtttagcagggcagacatcgctaaaccagcctcctcgcaccaagtcaagcttgcagcctagtgtacaaaggagagagcctaatggagagaatccattgaatcccgggaattgctctcctcctagcttttcgtaccacgtggggtcacatactaagcaagccaaaggccagaagagtaagaatcagaagagaaaagcaccgatgcgaactgaagaagaagtacgtaagatgactattaccagcaccgaatggcctccagcaaggataactatccctacacgtcaaagaggaaatgcctttcgaggtgcccgtcagttgacccagcaccttctaatccatggtggcagagtatctgatagtgaagggtcagatcaggtctcctcgcatgatgaagatgagtctccccgacatgtctgagaggaagagacggaatcaaaggcatgcccccgatgtggagaaattggacacgttgctagcatgtgtatcacactttgcactcattgtgaagaagaccatccaccaggggagtgtcccacccgcaaggtcacatgttttctatgcgaaggtacaaaccatgtgcccaaggattgccaactcagtgtgttgttgaccaagaccgcagaaatccaacgaacaaccctacgattgtctcatcagctagtcagctccaacagcaatatcgacgatatcatccacagcaccaatgctcctcctgctgcacttgactctgcaataaatcatagcaataataccttcagcaccaaccattctcggcaccgacagcctcagcaatgaattgtcgtcgatggaagaagttgtttctctccccgacctactccaggccgagcgaagggaaatcaacctcaggagggtgataccaagcagaagaccgttatccacttcaaccagcaatcagaaggaatttttctcctgtgaatgatagcaatatgcagtcctatcacatcatcacagaaccaatcaaggatgatgcagtaactagaacaatgccatctatatctctccagaatcagaatgagtaaccatgtttgtgattttcagttcgctacttatcactgtaatcgaaagtttgcagcaatcatgtaataaataaatatattcatgtctataaacagtgagcttgctatgtttatggatgattcatgttgaggatgcaatgtaccgatgttaagcaccttccctttttgtttaaggtagggccttgtattcatgtaataagggagaaatgtgtaataaaaacaagttctatgaggactctttcggaagatgctgatatgggattatgtgtataattgtttactgtcaaaggagacctagggtctcattttagaggaactatgttctaacctcgagttaataaccaacctgaggatggaaaagaaaatcaagtgattaaccaaagagacatttgtttggactaagagtttcagatgtgtctttttcggatcaaaggcaaagacggtcagtacagcttttggcgaaacactccaaggtttcactgaaaggcagcagacaaaaggaccacatcgtcaccagaagcatccacaactctcggagtgaagagtacttggttgacaaagttcaaaaggtgattgatagaagataccagcaaaggtgtttattatcgggcaaagaagtaggtcgaaaggtgattgatacgagaaatctgaaaagaatacatcagggttgaatgtgtaaaggaatactttgaatgctaaatgatgacaacatgaagagaatagtgggaagtaaactgaatgtaaagaaagtgaatccgagctgtctgttcgtgggagctattcccagttatgaaccaagtgatatgttcgaagatagtctgtagaggtcagattaaaatcacatctaacaacgaagcttcagatttggcaggatcacgatcagaccataacaagtccagcagtaaagtcatttggggagacgtcaaagcatgtcaagtgggataagttggttctttttagaaacataattcaaaggcaaagttaccgacccttgcatcgaatagcagaagtagctagcacccggagaccaggaaagctaatatgaggcagttaggggcaagttgccaaacatgatatcctagtaatgacaagctgatatcgacgcataacgtgaagtgggtaacttgtatgaggttgacgccaaagatatgaattatgagaagttctggaactgaagtcccatcttcaagtgccacaatccaatcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttcttgctagcctcctcgaatctcggggacgagattcctgtaaggggggtggatttgtcacgtcctgataaattcatcccgaaataaaaatcattcgctaaaaggaataatagaattaattaaaatgcgaaaagaaattggcaaacactaaaatacgtgcaagaaaaattcaaaggtggcccggagaatttttgttaaattctccttggtctaaaatgagccctcaaattttacttgaattttcagagcaccagaaatatttattaaacaacaacaacaattaacaaagtttattaaaaagaaaaaacctaaaaataatctctcttcctcctttgggccaagcccagcccgaagtctccctttcctccctctctttctctccctctccttctctccctccttctcttgggcccctcttcccctcccggcccactgcctccccctcctctctctcccgggccgtttcctccccccctcctct

SEQ ID NO: 61308 - DNA, 4179 bp, Oryza sativa
aaggggatctgaaagtgggagccagacttttgctactgtccccatcttggatgctcgcgagaatgtgtgggagttggtggtgtgcgacacgacattgtccctctagttcacttgcttcttccccaacacctccatcaacaacgtcaccctccgcatgcgtactcatcttcatcactaccgcttgagctcaagttttgccgccaccaccgcagcacccccttcccatccccgcggctcctcacactcctgacacgactgggctttcctgcagatagctcatgagctcgaactcgccggctccctcacctacctcctcttctcccccgtcgtggaccactggagccacctcatcactgacctcccaccaccattaccacctcccgtggatgggctcgctggccgccgcccctctccccactggaggagatgggaaagagaggggggaggtggagagatggggaagagaggggacaggttgggaggaagtccactttaaattttaattttctgattggtatgccacgttagtgaaaccagtcatccataataccatgagactgacttggaaggtttttccaaaatgggggggagggggtgaagattgctggtattgcggtttagagataccattaaactcgacgtaaaataagggataataagtggacttatcactgtgagtaatactagtagtaatgagagttgggcttgggccgcccttttctacagtactacgatatatgggcccctgctcacacagtacatagagagacgattatgataggataggagaaacaagttgtacgccacgccgcagccgcacaagacttgatcctcttcttcttcttcttcttcctccaggctccagtggcgatggcgaccatgctctgctccttcacgcccgccaccagggctccgctccttcgcacttcctcctcctcttcctctctcggcttcgccacctcgcaactcgccggcctcagcctcggcctctccgccgcagccaccaccgcgccctccgccgccggtcccaagctccaccccatcctcgcgcgtacgtcatctgcctcctccttcttctctctgtttcgagccatccacccgcagattgacattacagttttatattacaccaccaatgtcatttctgctactattaaagttgttactttatccttcgttttttttttgcgctatccaatactccactgtatatatactactactagaaccagatgacctatttgttagtaattgattgctttaatctctcgaaaatagactagctgtcaatctattaccataaactcagatctttctttgtatttttaagagaatggaagctttattgaatttggtcgttctttgcaccatgtcagtgcacaaccaatagataccacacaacaagaaaaacagaactaactcaacgattaaggacctaatatcggaagactaggttgccgctcatgtgcctgggtaaaaaaaaaaaaccttgaccacatgctccaaatgaagacaagccgaacagacaaaacccctgtaatctggcttcttgagaataatccatgatcggagccaatgtgtgatcaagaaaataacctgcaaagaagaagaaacaattttcctgtcaaaaatcacatcattcctttatagccaaatagcccaacaagtcaactcctagtagaaaaggaggcctagactctttgttttgtcgcaaactccattgtccagacatatgtgacacactcctaggtgaagaaatgttcgatgcaatctggattaaagaccaaactgatcgggctagccgacattcaaaaaataaatgctttatcgtttcttccttgtggtaaaaacaataggtcttattcccttttcaattccgtttagccaggttatcttttgttaacaccacccctcgacataaatacgatagaaacattttcactttgagagggatttttaacttctagatatgtttgttaaaattgggaactcttgtatgtgcaagataatgagttttaaccaagaatcttccatcaggtgttagattcaatttaaagtcatctttctcgtgtgacaacactatattagcaatgcgtggaaagagatgattccacgccactaacttaaggccaataatatccttgcgccaagtgaaatttaacagggttgtttagaatatatttgaaatggttgcttgtttatgtctgacaaccatctctttgtttctctaagacataagcagagcttcttcttcttactagtgtatataagaaagaagggggaaaagaaaaaatataactattctggccatttcaagttatagttttagttttattctaagtcaaccattcataactttaactatcaatttcttatttaaaaagataattgtgacttatcaatttctagaaatttgtaaagtttaacaacatgttaattgtactatatattatgaaggtacttttcatgatgcatatataaacacataaatattatgatattaaatgtttggcttatgataaagttaaggacaagtaatttaaaagggtgagattatactttatcttttgtttgcatgatgccacaaattatagaaactagtagtagtaggaacaagatggcgtgtatggtgatgttgttgtatgatgtgggggtgggtgactcaggccggatatgccccttcacggacaagaagaccaacagggcgaacaaggtgtccttctcaaaccacaagacgaagaagcagcagtttgtgaacctgcagtacaagaagctgtggtgggaggaaggcaagcgcttcgtcaagctgcgtctctccaccaaagccctcaagaccatcgagaagcatggcctcgacgccgtcgccaaaaaggccggcatcgacctcaacaagaaataaatcaaatcatcatcatcatgatgcatacatacatgtattctctcatcaattgccgctgtgctgaatagaccagagctgtatgtagtccattattaaatccattcatctcgatgatgcaatttattgtagagtactacagtatgcattcatcggtggtggtggccggcttcgtttccttaaatttccttttatcccgtgttgctgctgcaagtccggctcgaattgtttgctactagtgtttcatttcggtcgagttcctaattaatactgtatgttggttacgaattataagatggatggatgtaacttgagcagcatcaggtcgtgcagttggcatcttgcgcttttcactttagagtgtcttccagtctaagctgaaattgattaattattttatttcctttttggctattgatatttaataagagcctaaatgaaagaattaacttgtacaaaattgaaaagctgtttgttttgtacaaaaggaactcctacgccaatattgattgttctactgctatggcctgtctggtttgagatagctgaaattgatggattgttttattcccctttttagctattgatatttaataagagcctaaatgaataatgaacccctacaaaattagaaggttgttttttttctctctaaaaatgtagagacgagaaaaaggtgttgagttgtagacgtggagcaacccggcagctccacacacgcgcaacctctgtctgtctcaaggactgccaatccctcgatcccctcttcctcagtcctcactactagtctcactagtcgacgtctcctcccaagtccaaacggtgccattgagatcgaactcgaagagagatactagtagtcgatgagtatggagatatccatggagaagaatttggagaagcggtcgcgcaagaggagcaggtacctctcccctccctacaccttccccttcactacagtcactgtccaagacgacgtgtccgtatccgattccgatcagtcggaggacctcaccaatgtcgccgtggcggacatgctgtcggcgctccacgccgccgcgctcttggacatggatgctgccaatgtccacctgctccgccgcttctttaccctgcacaagaccacctccccttcttcctcctcaacccgtaagcaacttcaatccattatattcattctagtacagtatatactagcatagcataggatatctatctcttcttcttgtactcttttatcttgaatgctgctgcctgagcatcatttattaggggtgcaggaa

SEQ ID NO: 61309 - DNA, 856 bp, Oryza sativa
attgcctcttttgacagaatataaccttcagccttctgttcttgatgctcaatcaattgttagcaatctgaaggtatgtgccatctctcttatgcacacttgataatattatatccttgtttgttcttgattaagccccaagttttcaccaaaaaaatctatattatcttcaatagcgattctctatgatctgaagttttttaaatataaaaaaatgttcaacaaataaaagacaaatatcttctctaacataagatcttttatgaattgtcttaacaacaaacatggaaccactccttgcagacctcttgtcaggtgggataagagcaagctatcctttttctttatttttgttttaatgccaatattgtaatattactgcgcattactgcatatttttgttcttgtggggaataatcgttggaaaggtacacgagtgggtttgatcttgttccttacctagttgaagttgacctttcactaaacacttatttttctttttgtaggtcctgtttaagcatttgcaagagaaactcgctattactgaggtgtgccaattgattaaatgtcattgcttttatatataatagcttgtaagagaagcctgggttgtgagcatacattcacagcctggctagtagtgtgctttttattcttgcacagcttatcgctgatatttttgtatagaaaaatgaagctgcattctttgcaattttggatggtgcaggagaaactgaaagaatcacaataccagcttacaccttggcgagctgaatcttcaaacagtacaaatattcctgtgcaggcgccttctcatcctcctggaaatgcaatagttaccactgtatgactcttt

SEQ ID NO: 61310 - DNA, 4367 bp, Oryza sativa
atttttaatgggtggcttttgggagttgataagaaaataagtaaactaatacttgttggagcttctgccatttgttgggcaatatggctgagtaggaacgatatggtttttgacaaatcaccatcattttcctatatgcaggttattttcagggtaactcattggctccggttttaggcacaactacaaaggtatgatgaagatgaagagtttctgaaggttgcatgccgaaagttggagaccacggttatgcaactatttgctaattatggttggagatttacaaatagacttcaataattgtgatctccttacgttaggctggtttcaataatagtgatcttcggtgtgttctattcatttagatttacactatgttcatgaaaactactatgtaataattggctgtagctcttttgagtaaaagccgggatattatattccattatctaaaaaaaatagatgtatatagcagtaatatgctattctattcaggccaggatctaccatgcatgcatgcattgtttcaaactttatcaattgatctgattggcacatgaaaatctctatatatatacacgtaaatgctagacttccattgttttatcatttgcaatacattgtgaataaaactaaaatcatatttatacgtgcaagcacttcattatattacttccttacaaataatggtgaaaccaaatctacacttttaaaattacggaaatgctagaggacgggatcctatcctctgggcggtatcacctcatacacaacgatgtgctaagtttgagccacaactctcacctccgtcgcagtcgcaccttgctgttactaattcgtcaagccaacgcctcctcgaatctggctcttcgctgatttctccgttggcgtttgccccgattaccactcatgttgatgtgatagatgtgggcacacacaccggcaacagcttcaccttgatgctttgctggacgagacagtcgtacatgaacaccaagagactagaacttgaagcaaccatgagctgatgtcaccggttgtctttttcttccaagcctcccacaggggtagctatgtcaatatgacaccgccatgtcagcgatcacaaacagaatagaagaaaataaggttgcggggagacatctcaaggtgtgtggtgatgatgccaagagaggtcagcgatcagaaacgaaatatgaggaaaggattttgcggggtgacatgttgaggtgtgtggtgatgatgccaaaagaggtcagctagcttctgatagtgttgatgaaaaaatcgaacacactggcctgggagatctgcttaactccagtgcaggtctaaaggttattgagatgcgggcatgccagtcagtttgatcctgcaactgacaagatatgcaaatagtagatcaaaacagccgatcggctgacaagccaatggagtagttccagccgatagccgataatagccgatgccgataccagccgatagcgatagggtttaagcaatcagctatatgtgcaatgtagataatgatataaaggcaatcggctgatgataatataatatagcaatataatccagtagaaaccaatcggctaacaataatataatagaataaatgttgattcgaaggttaaagcacacatcggctggaggtccgatgtcatgaaatccacaagattagattaaacagtgaaacatttgttgtcatcggctagatccaacttatatgtatatgcaatccttatgagccgatgcaacgtcaagataactcaccggctgaaaccccgatgaaacccttattggcagtcaagaagcaggctagagattatggttctaagcacgacttagtagatcaaacttaactgatgcagcactaagtatgaaaagaaacataatgtctagacaatcaagccgttgactgagtttttagggtggtagatgtttaagctaatctaatctagcaacgcgatttagccgataccggcagaaaccctaaaacgagaagcagccgatagagctaaattgatatgctaagactagattaacagagacatatgataaataggtaggcaaatatatcatccaaaccagaacaatccaaaaggtcgaatgtactgatgcagccttgaacgacgccgatgtagatgagaaaattgcctgggccggcggaacattggacttaccccttagccggagatcgaacaccgatgcagcctcgcgtcaagtgccaagtcccgccggacgataaaataaagtagaaaaggtaaaaggtggcgatgcgccgaattgtattgatcgtagcgataaattacatagaccccgggtgtacatatttatacccatgggttgatacaagtccttgtcggacaagaaagaaactttcctaaagataaaaggaaaagataaagtccttataggacactaaacacactttcctaaagataaaaggaaactaacaaactattcctaattaatagataacttgccatgccgcattctctttgaactcggtctcttctagataagcttcctctagtagatcaatttccttaaccgaatatagcaagaatccgataactgacgacttgacaactctcatcggctaatctcaggacttcgaagctgatgctgactctaagccgatgactactccggacttaccaaatttcactgttaacagataggcatgcattgggtgagagtaaagttggaagaggtaatttatgttttgtttgattgtgtgcatgccctctttcttatgatttatatacaactaaaatggatctaggtactagatctgtcacaacctgataccaaatttgatacctgtaagatatcgtattgtagttgtttataaatagtatcctctacaatagcatatcccatgaaaattaaccacctttatcattccaatctaaatactaaaactacccaccatttccatccgacatgattttaatcttagccacatgctccataaagatctattcctcatagaatcagttctgcctattagttttgttttgataaaatactactatacaatgtagataatttatttttttgaaaagaaaagttttttttgggggcttttagcaagagagttggtggatgattaatacagaggtgggataattattttgctattgtataaacgaatgattattcttgcactaaaattgcaatttattgattttatcttttctttaagttgctccaaaaggcgagggaggtattagttgtatttgattgtttgttttcttgaatatttttgagagagtaaattctattactagttaattggctggctgctaaaatggagtaagtcactgaaatggaaccgttgattgaagtatagatggcctggatggaagcaaatttgcctttcatatcgcccaaaaagaaagaaagaaaaagaagaagaaggctgtgtcgtgttgttcgggccgcatcttggcccttccccggccgcgccgccgccccccatcctcaccgtcgtcgctgccgcgcgtcccttcccctcctccgcccgtgtggcgccttcgcaccgccgccgtcggtataattcctctttcccttatcgtagtctgaccaatctctggaatccacaagcttggtggtggtgggggccatggccgacgccgacgagctcggcaggaggctcgccgccgtcgcggtctccgactccgacagcgcaaacaacaacctcttccaggtgatgcgcgccgtggaggacgccgaggccaccatccggcagcaggtatcctatcccattacgatttcatttttcatttttctgccccctccccctccccctcactcactctctctctctctctctctcagctggaggagaacagccgcctcaaggacgagctcatgctcaagacgcgagagcttgacagattcgtaagcggctccccgatctgcccttttcctctccgtctcttcttctccacccgaatctcaccttacaataatatggagtacatccgcatcgcacaactaactaactaactaactagtactgcaacactcgtcggaggtactagtattgatttgcattcatctgctgctctgccagaggtcagaggctaccaagcccacttctcttgccgacaccttttcaacttctccccatgggacctcaacatgcttcggtaccacttcctcgtcgctcaattccaggaccgctctagctgatcagcacaatggactctttcaccacactgaccaaatgctgcacgatgccatcaagctaaagtacctagataccgaccagtctaatggaatgcccaggaaactatctggggagcagagtgcgcccgagagtcgtgtgccgtcgcacctctctggggtgcaggaat

SEQ ID NO: 61311 - DNA, 4071 bp, Oryza sativa
atgatataaaagaacacatctttattatatcgataatatttacattattacaaaggcgcttcaggcctggcaatcaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccggagatgcataattaatgcaagggggtacaaggggataataatatagggattaagttttgcagaaaacagcattcaaaagccacttagttgcccaagccattttataaagacgatcctagagttacacagtgttattaaacaaggccgtgaaccgtcacgaacctgccttaacccaaggcctacgatgattcagaccgaactggcaacccgaccctgggtcccagctcgtcccaagccaacccaggccaaccattccacattttagttgttgagcagattttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccggaaaacaggttttaggggttttgaaagaggaagagaggggtatgtccaattccaccataatccaacaattccataatgtccaaatgatatgagaattcccaatgtctaaagttataaaaccacctaatgttgtcctattaatcagcgaagcatctaccctaattcatactagtggaaccatgaatagagtacccactagttggggttttattttcctagggtgaacaaggtaataataacaatagcaataataatgtcttaacaaaggtaaataggcatggctaaataaaacagtgataacgcgggtatttaaataaagcggtactgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctaccagcctataaagaagcaataacaatacataaaaaggaagcacacagttctttaggttataacaaacattaggagacttgaacgggtcgattcagagttcgtatgaccaagatatgatcatccgaagtttaatgctgttatatggagatttgcggattattgtaattaagctttgcaactataaaacaggtggaagcgctagcctggaaaagacaggaaggctgcgctgttgacatgcggaccccacatgtcaacctaaaggaccgcggtagaccaggtacacagagacggtccacgggtcgacagaagcggaccccgtgtgtcaaccgaggcgagtggccgacaaacggactccactagacaccacacgggcagcacacgtggaaaccacgcggctaccgagcgggcacactaacacggtcaccacacgcacacaaggacgactaccgacaccggtacacgggtaccggggccgacaaccgcacaacgagcacgggcgacaccgaaaggacgaggacggggcagcgagggagagggatccttaccaccacgcgacgaggcgtgggaacgacaacgatgaacgggcgcggcggaggcggccgggaactacggagacgaacggcgaggggacgacttcggcggcgatccttggacgaaggcgagacgcggccggcacgaggcttgacgacgcggagccgaggacgaagacgacgacggggctgcagcgacctagacgaaacaccgaggacggacgagggcggctcgacggagggacgaacgccacaacgaccgggaacgacgagaggacgacgacggcgacgaccggggccggcgaggaggcgacgagggcagccggcagcggcagcacggagacgaggacggcgtggaacacgccgctgcgatgacgatgacggcggcggcgccgcgagacgacgagccggcgaggatgaacggtgaaggcgacgacggacaccggcggtgttcggtcggaggggaggcgaggccgaggacgacgttgcggctgcgatgccgaagatggtggaggtgtggccgaccggtgcacgggcgaggagggacgggcggccgaacaactccggcgaggcggatggagaggctcgcggcgatgtgcggcggcttccgggcgaatccgaggggtggacgaggtggagggctacgtcaccgtgccgaggggggggggacggcagcgccggctgatgcacgggcgcggcggaagggggctgccggaggagacgtcgacgaggaggaaggagaggccggcgcgggcgacggtgttccggcgaaattcgggcgaggaggaggtgatgccggggatgagggcggtgtcgcggagccgagggaggtggtggcgacgtcgatcggcgctcaggcagggagacagaggcggctggaggcggccggcgtggaggaaagggaagggcgacggcgggaacgcagctccgggggtctccgcgggaaacggagggcaagccggggaaggggaggcagctgcgatgctggaggaggcgacggcgcgaccggaccacgctccggcgaggagggagaggcggctggaggcggccggcggcacgggagagagaggaggacggcggggagagggctagggaccacaggagatcgcgggagggggctaaaacgatagaacggagcgagggggttgcattttatagcggagggaagcgagccgagcacgggagagggcggaacggcgacgggaatggcggccggcggccatggttggtggccgggaaaagcgcggccgttcccgacgattgggggcgccattcaagggggaaattggggggaattgaagaggattcaatggggattaaaaccccccaattaatttggaaagaacggttggattcggggcggatttgggggagcaatggcgctaggtttcccggagagggagaggaggctgagcgggaggaggaagaagacgacggccggcctggcacgtgggccccacgcggggcgcgcggcgtcagcgcgcgtgcgacgcgcgtgcacgcgagaaggaggggcggctcgggcagggggcggcttgggcctggcggccggcccaggaagagaggagggagaggcggcccgggggagagagggaggaggagggagtgggccgggagggggaggagaggcccgggagagagaggggaaagagagggaggagagggagacttcgggctgggcttggcccaaaggaggaagaggatttatttttaagtttttctttttaataaactttgataattgtttttgttgtttaataattatttccggtgctctgaaaattcaagtaaaatttgagggctctttttagaccaaggagaatttaacaaaaattctccgggccacattcgaatttttcttgtacgtattttagtgtttgccaatttcttttcgaattttaattaattctattattcctttttagaaaatgatttttactttgggatgaatttatccggacgtgacaataggcacggc

SEQ ID NO: 61312 - DNA, 3231 bp, Oryza sativa
atggccatctatacctctgtggccacgtccttccacaactctagctagatctggtttgatttggttgtttcaattgacatctgtgtaggagataaccaagacggctaggagaatgcacagaggcctggccttgtgaaggactagatgaaggcaagatgcgaaccaactttccaaggtgcaagcaacacctagcacgataacaagcagcgtccagtgtaggatgtggtagttgggttggtttggtcattttgtttacttcagtccacaacgtaagatgatcacactcaacgaatatatcttggtcttggagatcatatgaccgaactactgacggagttcagttttttgggttcggtctcggtgatgagccgaaggtggggaagccaacaaggtaagcttagagaacccaagtcagtcttgtgatcgtgtcgtgttcgtgcaaaatactaagccacgtaacccatacatctgatttgaaccccacctcaccttctttgcttgtttgttgcttcacaatgacatgatatctcaacctttttttctaaaaaaacaaaacatatttctatctttaggcatatggtattatagagttataatatggaaatatttcttttttcctttcctgatcacgtgtagggtggtgctctatataaatgtgacagtctgacacatcagaaataggttaggccagaatggcccaatttgcatcccattttcaacagatccgcaaccccaactagaatacacccctcctgcggttaaactattagatgtggtatacctcgaagagtagtagcttgcggaaaacaaagccggtggagttgggatcgagcttggccaacatgtcgataggggcaggaacttgtagccaagtcgacgatggtgagccatcgaggcaaaggagaacataaaagatgtgagacgacaaggggtaagagttttcatggagcaacttagaacttataagttaatgcatagaggccacgctgaccgagagatcatggccctgcttggcgtagctagctgcaacaacattagttcattttgtattgttggtactgtagtcgcagtagcaataaagctacaatagcactagcaaatgaggccactatagatactatatcataagagcttctctttatatgggttgtcatgagatgcttttgaatgcgtcatatacacggtggagaaaaagtttaaagcttgtggtttggatcggcttggatctacttgaactcgtagtcataatgggtcgaaccaagctaggctttagctagtgagcttaacgagccagcttgtgagctgctcatttagctcattatggtaccacatatcaccatatcttcacttactgcttcttaaccatagatttagcctttaattaccatatcttcgctattatttaatgtttattattaaatttatatatgataaatggtaaattaaaaatataaaggtgatataaatgcgttaatgagcctaacgaacaagctcgtgagctgagctgagctaagcttttagttctctaaggttaacaagtcaaaccgatctagctcagtatccgcccctaaatccctaatattgttatatcttcctatcaacaactttcagactcccctatttatatgcggagaagatagcatgttgagttcccatcatccgcttattgcctcataagagcatcaccaacaaagtgccaaaattcaatcccctaaaatcttttgtatgagaatctctaatggaattcaagggataaaaatatcctcccctcccaacatagtcaaatttaacttctcaaaaaaattgagtcatgcgagaaacttcgtaacaaaatcggacctcttcttgtactcccgtgtgcaactcctcctcttggtgtgcacgaacttgcaattggagcgattgcctctcccaacttgtggaaagctagatttaaggagaagggaatgagtttagagctacctttgtagattgatttttgcttgaaacacaagattaagggattggtgttagggtcatgctctaaaccgcaaccaaaatttaaagagaaaatttcttatttgccaattaaagttcacgagtttccttatatgccatcgaaaatttgttatccctttatatgcgactgcttgaacttattcttcccctatatgccatctatgttatcatcttgtgtaatagggatgtaaaagtacaatattaccctcttagtccctcgaggggatgtctactctcttttttgcatgtcatctaaataattacaaaaatacttgttttaataacatagaaataatatgtgatatatcactaaacaaatatgcaagtttaaatttcacttttacattttttttaaaaaaaaatcaaatttggttatgagcacacctatactagttccaattaaatttgttgtttgcgttacttctattttgccatgttggatcttaattatgttgaacagaaggtatatataatggcttattatatacgtgatgagataagacaggcatgtaactagctagccgcgtatcaaggaacgaatcgtattcatttgggcttctcgattgagagtcgggtcggatcatcgtataaacaatgtataactactactacatatataaatatacgtactataccgtagataagataagtcatataattaaattaaagaagagtagctagctagctagggtaccaaaatatataattaagcagatcgatcgacgagacgacgacgatgcagcagcagctggagcaggtggcaagagcggtagccgaggcggtggtgcgcatgacggcggaggtcagcgccagcagtctcgccgccgtcgtagtcgtcctgctcgttgccagcggctacttggaaatcaagcgccgctgtggcgcccttccggctgcggctgatcgcgctgctgcaccacctcaagatgatgataccatgagtatgatgaccagggaggaggcagcagcacaagaagatagcaactgctccgcatcggcattggcacaatgcaactccatctgctgcagcctgtcggcgtccacgtttcgttcaggaggaagccgcaacgacgatgataaccactccgacgtctcgacgtcagagtcagatgattcttcttcttcggactcggcgatatcctcgccagcagccgaccttcgcagaagcccctcgctatcagattgggcttgccccttgttcacccctcgcaacttcatcaggggtgcaggaat

SEQ ID NO: 61313 - DNA, 865 bp, Oryza sativa
caagaatcagatatgtgcgggggaatcaagaatcagaccttgcagctgctgcgacggcggagtggtggtagggtttgggtcaccagtggccatcgaatcgaagcgaagcgaacgtacgtgcgcgccaaccaggagagcttggcttcttcaaccccccaagtccccaacccgtctcgtgctgtcgtggacgtgccaaacacagacactgctcaaccacgtacctctctctcctatatgctgctgcactatatccgatccgaaccgaacctccttctctcactccttccttgcaaaaatgctaagattttcctaccttcaaagaaaatacttctttccttttctcattggataacagagaactggttgtatcttgcatagagatggcaacagaataggtcacggtcagattgggctagacgaataaaaccaacacatctcaacgattgttaatactacctccgtccctaaatatttgacgccgttgacttttttaaacatgttttaccgttcgtcttattcaaaaaattttgttaaatatgtaaaactatatgtatacataaaagtatatttaacaatgaatcaaatgatatgaaaagaattaataattacttaatttttttaaaagacgaatgatcaaacatgtttaaaaaagttaatggcgtcaaacattttgtaacggagggagtataacataaggggaacataacttcggagttggggatctagccgacgtatcaattgggacttgctaggctagtggaatccaaggtgtcctctccgcgtatagatggccatatgacccgacccaggcacggcacggcccgactcaggtcgtgcccgtgccggctcggcccgatagccgtgt

SEQ ID NO: 61314 - DNA, 45405 bp, Oryza sativa
atgcgacttgccttgctcgctttcccaaacgtcggcttcaacttccacgaaaagcggatcttccgaagctacagcgtctacacgaccaacggaaaagaaaaggcttttactctaataaactccatataacaagcaggaacaaagcacaaaaatgggttcttgacttcttaaggaaaaattagagacttgaatggtccaattccgaattcaaatggccaagttatggccatttgaagtttatatgctctttaaattaatatttgtaaatttcctcatttaaattttaatttaaaaaaaagtttattgcgtcagccgaggggagggggcgcgcggaccgggtccacgggggtgggacccacgaggcagcctcacggtcgacggtggaccgggtgcacccgggctcacaccggccggcgccgtgggtcccacgcgtcagccgcacctaagggtgcgggcggctgatggccgggccccacgcggcagccactcggcgcgcccgagggcggcctagccggcgcagccggcgggaggcggcgcgcctgcgccccgatggtcgccgccggcgaccactagcgcggcggagcggcggccgagagaggggaagggaagggggaaaagaagcggcggtccccggctcactctaggtcgacggcgacgacgaaaaaggcggccggagcggaggaaggcggcggtgcggctcgggtcgacggggtcgacggcgctccaccggtcgacgagcgaaacggaggggtggacgaggtcggcgagagccgaagaaggcggcgccgaggtgggaggtggtccagggcgacgacggcggcggaccggtgctcggcggcgacggcggagagagagagcgacggcgcgagctcgattccggcgaggaggaagggcggcgagaggcggaaacgaacggaggaggtgcggggagggtttatatagggttggaaggggggagagggcggccggaggggaaggaaaccggcgcggcgctctcgggctccatcaatggcgccggcgggattaggggagggtttccaaacgaatccaagggagagagggagggaaaattggggggaaagggggagggaatcacggggaataattcccccctattgattgtacgcggggaggacggcggcggcgctagggcgcgggcgaggcggcgggagcggcgggaggaaggggatgacgggtgggccccacccgtcagcgagggtggcgggcgggcccgcccgtcagcggcgctcgtgcggggagaggccggatgggccgcggggagaggagagggagggggagggagatgggccgagccggcccaagagagagagggaggggaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttatttgttggaggctttcacacggattttaattattctaggcataatttagaggatgtattttagagtcgttttgggacgcgacaatcgccgcctcgagccgtgccgctgccgcgccacgcgccgtcccgtcgcctcacgtcgtgcgcccaccgcctcgcgccccgcgccgctgccacgtgctgcgccgccttgcgccccgagccgcgccgcaccgtcgccatctccgccagcgcgccacgcgccgtcacatcaccgccgttgcctcacccccccaccgcccttcccttctcttccctctcccccttatcctctctttcccctataaaagcccaccattctcccctctccccactccatcccctcctcctctcccttttccctccccttctccacgcgtcgccgtcgtcgtgctgccgcgccgccgccttcgagccgccgcgccgccgccacgaagccgctacgctgtgccgcgccgtgcgccgtcgtcgccgccaccgccgtcggtgagccgctgccccccccccctgtttgtcgccgtgccgccggatagagagagagccgagagagagggaggaagggagaagccgagggagagaaagaagaaggaaggaggagagaaaccgggagggagagagagaaggaaaaagaaaagaaaagagagagagaaagaaaaaagaaaagaaaaagaaaggaaggaaaaagaaaaagaagggaagaaaaagaaaaggaaaataaataggaaattagagggagattagggaagtttagaaaatttaaaaaaattagaatttagttatagattagttatagtcatagaattgcgtaatttaatataaattatggattattcttggtaatttctacaagaaatcaattcgcggtagtagtttaaatgtaattaagaactaaacgattagatgaattcttatagactattatagattatgttgggtaatctctataagtaatcgattcacggtagaaattcggatttaatgactatgaattttagacgtatattatatttagtcgtttagtcctagactaaaattaaatcgtataatattataagataattttaggattccgtccgatatttagcttgcgatagaaatttccaacctattatatggatataatgctcgggtagattaaattaaaaacttatgatgacaaaatatttatacccgcaaaatagtttaggatatataaatcgaaattgggtttgccctagttcgcgaatagtaaagttaatataaaagaatcgactttcgcgttcgacttccatttggatttatttggatttttatttgaattttaaccgaattcaaatcaattttcgcacgtaactatagagcccgagggagttgcggatccaagtgaaggctaggacccgcaagactttgagcaaggcaagtcatcactattcttgaacatattgatcccaattgcgaaattgttttgtttacaaataaaattgcatgcaaagatgaacatcctacttgcgattatgccatgccttgattattgtttaccccttattccttcataaccatgtttacgtatgagtccctagtcaactatgacaaatgcttagaaatgctattctagaatcatgcatactcatatttgtcaaatgttatatgcttgggcaattacctttgggaaggtaattgagatgcggcatgtggagacatgagcgccacattgccatgatattgaggacatgatttgtgaaaggagaaataaactaaataactgttttcgactggggcggacggaggatttgggtggtatctggaaaaggctagtaccgtccccggtcaattaaggaccgagccatgaagttaagcatgaaacgacccccgtacaaccgcacttctcgtatgggtatagacctagcagagtagatagccgagcggaggcagtatccctgcatagatggttcacccctgagtgaggcaggtgcgctacggtgggacagccgttgaggtagggccgagaggcgtgccctacatcggtgtcaccattggtaggactgccatgagtgtgtgagagagagaacttaacttgaaccataatttaatatgtgtgcgagacttctctttcctgggagcgccagaactcctctcactgctagaaacatggatgcctagagtgcatgaggatttaagttcacggagcgggtactgccaattcgaggttatcaaaaggctttgccgtggcgcgtctcatgtgttgggacgaggctcatgtgttgggcagtcacgaagtgcgggtaaagtgtacatccactgcagtgtgagtaaaccaaatctattcgaacagccgtgctcgcggttattgagcaccgggacatgtattacacttggctatactctaaattcttaacctgtgtgggatgggatattgcatgttgatttttatgctgatggagccacttcctgagaggagggaaggtagacgtcctcagaaaaacatgaggactcaatggcgggaagctatccttgggatcacaatggatggtggacagaaccgtcgttgtttaatgtgaacactggtattaaaacttgatcagtctatgctaagtcttaggtttgtgaaaagaattacaaaactggcttagcgcaaaagagccatagccatcctttgaaatacccctttcatatgcattgttgctgtggtggcttgctgagtacagttggtactcacccttgcaaatataaaattaatcagaaacgggagatgaagcttcggaggatccctatgcctactaccaggagggagatgaagacgatggcgctcagtaggtcttagtacggtcgttgcctgtggcaatggcatgccgctgcctgaattccgctgccttatctattgctgcattttggatgtattccggaccgctcggtccgatgatttaagacaatgcctgcgggcttatgatgtaataattagcactagactctcgtgtatgtgcttttggtatttcagctatgaactcgtgtgtacaagactacttgatccagggaaatggtactgtttacacgaatgattcctattataaaaacgggggtccacacctggactataggaatctcttccaaagtcatttggttcagacttgaccttaaagactcagaagacaatgcatgaacagttacaactcgaccatcattgctggtgagaattacttttctgttggcgcagtctatcacacctttatatctggctaaccagtccatccctaggataacatcaaggtctttggcttctaacagaataagattggcaagaaatggtactccttgaatttctattctgacagaggggctatgttgcaaagagagtgcttgattactcggggtactaaccatcaaaggacgtctaagatcttctacttccatcccatgatttcccgcaaaactcatagataagaatgaatgtgtagcaccagaatcgaaaagcactgttgcaggaactgagttaacaaggaacgtacccaaaatcacatctggagcaccttgagcttctgcagcagcaacatgattgacacgagcctttgatgctggtgcggtagagttgctttgggcagggacaaccttcacgcgtcggggctttggacgcttgtcagagtaatggcctggttcaccacagttgaagcacaccccgggcttgctgccttgctccctcttggcaggctgttgctgtgtcaaagctgcaacaaggcgtggagcttgattgcggatgttgttgcccgtgttgttgttgaagaactgacgctggggacgaacaacagacgaagaacctccctgtgacattgactgaggtcccaaagtaagatgcggcctctgactattcccctgttgtgccttgaagtgagcaatccggcatttcttctgctccatgcggttgtacttgtcctcctggtgaatagccttatccactaacttctggaaatcatgataatccccagtcatgagtgggtaagaaagctcatcattaagtccttccaagaacctctcctggcgctcttcatcagtgcgcacatcttccggagcataacgagcctgacgattgatctcgtgcagatactcggtgaccgtgcgagatccctggatgagcgacctgaattccttcttcttgagagacaccactcccgatggtatatgcatctttcggaaagcagcggtgaaatcaagccaagtgataggttcagcaatagtcctgttaaggcggaagtgatcccaccactcagaggcagggccatgcagttggtgtgatgcaaatgagaccttctcctgatcagtgcactggagcaaatccaacttcttctctatggcatccagccaatcaccagcttcaacaggattagtggtgctagagaaagtgggcggcctcacacgaagaaattctgctaacttgttctggggaggtgcatggttatttccctggttctgctggttctggagttgctgcatcatcatgttcataagctgtgcctgttgagctaggacttgggcaagcgtgggattctctccattgttgttgttgttgatgatgttgggaccattcccgttgctgcgagtgagcaccatctggcatgggcaggatcacaagaagagaaaccgaggaaaaactacttaggacagagaattaatctttctactaacttaacttttattgatcttaactgagtttcattattacagaactgaagactctcacaccactaaactcaccaactacctaacactcgaaagcaaacaaacacatgcgcttacatcccaccactgatgtaaatcacatgcgagacacacacaaccaaacttaaaacaagcaaactaacacaacgatcaaagacaatggcttgacaaggcattctaggtcttccgggcatcggagttgattgaaggctcgttcggttcgtctccatcatcttgagttgctccccactcgatcttggaatgggtgcgcttggattcttctttatcatcattacttacattgacgaccggaggatccgctagggctggggtaacttctttctccaccacacgaacctttggcgccaattggtagcgagggacgaatagagctctcttccttgcggtaagacgaaccctggccttctgcggtggtgcttctcccttcaacgcggctagttccttctccaaatgatccaccttgtcctctagcttgcaaatcttaccacgattctggtcttcacgatcttgagctgctaacacagtctccgcgcgggtctcatccatagctcacagcatctcaaccaaatgccttgtggtagcatcattctcaatccccacagtctcaaggtaactgccacggtcacttccctggggttggcgaggatggtagcgatactcagtgtcggccaactgatcactgtagcgatcgcggagctctcctatggccatccttgccacctcctgacatgcatgaatgtagtttcctcctccagcttcgaacatcactgatgggatatcttcactattactgttcatggtgactttgactcggcacttctcttcatcacgatcatgaggaatctgggcatacaaaggggcagtcccaaatcctatggcaaaggacatcgtatgcaactcctggacaaatccctcaacaccaaacaagtactcaggcttgaagcgcggcatcaaaagacaagtgaaaggagggagttaagacattttatccaattaatagcacaagtttttggattaatttgaataaagttagaaaatcaaagtaaaaggtaagtaaataaagtaaaccaagcttgcaagataagttgaaacagttggaaacaagatcacaaattttgcacttttgaacaacaggcttcaaaagaaataaaataaaagaaagttataaaatcaacacgctaagtttatttcattgcagcaagattaaataaaacaatgttgtaaaacttttgctggtaaatgagccattagtacagtaatagatgtacagtactaataacattggaataaattttgaatgagaaccactaaaagagattatgaaatgcatgtgctattagtttggtttaattaaaagagaaagggaggagaacagttctacttttccaatatttttagagggcttctatgggtaaccatttggcataacctagggtcaaggaggctctgataccaacttgtcacgcccggaatttctatccaaaattccaaacgcttacatgtgtgtgaaccatcgtccaggaatcagccgaggcacacaataacaaattgataatagagtacaattactactctaattaataagtgaataaaatgtcattacagaggtagatagttcctctcaatcaataaagatctaagcagcggaaaaataagataaacggcgcagacgactccactccacaggcagcttgaccagggctacacctaatcctccacaccatcagcatccctgtagaactcctcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaaacaatattaacccaacgctttacaacataccctgttgcataggcccaaccattctgaacaaccatcccggctgcacagttctatctccaaactaggaattaaccattccaaaccaggagctaatcaaattattaccagttatagcatcttttattatgatgagaagtgtgagactaatcacgaaagacattgttagacccgcccttaaccgcaggcacggctattcgaatagttttactctggccagacgtgtaccactgtacccacaagacacagccccacaacatgtcaccatgtgcctcaataccagcacggtacctcggaaagaagctgtgacagtacccctcgcacaacacaatccaccacagtgcaccgttcctggatcataatcacccccttataaacaaggcatggactccccagcgacccccgtgggcttatctccgccacttctcagtctggtgctccgcaatgaaccatgctatacaaaaggtaaagccattgcccacgctggcttgtggttggcatggttaatgtttcacaaccgaaactcgtgaaccggtccttaattatcatgagcacgaccatcaaaaccatgtgctcacaacccaccattatcaagttttagttggcaatttaattaattaaccaatcacgattgaccatcgtgagctatcattaagccatcattaaataatagtgaattataagttatcccaatagtgtgctaaagtttctaagcatggctaagcaatcatatctaatatcaagctgaaccaatatataaagctcaactagtcacatgctaatttattttaaaatgattaaaataaatatattgtgctaacacatgctaatttattgtgtaaatagatacatacacacacacatatatatatatatatatatatatatatttatctattagtttattatattaaagaggtgaacatgcaatataaactatacacagtcaagctcggccaggctcggtagaagctcgagctcggctcggtaaagctcgcaagcttttgcttaggcttgggttcagctcgtttggtgctcgggccaagctcaaatcgagcctaggatgagccaagctcgagctgctcgcgagcctcgagcttttctgatagccctaattctgattgtatctgttgtgttattagttgaatctgagatggtatctattattaggtttgaatctgagatggtatgaaaaattggattgaatttggtgggctcaaatttaatgggcccgtttagtgggctttgaactgatagttcgttaaaaatatgggccagttttgaattgggcctagttctaaaatgaacctattttaaaatgggctagttctaaaaaataatgggccgctgttaaataattaatggaccaatgtaaaaaattaatgggctgttaaaaaattaatgggtcgtcaaaaaaataatgggacgtttgaaaatatttgctgacgttagctgctacgtcatcagtgacacgtcatcacacatgtgtcaacgaccacgtcacctgccatgttggccgccacgtggcaaccatatgtgacgtaaggtcgggcctggctggactacacgagcccaaaaacgttttatgacggttaaaaaacgtcatagattgtactaatccgtgacaatttcggagaaaacatcggcagatttaatctgtgacgctcaatagatgatggtaagtagaattgtcacagacaaatttctgtgacgaattttcagtgatccatgatgaatttttttgtcatagataaaatagattcttgaagtgaaaaataacgattcgaaaaccggcatgtttagactttatcaagccctagatcgattgattgatacaggtaacaatctggatctttattgcatacagttgaacaaggctccaaaggggatttctttacataaaataataggggaatttacaagcttgtggctaactaatccaactgaagctatagagggactcaacatgaatgttttacttagacttaaaccatctaactaatctagacttgagaactaggttgaaatgagactaacttatatgattgaactcccggcttcggcaagaatatcaaattgactctgaaaaggaggggttgaagcaagagttgtactcagcaagctattatattgagtaatgaatgcatgaaataatagtaattgagtagggctatattaagttgtagaaagcagagaatgtagaagaagaaagcctgtgatgtttgaaatgtgtcagtatttaataaaatcttgaattaggtttctaaccaagatgccatagtgagtcccaatgcccgataacaacgagcacggctattcgaatagttttagggatactcatactgcagtagatgtgcgcttgccaaacacattagccttgtcatgacaaagcttttcggtttctaacatcagtggtacctgttccatgtactctagtgtaacgccccgatttttgttcaggattaaaaatcattaaataatgcattttttaggaattaaatcaaagttaaagcaatttaatcatgtgacattattgagggaattaaaaattttcctttaaaaatcatggccgaggatattttgtaacattctttgtgccctgatatattctctggaatttccctctaatttttggatttcatttaatcaattaaataaaaagaaaacaaataaaatttcccctctttgtctttgggccactcccggcccaatccccctccttttcccctttttccacttcagccatgcctccctcctcccttctcctcttgggccggcccctctccctcgtcccgctcggcctccttcccctagagtcttttttgcctccgtctcccgtctcctctctctttccctcgccgacaggtggacccgtggccccacctgtcagccccatccccaacctccagccgccatggcatccaccccacatcgccaccaatcccgcgccaccctacccacctcctccacttcgcgcggccgcacccgaccgtgggacctcgtcgcccactttccgtcctctcctcccccactccttcccgcaaaatcggcgccgaagcaccgccacttcgccgaagtcagtgcttcaccccgtcgccggtgccccgcctctccccaccactgtcgtgccctccccgaccctataaatgccgccctcgacctcctccctcctttttcccctatttcccgagctcaccatgcccctactgtggtccccacgctgaactgagtgccgccgctctccggagccctccaaccatgtgccgccaccgctcccgccgtcgccgtgctgcgccactgccaccgctagcttcaccgcgtggtgccgcaccccggcctcagctccgtttccctattccatcaccagaaccaccaccccattgccaacccgaaccaccaccgtaattcgccgcctccagccgcccaccaccaccgcttcaaccgacgccgcggctcgccgcttgcgccattggcttcgcggttgcaagagcaaggccggccgccacctcgtttgcccagtctactgacggaaacacctctttcgccatcgaccgaaggccgccgccgcgtttgtcgcctccggcagcactgtgtcgcctctccggtcgactccgcaccatgtcgccgcctccttcggcttcacgggagcgagggccagctcggcgtccacctcttttagccagaaacctgctagagctccctcaccctctctcgtcggtaagctccgccactcttcaccgtccttggcattgtttcctcgctgctccgatcatccatttccctccctaatgcctccaatcgattccccaggtcctgtcagctctcggccgcccctcctccttcaccaagagcctcctaatcgccgttgtcgtcatcttgctctgcaccggccgccacttctggtgaggactcctactccctcctccttttcctcttcgctggccgtgccgcgccgccgctttcccgcgtgcgctgccgccgctcgtgagcaccgccgccctctagccgctcgccgccgtcctgcgtcgccggctgccaccgccgcatcgccgtttggtcagcccgggcggcgagccggcctctgcttcgctgtggcctcctgatccccttcaggctgatccgggccatccacgtggcgtccgccgtggccgcccgtggccccgccgcgtcggcaccacatcggcgccacctcgtcttgccttgccaccgtggccgccatgtggccgtccacgtggtgcgcccacgtctatgttgcggtggaccgagtccaccgtgggttgcgcttcttgcgcagctgactcgtggggcccgcccgtcagcaccaccctttgatgatgtcaacaacgacccttttcctttgtaaaaataattattaattgcgtcataattcggatttaattatagaaattaatttaaatggctcaaaacttaaaaaattcataactaattcataagaactccaaattgagccattcaagttgcaaaattaatctaaaattgagctctacatgtttgtttactatttatgtattgtttacttggtttttattagagtttttcctcattttgcgtggcagcgtgtagtttcattcgtttcggaagatcgcggtcggaaggatcagagttcagaagattgttttgaagaagcaaggcaagtcacacatccccccttgaacatattgagcctactctacaaacgttttaccgtttgtaaataaatatgcatgttttgctaattacatgggaatagggtttacctatctactcgcttgtgccatattacttgatatctgtcctttgcgaaccttggatgataaatcgactagcttgtgttatttgtgttaacccaggtagaattatttatgcttagccatgcttaattaccactaaaattaagtggccatgtttcattggtcgtaattatccaattaaaatgcgactgagtggtgccttgtggatgcatggttttactagtcgcacccatggcaattaatgactggttcgcgggatgcagtggaagatttaccgcgcttaccacaagcgggaatgggtaactgcttgatttgaagtatagctttcctctggttgacgtaccctggctagggtgggcgtgatggagtttggatgggccctgcgacggcctttgcggcttccggatcgaccgtggtacgaggggggctgcccgttgcctgctggggacgggggcgaaacctgtggtttggtgcgattggttagaggtggttatatgaagggtcttgtcacaatcactcgacatggtgacgtgtccggccaggcgcggtgacatgccggtggattgtgtcttgtgggtacagttgtgcacctctagccagagtaaaacaattcgaatagccatgcctgcggttttgggcaatcgaccagaatcaccgtgattaatctcaccaaataaatcgatccaatgcactgtgtggttcaggtgggatggttgggcctgtacaacgtgctgtagcgttgttcagtagagatttaatattatcttaattaaccaactgctttactgttttgctcaataaaatgctttacaacttcctttatgcaaattgccacaaacctctctttgtatccccttgcacaagtgcatcatttgtgtggcttgctgagtacggtagttgtactcagccttgctatttctcccttttttagaagtgtagtacttctgagctgaagtcgaagttagtagaccaaggcttagaccccagttgagttttgcctgtggagtggagctaaagtcccgctaggatcgccttttccgcggctgtcgttctctttcggtgtgaggactaagcgcctcttatgtaagtatatatgctttatttacgtatctatctgtatattaatttatcattttgtgtgccctggctgattcctggacagggatttaattcctcgaggacgagctgctcaaaaagaggggagtaatgtcatgggctttaggccgggcgtcctaggcccattggataggcttagggtttgttaggattagattaagtggccctccatctatagaaggagggatcctatcgtaggtcaattaggcattagatcaagatttaatttagtgcccatcggcctgccttctcagtgcgacggagagcgtcccgccgtttaggtttacgactgttccttgtcatttcatctactataatccaatctatccccactcatcacgattcttctccacataatccttgctcgtgacatgttcctttctttttttatttaattatttagtctaagtaagttatatttccatctttgcaggttcattgtttagtatttatactaagtgctctagtactaggactccggatagagaaggaagttcttgcgcaagtattagagtagtaattaataacttaggcgtggtgtctaggttagagattacctgtgtttgttgtgtatcccacggatttgtcagaggtaggcggcaggtggtgacagccctgaattccgtcctagtaatcctccactgtcacgtcctgataaattcatcccgaaataaaaatcattccctaaaaggaataatagaattaattaaaattcgaaaagaaattgacaaacactaaaatacgtgccagaaaaattcgaatgtggtccggagaatttttgttaaattctccttggtctaaaaggagcccttaaattttacttgaattttcagagcaccgaaaatatttattaaacaacaacaacaattaacaaagtttattaaaaagaaaaagctaaaaataatccccctcctctctttgggccaagtctggcccaaagtctccctctctccccctcggcccgcagtccaagtccctctcccctccctttgtttttctctctttcctcccgggcagcccactccctcctcctccttcctcccggcctgcctcggcccagcagcccggcccaagccaggccgagccgagccagccgcgtgcacgcgcgccgcgcgtgcgctgattgcgcgcgctgaccgcgtggggcccacgcgccggtcgtcttcctcctcccacacggcctcctctctctcccgtgaaaaccctagttcgttcctccctcgaatccacgggatttaagcgttggattccaaaattaattggggggaattaatcccctttccttcctctcccttttccccctaatctcccctttaatcgtgcactattttgaccggaacggctgccgttccccgctcctcccgtgctcggctcgcttccctccgctacaaaacggaaccccctcgctccgttctctcgttttagccccctcccgcgccctccccgtggctgcaccacctctccccgcctcctccttctctttcctcagtgccggccaccctccagccgcccctaccgccttgcccgagcgccggtcggccgtgccggtgccttctccagcgtcgcagccgcctcctctgcaccggcctgccctctgttgcccatggagacctccggaagtgcatccccgccggcaacagtggcgttaccgccactgttctgtcttcggccggctactgttcatcaccaatacgccgaccgacgtcgccatctcctccgtcgacgtcgcagccgcctcctctcccccggtcagccctccgtttcgcggggaaaccaccggagacacgtcctcgccggtaaaacagtggcgttgccgccactgtaccgcctccagccgcctgtgccgccttgccggtgcagcggctgtcgtcatcgccatcctccctcgacgtcgccgcgtcgccctccaccctggcctgccctcggtttcgccggaacgccgtcgcccgcgtcggtctcgccctccgcctcgccggagttccttcggcaaccccttccgccgtgcctgtgcgccggccgacgtcgccatctcctcctccggcatcgcagcgtcaaggttgccctcggcctcgcctcccctccatctgaaccccgccggtgttcgttatcgtcgtctccgttcgtcctcgttgacgactcctccggtcggtcgttcgtcctcgccggctcgtcgtctcgctgcgctgccaccctcgtcatcatcgtagcggcgtgttccgcgccgtcctcatctccgtgcagctgctgccggctgccctcatcgcctcctcgccggttcctgtcgtcgtcctctcgtcgttcccggtcatcgtggcgttcgtccctccgtcaagccgttctcatccgtcgtccgcgtccgtcaagtgtgccgctgcagccccgtcgtcgtcttcgtcctcgcctccgcgtcgccaagcattgcaccggccgcgtctcaccttcgtccaaggatcgccgccgaagtcgtcccctcgcctttcgtctccgtcattcccggccgtctccgccgcgcccgttcatcgttgtcgttccctcgcctcgtcgtgtggtggtaaggatctctccttcgctgccccgtcctcgtcctttcggtgtcgcctgtgcccgttgtgcggttgtcgaccccggtacccagctcatcagaagggatcaataataatggggtacacaactgaggaggtggctggttgaatgctgtatagattacgtgaaggacgccacacccattgttataacccccgttgtacatgagggtcggttacttgggaagtggaccgtaggcaagaaaaggttctatgataacgactacaaagctgtagcggaagcttttagcagcgtgccgcaacaactagccatcctcgagccatacattgagggacacatgaacgagataagagcatgcaaccctagaagaccggcgacttggatctcaaaggaacataagcgcaaatttcctgaatggttgaaggaaaaaacatgtcgttcggtgaatcgcttgcacaggttggcaactggcccaagtagcctcatgaactcatggcaatggtacgacatcggcggatatacgttttatatgataggcaagaacaagaaaagcgcagctcataatagtggagttcgtgtggaggtgttggacgcaataggcgagaagaagtcatactatggatagagaaaatcccttatatacccctgaaattttacctaatcccttctatacccctgaattttgcttacttccttgtatacccccaaaatttgattttgatcccttgcatacccctcccatcagttgaccgttagttgaccgtctattttccataaaaatgaccattttacccttggatgaacaaagaaattcatgaattacattattaaaaatataaaagcttctcgcatgagactattatagttatgagtttgttgtgcgatgcattatttatcccaaaaatatttttagatcatgaaataaaaaacacgtatttatttttttaaaaaaagtcataaaaatgaggagcattcatataaagataggactaccaatgttcacaacattttttttatgaatgttcccgataaaaaaatccattgtcctattaaaatttgaaataaaaattttaatttattacatttattttattttcaaaatttatgtcaaaattttctgcactaattatttagtttcattagtcttataaaatgcacatactgtgcacccaaacaaaattttttcaattgttttttaagcttatatttaaacctaaagcatctagggcaaaaaggatatttgcaaccaaacgtaacagtgaaatgatggaaaatgtaacggtaggggcatggaagggatcaaattgaattttcaggggtatagaagggattgggtaaatttcaggggtatgaaagggattgagtgagttttcaggggtacacagggaatttactcctatggataatagaagacatttgggagcttgactatggcattaacatgcaggtcccggtgctatgatgccagtgagtcaaagacacaacaggcgtatccatcgattactacacccttacggttgtggaacgtagtaaactaagccacaaggatgatccatgcgttctcgctgaatatgttggacaggttttctatgtgaaggacccatccaacgagcggatggacattactgtagtgggaaagcaacacattattggcatcgataacactaaagacgtgtcagattacaaccaatatgacgacgtcccattattcacagatattcctaaccagatcaagcgaattgagacaacccttgacgaagagaagttttcgtctgtgcggaaggatggtgctgcgaaaattgtgaaacattagtatatatatatatatatatatatatatgttgttgtgtacaacctgttttgaaaacgattaatgtatccaacttatagccccttcaaacgattaatgtataaaacttatggttccatgtttatctgtactatatgtcgttctcaatttatatggttgaataattaagatgtggtttgatcaatatacaagtgatttaattagatgcgattgaaattcatttgtggttaaataattatatttctatggttgaataatttgttggcattaatcatatggatgaataattatattgattaattaattaagttgtggtttattaactataaccctatttagttatagttaaagaattatagttaaacaatttatgggtttaattaactataactatatttaatttgtggttgaataattatattgattaattaactatatttagatgggatttattaatttatctgcatttatttttgcgtgcgggtggcttaagccgcccgcacggaataatatcatcccgtgcaggctacttaaaccgcccgcacaggaatatcgatttcccgcaggcgataatatggttacataagcaccgggcgggcgggcgaaattaccaccgacgctgcccagttgtttgccgccgccgccgccgcctcctcgcggagccccaaacgccgccggtggcctcctcgcctcaccagcctccacctctgccgccggctcctctcctcctcgcccttcatgctggcgacgtcctctccggccaccgccgctgcctcctcctctactcctctcctcctccatcaagatctgggccgctgccgcctcctctcctcctcgccctcacgccggcctccccgacctccgccgcggccgtcgtcctcccgaaacaaccagcctccccgacctctgccgccgccgacctcctccccaagccgctggccttaccgacctctgccgccggccacctccttcccaagcagccggcttccccaaaatccgccgccggccacctccaccccaagccgctagcggtaagcgtgttttaggttttttgtgaaaatttgtgatatgtgcaatttgtgatatgtgaaatttgggacttagggtgatatttgtgaaatgacaatttgtcaattttgtgcgatgtcaatttttattaaaaaatgtagatgcaatttttttatatgtcaattttgtgatttttgggacttaggatatgtggtatatatgtattttttttttataattattcatttatatatggatttagttcctaggttattaaatcatcacagaatatgaggtgctctaggtgccatattggtttcgtcgagttagtgcattgacggagccaaccaagacaccttgggacgccgaggatcatattatgtcttttataggaaatatatatgtttacggttttttaggggtttagtgcaagtatgaaattgggctcgaataatttatatgtaactttacaattctaaaacacacacaaaaaaagggttaaagtgcgtagatatttctaaacggctagcatgattaattgagttacaattattacaaagatagaaatagatttatctaatatttttaaacaacttctatataaaaaatttcacattaagtattttaaaattttgttaacataaatcggggtaaaaccaaagagtggggcagcggtcgttacatgggctacaacgactagtacaatgcagaactattagttgctacttccttactagctagacctcacttcaccatgtttgttctgacaataggtataggtgcaactgtacaagctagtgcaataagcatggtccgcatgcctgcatgtccctgcattatatccatctacataatccaaggaagcaaatttgtataggtgataatatatatgcacgagatatgcatacacatattatattatcatcgatcagagagctagcacttagatatttttatactggaatttaattagtttattctttacatcactcagctgatagtacatatccgatcacaatcacatgcggcgagatcactctacgtaccattcgaatattgacctatcacgtgccgaccgactgataaactaatgaaccgaattgtacgcttagtacaccattagtcgattaccccacaaaattagtctatcatccatctaataaatacctataaaaatgaaaaatccttggctcaaatttattatccatacacaacaataaactagcataccttcaattgaatgcatataaattaatttatgcatatattcatgcattcgtttttcaacttaaaatttttaataacacctatatatctgaaaaattctaagagctagaagcacattacatacaagaaccaatacaagcctaaaatcccacattgggaggcctaaaatttggggaaaaaaaaagaagtttttagggttactctccaatctctaaatttgaccaattaaatcgaaaaaaaagaggaatggtgtagtatatactgctcttcaacttccatgagaggatttgaggaggagaggtataggtgctacttccttactagctagatcacctcacttcaccatgcttgttctgacaataggtataggtgcaactgtacaagctagtgcaataagcatggtccgaatgcctgaatgtttctgcattatatccatccaaggaagcaaatttgtataggttataatatttatgcacgagatatgcatacacagattatattatcatctatcagagagctagcacttagatatttttataatataatttaattagtctattctttacatcactcagctgatagtacttatccgatcacaatcacatgcagcgagatcactctacgtaccattcgatcattgacctatcacgtgccgaccgactctgataaactgacgaacctaattgtatggtttgtacaccattagtgtatcatcccacaaaattagtctatcatccatataataaatacctatgaaaatgaaaaatccatggctcaaatctattatcaatacacaccaataaactaacacataccttcaattgaatgcctataaattaatttatgcatatattcatgcattcatttttcaacttaaaattttgaataacacctatatatctgaaaaattctaagagcttgaagcaagttacatacaagaaccaatacaagcctaaaatcccacattgggaggcctaaaatttggggggaaaacaaagtttttagggttactctctgatctctaaatacaagagaggaagggcgccaatcaggttgatgccaaaaagggtctattccagcaattattttatggaggggtctacttaattatcctctacctcaactctggtcatcactgaccagctcatgagctatactgtattctggcttctcaagtccttgccagtaattttcgcatgtggtcctctttagaccttgccagtaatttaacatttttttgctggcgaggacttaagacgttcgccagtaaatataggagcggcttaaaaaaattggatcacaaccaacgagcgcaccttgcccctcccacaccctaactgctcgacctctcagcccctcacccgtctcagctctctccctcaccttttccacttccctttccaccacagcccctccactctcttcctagtctggccgaaggggcggaagctggcggcggctgcacttcctttccctccctgtccttgatctagttggagggaaggagggtgtcagtggcatcgactagatgcagctaattaggtgtaacctcaactatgtgattagatgaacaaactaaacatatagtcaaagagcaaataaatcaaccagccgagtggttttattaaaaaaaattaaagcatatgtgatgtcaaatctgacttaacaatactcatagtcactcatacaaaatatcaaataggtgttgccactataggtaacggaagtgattaaaccggtacctatagtgcttttcccaccttcataaaatgaaaaaaaaaaaactaacacctttaaacgaagataggtgacagttttacagaaaaactggcacctatattttaggtgtcggttcacctataattaattataagtgccggtttttaaaaaaaccgaaaccgataaaatcgagccgaaccagccaggggagatatttttcctccagatggggcccacacccacactggcaggagataaggccgagcccttctcccgccttctcctctctctctctctgcagcagcggtgggagaggtagcgacgcttcttctctctctgtgtctctctctctctgcggcagcggcgggagaggtagcgacgccctcccgtcaactagatcggggggaggggaggtgcagcggcggcggacgacatggaggcggcggcccggaccccccctccccccgccagatcgagcgagagaagaggtgtagcggtggtggcgggttggacctcgcctccgccagatccggtggcgtggaggcagcaagtttacactaacttcactcagacaatcacacaatagcatcatatatgaatagaaaccatctagaagtcatatccataaagcactgtagaaatcccacgaaaataatccgaaactaactcctacctggagtctgctaatctgaccgttgggcaacccggttagaccagtccaacaccactggtctgaccggcagtccccgcctagtctgaccagccaccaagagccgactaccgaaaacactattcaccgtattttcacaaagcactcacttttgacaattgttcatcaccacgattaaatcatcacatgattctacacatatctagagagaggaggcaagagaaggcaataatatatgttggtaaggacatagctacagtgacagaaagtgatgctgaactccatcggtatcgttagatttgtgctgatgtatatgtttcttttttcacaacagcttagtgccgttttcttttgatatgtcctccacgtgtgttgttgctgtcaagtggccatcgacttaaatttgctagtgtatgaaataatcactgctagtatacaacattaactggcagcagtactattatcgattggatacatccgattctaaaatttgggtgttgtaaacagctatacccataggttagcctaatgtgtagtagtgacattttttttagtaaaatttttaacagccacctagctaccaggccagtactactagctatagatgctactaaggcagaagatgtcatgtgattaagcttctatttctcatcacgttcaccacatgggcagcaaaagttttgcatgaaatgggatcagttgcagtcaacagaacacggtacacactcggtcttctatatttcgctggacgatagcaggtaagtatgtaccaagccatctatatacatgtgtcatgcaataaagtagcttggtctctaaacaaacaaatatagagaacatatcatcaatataactattgtgaattaaaataacataatcatctctatcatgcgggtgcagcttgggcatgatgttggcttcaactataaatagacgcgtcgcactctccaatcagatgcacaaccacaagaccaaggaagcagtagcctttcagccctcttgctttagtttgttgatccccgactaaatctcattggaaaacaagctagaaaacatggaaggagtgaagagtttgatcatgtgtatgctagtgctaggcttagtcctgcaacaagagaagatccaggtggaagcaaagagttgttgcccatccaccacagcaagaaacgtctataactcatgccgtttcgcgggtggctcaagagacacctgtgctaaactttctggctgcaaaattgttgatgggaattgcaagcctccttacgttcaccatacccttcaccctgaagctggtaaattagaaacattaactctccttatctatatttctatcttgcattcaccacgcccttcaccccagctaacctaggcaaattaaaacatattaactctctttgtgtaaacttttgggctattaattttgtaatatctattggtacaagcatttattcatgcatatacatgattttgcagaggaatcggaggtacttgacttctgcaagctgggatgtgcttcgtctgtgtgcagcaccatgagcactcgtaagcaagaaaaaacatcatattaaattaccattgattttcaaccaaaaaaataaagattctttgttgtatatagctaatgtatagattgaatcatttgttttccttttcagtttctagcaatgaagaagcgaattatgccgtcgatcgttgcaacgatgcatgccaccgcttctgtaccaaggaagctgagactgtcaccgttgtttcctaagcaagtgcaacatgcaagcataagggcttcacacatcgaagcccatggaaggctatgccactctggagtactcattaataaaacggatatcatgatatccaagccagtgtgccatcgatcgatctatcttgatttctgtcactctttattttcaataagctatgataatcacgatctaccatcatatattatcttttcttgaggatgggagcatacgtagagtgatgatatcattgcctaataaataaatctttatcccttttgttaaaattttataatgcatgctacatatatcggaactgaggtggcaatgaatatacatgatcaattgagctggatagtccattacaggttttatacacatatacatggtgaagaaaataaattattttccttccttaattaaaaggatacttgaccaaaacacaatgaatgattaattattataaattgacctcatgaacagatggttaaacacacagttaataacgcataatgacttacttctcatctcttctatatgcttgaggaccatccaaaatattcaaatgttttcttggcgacaacacaatgagctcaacaattaccaggtaaccatatttatattcgccatcagaacttacagattcaacctggcaacctcttgtttattatatgcctaaggcctccttgggcattataaaactattacacctacaaacctgcaatgaacttacacctgtatttagatatacacctaatgttgctcagtacaagccaagttgatggaagtactgatgcttattaccttgaagaacaatatatacagtcattgtttaattgttttttgtactgcttgtttgggtaagcgcttatcaatcgtggtgggcagctggtaggtattttgctataacctcaaaattaggaattagggatggggtcgatgtatattcagcctgactgacttcgtcccgactccgagcaacactataacaagatgatggcagggatgtgactgccatcgagctacacgaaagatgagcagaaactactatgagagatgttggggtggggggctttgcagaaaaaaaaaagaaacaggccggaacttcatgcgaacaaagatgaagaattttaaaatcctcattaaaagactattgaagctaaaaattgagcaaattgtcaaaccaaatatcgttggtcttgcttttgggctgttaacaaatatgcaaaagaggtttgttattcctattatatgttttgatgaagagctagctgcaagtaattgctaactccctgccttgtgaggtgaaggacttcccttgatcttatttggttctccctttgacagtaaagaagccttctaaagcggactttctatcccttactgacagagttgctgatgaactccctttgtggaaggcctcactcataaacagtgccagtcgcttagttacggtgaaagcagtgctctcaactatacaagaggtaaccaaacctatagacaagagaaggagcttcttatgctcagagcaagagaaggccaatggtggcaattgtttggtcgattggaatagagtgtgccgactgtttacacccaaatttgacacctatggacaaaatagaggaaaattgccaatgtttggaaagtgctgggtttcctttacagggccggtcagaccatgggtatatgggctgtctgaccgactagtagggccggtctgaccgcaggtatgtgtgcagtcaaaccgtcatggtccaagtctgagtctgttttcgttgggcctcgggtttccttgctcgggaagactatgtttcgtgtttcctttggtcactatcccgagttgaacgtggagaagggcctgtacagggcaagaccaactcctatttaagggacaaggccggttcattgtaaacccccgaatacaatatatttgaatttttcttttaccatgttttctattttaacctaggtttagtccatctttgtcgatttgcgtcgtaaatcatccgccaccgctgcgacagtgcgacacctctatgtaggtttgtcctgaaaaccttccgttttgcccacgagatgggcagttatccccatatcgatctaaatcggcctagaggctgattttgatctctaaatcgaccccgctagtcggtttagctgtttttcgacaaaacccatcttgatttggctgtttgactagatcgaggtggttgacgactccatatcaccaggcgtttaggtgttgcaatcgtgcttgtcgacttatcacaaaaagttgccaacgcgatttttggtgactccattggagaacgatctaatcggccatatcacggtcgaatttcgtttaatctagtaatttctgtttcgtcaaatcgagagtttcggctaaacagccgaaatcaatctatctatctactgccactgtacatatctattgatcattgtgttgattgattcagatcggtgacattgttcttgtactaccgatctggccgcttattttgccggtctaaccgacatatttagtccggtcagaccggagaagtggagcagtagcatggccggcagcttctcagctgtacacggccaagagatcagaaacttaatccaattcggtttgtacgtgttaaaaaaaatcaggctatacaaagtcgatttaatcaataggcaaaactgaattggtttctgttagtacatacattagcacatctaccgaggaaaattacaaaaaatcaaagccgattcatattcggctgttctgtcaaaaattccaaatatttgctaggcctacacggttgattaccaaatagatcaaatatttttgataagtacagtaccatatcaagaaaaatcacgatcgtatattaatttattcggtcaaatatttcggttatgagctatgtggcccaaattaatcaaggaatttcttcatcaaccatggcgagcgggaacgagatcgacatggtcacattggacgatcttgatgagggagcacgcaaggccatataggaacatctcaaggcgtatagccaggagatattgatgaagacgtgcactaggacccgtcaaggtgtggttctcaagcctggttctctttacaaacccgtatttgacgataaggtaacctccaattcgcctgatccatgtcttgccattctaaaacatattgatcattgtatagatgcatcttttagtgcttattttgataaaaatatggtagaagatgcttgtaaaacttattctagtaagaaaattggctctaaaatagccagttgtcaacaatatcatgctacttctacttttgcgtctacacaacatattcataatactatggatggatcagcgggtgttcacacagccgattccacaggaatcggttatacgaaaagcttagccaacagttagaccgcgcatcacgctggtcagatagcaatctttgccggtcagaccgcgccaaccatagctggtcaaaccgtaccttatcttggccagatcgtgcctcctgtggccggtctgaccgcatcattgaccaccggtcagactgggccattggccggtcagaccgggttatccatagccggtcagaccggcaccctgggacctcttccagagttttgtcctatgactaaaagcactgatttaaattgttatttgcctcatgttagtactattagtcatgctattctacatacacatgctatttgcactgataatatagcatgtatagccgaaccaagcaatgatttggattgtgttaataatttgtgcaatgatgccgtaacgagtatagccgaactaagtgttggtttggattgtgttactagtttagacaatgatggaatagccgaaccaagtgatggttcgaattgtgttgctagtttagacaatgacaccattgagagtataaccgaactaaatgacggtttggattgtattacaagcaaaagtgaaatagcattgtcacctaagaccgaatcacaaattggtcatgtggatattggaaaagatgaggacaatgtcttgcgggatagtagtgaaatagaatccaaagaagctatgcatacatattaaaagccgtatcctgaacatgtagattcggtcctatacccgcaaggatttgaggtgcccaacttcacgaaattgacaggtgaggatgctagaacaataatggagcatatcggccaatttattgaacaatatggtaagcccggtactgacgatttgcttaagttaaaattgtttcctcttactttgtcaaactttgcatctacatggtatagtttacttgctcctaattcaatttctacatgatcacaaatggaccatgagtttcatgattatttcaaagatgcaagcttgatggaacaaagaccgattgatacttcatcggtcacttgtgaaactattagttgtactgatttagacaacgaaaaagtagtgattcggcctagtcaagccgaatccacaaaaggaaaaagtgttattattggggatcctcggcttgacacaattaggatcaataatgcaaaggccgaagatcgtaaggttacaaaggatgaattatctagttccataaagaccaaaaagccgaagctcacttttgagatgcctatggctaagtataagaaaggattagccagtcaacgatttcataatcgaactaatgattcaaaaagaccaagatcatcttgtaggaagagatttggtcaaacaccaaaccaatcggagccatcaactataccaactccatacaaacctccggttgcgatgccatggtatccatatccaatgtcaccgtttggttatccttttatgtattacatgccatggatgcctcaattctctacgccatttcatcaaggatggaaggaatcaactaggtcagtaccaaatcattcatctaattcaagacaacactgtttcctactaaagaatcggtccggtggatcaaaggtgaaaaaggtgaagaaggtgtgggtgaggaaagaagccaaagcaccagaggtcgttgctatcaaggaggactctcaagatgttcatgtacctatcatgcaagcaaaggagatcgaagccgacaccgtaattgtcaaaagcggaggtctgaccgaggcattcggcaggtctgactgccaacctgtggccggtctaaccgatcctcctgggcggtctgaccgacggcttgcggctggtctgaccggggggcattggagaagagtgagaaaattgagagcaacacaggagcttccacctcgaccaaaaatatcaagaatcatttcttagctcctggaaaacaaccacagccgaagtggataccttctagcttatctcactctcaaaagtggaagctacagcatcttcgagccataggtcaaaaagaaaaagaagccgaagatgtagggaacaaaacatgtaataatttaaagcctcgaacgacacctaagcgagtgtggagacctaaagaagtaaaagttaagagttcggtgatttcttggagtagtgatggattcaatttgatgagagaagaatcatcggtcattagagataagtctcctccacatgattctatggaagttagtacggtattcatcttgccttcgaaattgtgcaatcaagaaagccgattctgctcgggggacaagacattaatatgctcatgaagagatcaagagtgatgaacggtgatggatagaatatcacatctttgagccgccatttgttggatgctaaggcacggtatgggtttattgtgtttaccattatattatatgcctatgccatgttagaacattgcttgctatctagcacatgtgtgttcttgcttatcaaattgatattattcatacatgttgcaaatgccagttctaagtagtggaattggtaaattggcatataatttgtttaaagtatgatttggctcatgagtctttgatatttattgaaagccaaatcatatgtgtttttatggatcaccatataatttgtagatttcatatttattgcaccatgaaagttttgcttattagtaattcggctaacgtcaatggtcaatgtgatgatttgttctagatttgttttctttaggaacattggcattgttaatattttgcatacatgctcaagccgattacttacatttgtagattattggaatctatgcatgtgacacatatgactttggtgattcattattaatcatacttcaattggctaagtgttttgatgctatgatgattattgtttcaaaagccacttgaattagtattcatctagacatattagttgaatattataatttttcatatatctagagagaaggaattttggaccaacaatttgatacaccaagcatctggctattatgtgaagaaaatttatatagtaaaagctgatgcttgatttccaaagtttggatgaaattggcagaataacagaccaggggtggtctgaccggcattgcatggccggtataaccggtggcgaccggtggtctgaccggctctacatggccgtctgaccgagcagacggggcggtctaaccggcattacgtggccggtctgaccgatcccaggcagagagctgggggccacattataattgattcaaaggccgaattatttgtgaattcgggcatttgtgcccaggagttagaagaaaattggagaatccctttgatagaatatttgaaagatcctggttttagggttgatcggaaaattcggcagcgagcattcaaatatactttgcttgatggagagttatatcgctgaaatatagatggagtgcttttgatgtgtttagacaatggtcaatctaaagttgctaggggagatgtgcgtgaagggatttgtggaattcatcaatcagcccataagatgaattggttgcttaggagagtgggattctaggccgaaagtgattgatgattgtttcaagtactatagaggatgtagagtttgtcaacggatcggcagtgttcaattagtgcctactgctgtattgaatcctatcattaaaccatggccgttccgaggttgggctttggatttcattggtcaaatttatccttcgtcatcaaaggggcatcggttcgtgctaattgcgacgaattgcttcaccaagtgggccgaagccgagccgttcatgaatattacttacacgtaggtaattgactttgttttgaagcatattattcatagattcggtattccttaaactttgatcaaggagcttattttatgttcaaagaggtgagaagttttgccgaatcttatgatattaagttgttgagttcttctctttactacgctcaggctaatggataagccgagtcgagtaataaaacattattgaaattagtcaaaaagaggattgaagaacactcaaagaagtgacatgaggtgctttcggaggatatctaaacaagatgctactaaagtcactccttttgagttggtttatggacaaaaatgttgttttgccagttgaggtaaatgttggctctcttcggtatttcaagcaagacgacttgtcaattgaagattacaagaccttgttaagaggcaattttgaagacgtcatcgacaagcgtttgaagactttgaaagagatggagacacttcaacacggtgttttcagagatgtaacgtcccgccttcccccaggccgggcccgcttacatgtgatagctttcataggtcatagactgccctcacagaccaacacatgtcttttctgcacactttgtcctcactcgtgtgcacccgggaagaatttcccggtcggtcacccatcctaaattgctccaggccaagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctatgtaaccactcccggtctacaccagccatgcgcaccatgcctgcgcaactgcgacacacgcgccctgaaaccgcgagagtcggctctgataccattttgtaacgtcccgccttcccccaggccgggcccgcttacatgtgatagctttcataggtcatagactgccctcacagaccaacacatgtcttttctgcacactttgtcctcactcgtgtgcacccgggaagaatttcccggtcagtcacccatcctaaattgctccaggccaagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctatgtaaccactcccggtctacaccagccatgcgcaccatgcctgcgcaactgcgacacacgcgcccgtgaaaccgcgagagtcggctctgataccattttgtaacgtcccgccttcccccaggccgggcccgcttacatgtgatagctttcataggtcatagactgccctcacagaccaacacatgtcttttctgcacactttgtcctcactcgtgtgcacccgggaagaatttcccggtcagtcacccatcctaaattgctccaggccaagcacgcttaaccctggagttctttggagattggcttccggaaaagaagttgcaacttgttgatatgagtattttattaatcctattaagccctaggccgggatgttacaagagagcaatcaatgggaaatatttgaagaaatacttccttagcgtttggcaagatgcttaggaggtcccatggccagtaattggattattggcctaagacaatatgttctatgctattagattcacgacgttcatcaaaaaggctgggggcatgcgtttacacctaaatttggcacctatggacgaaatagaggaaaattgccaaagtttggaatgtgccaggtttccttcacagggccggtcagaccgcatgtatgtgggcggtcagactgtcatggtccgagtccgagtctgttttcgtcgggtctcggttttcgttgctagggaaggctatatttcgtgtttccttgtgtctctgtcctgaattggacgtggactaggcctgtagagggcaagaccaacccctatttaaaggacaaggccggttcattgtaaacccccgaatacaatctatttgaatcgttcttttaccatgttttctatattagcctagttttagtccatctttgtcgatttgtgccgtaaatcgtctgccgccgcagcgagagtgcgacacctctttgtagatttgtcctgaaaaccttctgttttgcccacgagatgggcagttatcctcatatcaatctaaattggcctagaggctgattttgatctctaaattggctccgctagccaatttagctgtttttctacaaaacccatcttgatttggccgtttggctagatcgaggtggttggcgactacatatcactgcaaggcgtttaggtgttgcgattgtgcttgtcgagttgtcacaaaaagttgccaacaccaaccccttgcttatggtaggttaggagttcttaatttagagtatataggttgggctcttcggattcgttggctctggttgtagaagacaaacaatacatggacttcgcatggattacaggaacaagtgtctgcgcattgcgtgagttattcaatatagcagtagagacatgtatcggggatggacaacctaatttggtttgaacggatagtgtcgaaacatgaatttggcaataataaaagggggtagcgcacgagacctaaaagtggatggatgcggagacaaaggatttagacagattcaggccctctcaatgagaggtaataccctactcctgtttggggatttgaatccgtcgggtgtagtatagatctgacgatcatatgtgctcatgccccctagaggacctcctgcccaccttatataagatgggggacaggattacaagatagaaaccttaaccaatacggtattggtttcctaaatctattttacaatattattaaatcagaactttaggccgctccataatataaaaggaaacataatacccaagtcatgatctgttacatattccatagatataagctatcccctatgactagttggataaccatgccgtgtgggtatggggtacctataatctccacagtagcccctgagaccttcacagtcaaaaagataatcttctctcgaactagattacaccaaagccgaatgcttcaatcatctttgccatggtctcccgagtacttttaccaaatctgaagactgtagagggctgaaaaataaagtcaggtacatcgactagatgcacctaataggtgtagcccccaactatgtggttaattgaacaaactaagcatatagtcaaggaataaataatccaaccaactgagtggtttttgataattatagtcaaccaagtaacttgatatcaatatatagcatatgcggtgtgaatccccgaataacatgatcccagtgatatatcgactgctttgtaaaatatgatgcgtgcaacctaaagttgactacatcattgaaaattcacatagcaaaacagctataaaatgacttgaatgctgtgaataaagagatttccaaagtattagacacacaccaggcgcatactgctttaacagatgtgcttaaatccctaaaagacacatggtttcgccacacctggaaatatgacatatgtggtgtaaaatccgagtaaatgaactcataaggatttaccaaccgcctggaaaatgaccataatatacaatcagcctaagccataatattggtcaataaaaatgcacacttacgtggcaaaaagcaacgatattgtatccaatcaattgcttaaaaacccaaacagcaccttgacttatataaaaaagtcagcggggtagctatataaagatttactgtttgacaccttttaagatgcatattgtaccaactcctaaaaagttgagtaactgcggtataaaaggatttttaggtattgggcacttgatcacgcacactttggcctaagcaaaaagtgcgtaagtccctaaaagaacgtgataggccacacttgaaaatgtgggctgcagacatattaggcctaggccaaaaaatatgccttcgacaccctttaaaggatgacgcatgtaaaatgctcccgagtaataaatctcccgggtgatatagaccaagtgtagctcatatgaatagcttctgatatgagtgattatcccttatgggatactccaaaatagatataacaattgaatcccgactggcacaagtattcggttgataacccttacgggtaataataaatagtctagtctttgagcatagaaaatagacccatatcatgaattcatgttgcatgtatccggaacaagtctaaattgaaggtatgatacttgtgtttgagctagtaagcccctgagcatatagcttgtccttctgtcgtagtcacaattgtccattgatggtagctgacgcagttgtcatagagataagatggtagtgaagatagtgataccaatcaaaattgacgaagttgcaagccgtggaagcgaagaaaccagtcggcagcagtcaggtcagccagcaatgaatatgaaggcgaccagcaataaagttgggtagccatggcagcgaaataattagtcggtgacaacgaggttgctggtgaagaagatgaagatgcccattagtggcgacataataagccatccgtgaaggcgaaataacaagctggcaatgatggaagcaaccggaggcgaagatgtagtcatccattagcaacggcacagatgtcagggccgatgaagtagaggtgctggtgatgaagtcagtgacaataatccatcaaactgttgagaagatatcaaagctcaagtaattttcttgatgtgtgcataaggaagattgatgcaacaccccttgatttgtaaagatggtagtagaacttgatgttatagctgttgcagatactccacttggaggaaagtaaatgttgttgcccaactcatcgaaactgagctgattggttgataactctaaactcccggacatgtagatagaatctcaaacttgatatttgagaaatttggagtagattgtgacggcatggagaagccaaaattgccggtgaaataattggagttgctgaagtaaaatgtcggctttgaagcgaagacgaaaataataactcccagagttgactcgttggttgattaattgattgattcggtttgtcaaattttgagtcttgtatctgtgtagcccccgactctttggttagttgagaaacaactgaacatagagtcaagaactgtagcttcttgtcgtcgagtagccatcacttgagtgaagatcgagatgtcgaggctcttggagacgtcgtagttggtgaagtagcaaagcttacaaagtagaggcaatagagtttgccggtgccgaagacaatgaagatgaagtagctccaccatggtgacaaagttgcataaccgtgatgacgttagcaagagtcggcggcaacagaagcaaaccggtggccaagacatgtagttcatcgtcggctactgtggagataaaaacaccagtcggtgacggaagaagtagaatgatgacgaaaatgaagacgtccttgaacgacgtcagaataggccagccgtgaaagtgaagacgccatttgcggcggcaaaggcgaaccggcaatgacgatgacgccagtcaatgatgacgaagacgcgcagccatggaggcgaacaaaccagtcggcgtcagacaaggcggccggcaatgaagacgatgacgtccatcagtagtggtagcggcataaaccagccgtagaggcaagggcactagccagcaacagacgagatgaccgacggtgaagacgaaaaggccaatcaacactggcagaatcatgcagccatggaggtgaagaaaccagtcggtagtagacgcagacagcttgcgttgaagatgatgacgcctattagcggtggtggcgacgtggccagccgtgaagacgatagcaccagttggcagcggcgaaggcaagccggtcggtgaagacgaagacgcccaacaatggcggcagaataggccagccgtgcaggcggagacaccagtcggcgacagcaaaggcaagcctgtcggtgaagacatagacgcccaacaacggcggcataacaggccagccgacggtgaagacgtagatgcccaacaacggcggcataataggccagccggcggtgaagacgtagtcgcccaacaacagcggcacaataggccagcgtgcaggcgaagacaccattcggtggcggcgaaggcaagccggtcgatgaaaacgaagacgcataacaacggcggcataataggccagccgtgtaggcggagacaccagtcggcggcggcgaaggcaagccggtcggtgaagacgaagacgcccaacgacggtggcataataggccagccgtgcaggcagagataccagtcggcggcggcgaaggcaagccggtggtgatgttctgactgatccattcatgaagcgtaggatgtaagcttaaagcaatgaatcccttttatgcatatctggatctggatcctacagaacaaacatatatgggatgagtagtatttaatgtatatataatactcgagaaaaattcaagtattttaaaatattaataaatatgtatttctcctctagtcaatcttgatttcctcgagcagatgattccgtacgtttaaacactctgtctgactagtcatagcccccaaccatcgggagtcagcctaggcacttcccaaacatgcatatgagtgacatgagttcgtcattaatggaacaaagtttcacgaatcagaatttactactcgggtacttttgcaattgtaaagagcagaaaataaatttatcttatctctatgcttttgatttattccgaatagtacttatgtcacgtcctgataaattcatcccgaaataaaaatcattccctaaaaggaataatagaattaattaaaattcgaaaagaaattgacaaacactaaaatacgtgtcagaaaaattcgaatgtggtccggagaatttttattaaattctctttggtctaaaaggagccctcaaattttacttgaattttcagagcaccgaaaatatttattaaagaacaacaacaattaacaaagtttattaaaaagaaaaagctaaaaataatccccctcctccctttgggccaagtctggcccaaagtctacctctctccccctcggcccgcagtcccagtccctctcccctccctttgtttttctctctttcatcccgggcagcccactccctcctcctccttcctcccggcctgcctcggcccagcagcccggcccaagccaggccgagccgagccagccgcgtgcacgcgcgccgcgcgtgcgctgactgcgcgcgctgaccgcgtggggcccacgcgccggtcgtcttcctcctcccgcacggcctcctctctctcccgtgaaaaccctagttcgttcctccctcgaatccgcgcgatttaagcgttggattccaaaattaattggggggaattaatcccctttccttcctctcccttttccccctaatctccccttcaatcatgcactattttgaccggaacggctgcgccattcatggccgccttccatggccgccgggcgccttttccgccgccgttccctgctcctcccatgctcggctcgcttccctccgctataaaacggaacccccttgctccattctctcgttttagccccctcctgcgccctccccgtggctgcaccacctctccccgcctcctccttctctttcctcggtgccggccaccctccagccgcccctaccgccttgcccgagcgccggtcggccatgccggcgcctcctccagcgtcgcagccgcctcctctgcgccggcctgccctctgttgcccgtggagacctccggaagtgcatccccgccggcaacagtggcgttaccgccactgttccgtcttcggccagctgctgttcatcgctggtacgccgaccgacgtcgccatctcctccgtcgacgtcgcagccgcctcctctcccccggtcagccctccgtttcgcggggaaaccaccggagacgtgtcctcgccggcaaaacagtggcgttgccgccactgtaccgcctccagccgcctgtgccgccttgccggtgcagcgactgtcgtcatcgccatcttccctcgacgtcgccgcgtcgccctccaccccggcctgccctcggtttcgccggaacgccgtcgcccgcatcggtcttgccctccgcctcgccggagttccttcggcaaccccttccgccgtgcctgtgcgccggccgacgtcgccatctcctcctccggcatcgcagcgtcaaggttgccctcggcctcgcctcccctccatccaaaccccgccggtgttcgttatcgtcggctccgttcgtcctcgttgacgactcctccggtcggtcgttcgtcctcgccggatcatcgtctcgctgcgccgccaccctcgtcgtcatcgtagcggagtgttccacgccgtcctcgtctccgtgcagctgctgccggctgcctcatcacctccttgccggttcttgtcgtcgtcctctcgtcgttcccggtcgtcgtggcgttcgtccctctgtcaagccgttctcgtccgtcgtccgcgtccgtcaagtgtgccgctgcagccccgtcgtcgtcttcgtcctcgcctccgcttctccaagcattgcgccggctacgtctcgccttcgtccagggatcgccgccgaagtcgtcccctcgcctttcgtctccgtcattcccggccatctccgccgcgcccgttcgttgttgtcgttccctcgcctcgtcacgtggtggtaaggatctctccttcgctgccccgtcctcgtcctttcggtgtcgcccgtgcccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacgggatctgcttccgtcgacccgtggaccgtctctgtgtactcggtctaccgcggtcctttaggttgacatgtggggtccgcatgtcaacggcgcaaccttcctgtcttttctaggctagcgcttacacatgttttatagttgcaaaacctaattataataatccgcaaatctccatgtaacagcattaaacttcgaatgatcatatcttggtcatacgagctccgaattgatccgttgaagtctcctaatgtttgttataacctaaagaaccctgtgctttctttttatgtattgttattgcttctttataggcttgtagctttgcttgtgtgcttcgcgtagtcttcatcattccggaggttcccgaagcgtggtttgcggtcgtcgccgaaggtttggaaggccgttatctctgagcaaggcaagtcacatcatccttgagaatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactcgtgggtactctattcatggttccactagtatgaatttaggtagatgcttcactgattaattaggcaacattaggtggttttataactttagactttgggaattctcatatcatttggacactatggaatggttggcttatgttggaattggacacacacctccccctctattcaaaactcccaaaatggttttaggctgggctcgaggtgcgtggttgggttttgttagtcgtacctcgggtactgtaaggattaagctcgggcctctgttgcaaagcactaccgtacttccacatatctagtgggtaaggcttagtttgtggctcagtctagttataaacaaaagtacacggatggagatggacgaagtcgggggtcgatggacatctctaggacaaatgaaggctacacgagctgcggcccggtagttgagatgtcatggcacagggctggtgtcctgctgctaggggctcaatcctgccagcctgtcccggaggttccgggcgtaggtggggttggctcggtactcttgtttatggctaggatgggttggtaactatgtcacgtcttccgtccgtataccgtggtggcatgtggcacgtggttacacgtgaggaagatgtgtcttatgggtaaagatgtacacctctgatcagagtataacctattcgaatagccgcaccctcggttatgggcaagcctagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacgtccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctgaatctttcccccccttcaataagagaagctttggagaagaagtcttaggtggagtcctggcttatacgccagttgagcgcctatgaagatggagccgtaggtccgctagtctgctgctgtttatttttgattgtcaggcattaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacaacttagcaccttgcgttactcggtccatccaacgagcccccgggtgctaggaatcggcccaaaggcaactatccatcgacaaaccaaacggaaagcataggaagatagaactccataactcgataggcacttttgtactcagattatgtcgcaagcaatcaagataaatattatgaaaattgtttaaaaaatatgatataacatctgtagcccccgactcactagtcaacggtgaaccagttgatgtagtgagctaggcagaggaaaaggaaaatgtcatataaagaagaaaattaatgatgacttagctttttggtctttcccttggtgacggcagatgtcacgaccggaattaacccaacgggcgttccttacgtgcgtgtattaatccttgtcccaggaggcaaggtacaccaaaagttgatacaattcagagtttaacaagcggaagcgtaaatagttaattattacatgggcggcgaaggcccagcacacacaaaaacaaacgggaaacagcggaagactagggcgacgaccacaggcgcttgacggcaggcacgagctagacaccaaagccttcatcttccaggggctcctcttctggctttgggaaaaaattgagcaagactgagtacaaccaccgtactcaacaagacacacccacaagtgcaggataaatgcaagggagtacaagggggttataacataaagggttagggtttgcaataaacagcattaaaagacacttagttgctcaaagctattttgtatacacgattccagagctatacaatattattaatcaaggccatgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaacagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtcattatacggccgaggtgctactatcaaaaccatgcaccccgagcccagcctaaaaccattttgaggattttgaatagagggggaggtgtgaatccaattccacaataatccatccattccatagtgtccaggtgatgagaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacctccacgaagagcggatcttctaataaactccatataacaagcaggaacaaagtacaaaaatgggttcttgacttcttaaggaaaaattagagacttgaacggtccaattccgagttcaaatggccaagttatggccatttgaagtttatatgctctttaaatgaatatttacgaatttcttcatttaaattttaatttaaaaaaaaatggatttattgcgttagccggggagagggcgcgcggaccgggtccacgggagtgggacccacgcggcagtctcacggtccacggtggaccgagtgcacctggctcacaccggccggcgccgtgggccccacgcgtcagccgcacccgagggcgcgggcggctgacggccgggccccacgcggcagccgctatgtcacgtcctgataaattcatcccgaaat

SEQ ID NO: 61315 - DNA, 2358 bp, Oryza sativa
aaataaaggttcaggaccacaccttactccctgaagacctattatcccctcggtgtgcagcagatgtctgcagaaagcataaacattattaagatagtagaaataattaggatagaagatcaaggtccagtaggaggcattcttccagcgttaaccgcacataaccacaacagaagatcccgcaaaaaagggcaacacaaggaagatgacaaaaatgaactaatgacattattattcatttgtacatacacaggagcatgatcgattagtgcagtcttgtttttacagagggtagaacacagttgtaacatagtaacatattgatggcagatcttgaaacttgaaagcaggtcaagttgagctattagaaatgctataaaagtatgttaaacatgagaaatatattatatttgaagatcgagctgtactactttgagaaaatctattcatctgagggttaaaaaaatagcccagtttataaaaatgacctaaagggccgcaccagctaaatacaattgaacagcttgccatgggcttagaaaggtactagtatatgaaaagaaggtatattgctcgacaaatttattggttgatgtgcgatatttggttatgatttaaaggagttcattggctgaaatgtgatactgttaaaggctagataggaaataattatttcttttgagatataaggaagtaatgtgacatgggcaccacaaaacactaaattgtgcctaaaattgatgcccagctaatttcagcaaatcttgatttacagcgtgatcagttgcctacctcaacgtacgatcttgaaaatgatccaggtgtagcttcattatgtgttgacgcaaatgaaggcctccctgctcaaacaagcagctaatggttgggaaaagtagggtaacaccagagacacaccaggcgcgcgcgcacaaagagagagagagagagagagagagagagagcaggaaggaacttgaagttttactgacctgagccaaaatcactgtttggcacaccatacatattagtttgctacaaaaagggaaatgagtcagatattcctgttatcttgatcacgttattggagtggaaaaggaacaatgtacaacacacctgagaggctctccatggagtgttaactggccctaaaagtcgcaaacaatatggtgagactcatagttatcagggttaataattacattcaatcgtaaaatgaagtgatgccaaacaatagaagaaaaataaagaatgctttcggtaataggcaaaggtagcatttatagtctcctgccagtatggttgcagcatacctagggaaagtatgtagtgcaaaccacatatgtagtggaaatctggaaactgccgttggatcgaaaaatagatgtacgagattcgtccatgacaccaaataaaatttctactcatgagtaaatctgcgagtaaaatttttactcgtgatgacatggacaaatctcagacgtctattttcaatccaacagtagtttccgggtttccactacatatgtggtttccaccatatatttttccgcatacctaggctaaccttgcaatgcgattgtatgcaaagaaacaagcacttaactataaaatgatggagaaattaggtactgaccattccttgcagcagaaggggcatgctcttccaatgcccggtactgagaaaacctatcttccctggtaatatttatagaatccctgctatggttcagagactcacataaggatttcaattcttttgcttgggaatctagtgcttgtgttaatgtcacaagtatcttcttttctgtcaacaaacatgcaataatcagaatgagtgatataagaaaatatataaaatatgaagtatgtttagatgaattgggatagccaacaacaaaggggagcactgtgaaaccttcatcctttgaagcaagcaattcttggttagttttggcaatagcagaaacagcagatgcagaagcttttacagcttcagcagtttcctctcgatcttggacttaatttgcctgccctcgttttcatcaccttcagctacgaccttgcggatccaagacttaagcctaggaaggagcaatttctatgcaagacatgcaaatttgatttatggatgaatcagtgagttgaaaagtttcagatatgtggagaggtgagcagaagataccttgacaaacacagcagcactaactccaaaaccaagcaatagccctgcagcgacaatgcacggtaccagctgaacttgggctgtgtggcaacaataatagagccagcaggtgttgctggttgccttggtgcataaggttgcacaacggtagaagagtggttctggttgttggctgc

SEQ ID NO: 61316 - DNA, 6362 bp, Oryza sativa
ccaattacataattgaatgaagaccaagcgtgccagattgtacatgaggccaatgttttgtttttatatatgcacagcagtaaaaggccaaagttaggccctgcttagtttcaggggtgaaaagttttggcgtatcaccttaaatatatggacacacatttgaagtattaaatgtagtataacaaaacaaaatacatatttctcctgtaaactgcgagatgaatttattaagcctaattaatccgtcattagcaaatgtttattgtagcaccacattgtcaaatcatggcgtaattacgcttaaaagattcgtctcgcaatttacacaatctatagttctttttatatatttaatactttatatatgtgtgcaaacatttgatgtgacatgatgaaatgtttttttatgggaattaaacagggccttacattagtactcctgtttgctaagaagtgtacgtaccagacggaccgttttagatctttgattttgtctcaatctattactccctccgtttcaccctccgtttcaggctataatatgttttgattttagtcaaaagttaaactattcaaatttaactaagtttatgcacaaatatagtaatatttataatatcaaattagtttcattaaatcaataattggatatatttttataactaatttggggtgagttgaaaatattattattggtttttataaatttagacaaacttaaaataatttgactctaaccaaaacctttaacctaaccaaagtctttaacctaaaacggagaaggaagtagggtggagtaagtcttatctctaacttgctcttaagaaaaaggtgacacgtacgagtcgtccataaaacacgatggttggacttggaatagtataataataatgccagccatgcatgcataagcgctgacgaaacctcaattaggccacgttcgaatctcattgagacgaagatttttctagattttcgttagcatatatttcaaaccattagatagtatgtttcgtacaaaatttatatatatatatatgagttgctttaaaatattaaacaaatttatattttaagtttaaaataattaaaacttaattaattattatatgttatttttttccttgcacaaacttaggcctagtcctccgttcttttcttctctggcacatgttcttaaaaaagctgaaagatctctgccacatatcgttagaaaaactgaaaaatgcagtatgatgagatcaatttcgcgatctatctatctggcgcagtagcatcgacatctatctacgttttgcacttctgatgaaaaagtcaatgcatgtatgcattgagacgagttaggtgcagggctgcaggccgggttgctcaagtggcattaattaacaccagccaggcagccacctttgattgaatattcgaatttgactttgaccattaacgaatcatatgcaattagtaacttccatacaaaactttctctattctaaaaactgtcaaagtaattttggctcatgtgccggttttccgattgatttcaggaatctattgtcacacctagaaattctcgaaccagaatttctaagctgaatgtgcattaaatccctgtccaggaccagccaggatacacaaacgacaattgttgacatacagacccacgtcttacaaaaatataaaagattacaaatgcaacggaaaagataaaagcgagctaaaccgggaagcttgacttcagcagcgggcgactccactccacaggcaaaccttgacggcagcgacgaaaccaacctctctgagacggctccaactgagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctctagtaattaatcaatattaaccaatcactgtccaacgctacaccatgttgcaacaggcccaaccaaccacctgaactacaccagttcattaagctaaactaggggtgagactaatcacggtgaatttggttgatcgcccataaccgcgggcacggctattcgaatagttttactctggccagaggtgtacaactgtacccacaagacaccattccacacatgtcgccatgccccgaagtatcaccatgatactgcaaagggggaaatcgtgacaagaccctccacataactctcccctaaccatccacaccacgctaaggtttcacccccacccctcaaaaggtagtgggcggtcccctcttgcgccgcggtgaatccggcagctggacaaccgaacacctcggccgacccaactccatcacgcccaccctcgccaccggtgcctcggaaagggtcaagctatacttcagatcaagcagttacccactcccgcttgtggtaagcacagtaagtctcccagggtttcccgtgaaccggtccttaactgccatgggtgcgaccagcaaaaccatgcacccacagcccaccattcagtgcattttaattagctaacaccattgcggtggcaccaatccaaaactatgctaatagacaaagtctatgtaataaggtgatccctttttgtgtactagttgagctaagcatggctaagcatttcctaaaccaacatctaattatattgatacccaggttatcaatggcatgtggtaaacaataaaaggctgagtaataggacccatcccatatgacattgtaaaagaatgcaacatttaatagaaatgcgggacatttgtaaattgggtacaatttgatcaattgtaatgcatgacttgccttgctctcgcactgatgagaccacatcaacgtcttcgagaaaccgcggatcgacgaaacagtcgaaacctacgcgacaaacaaagcacacaagcaaaacatgcatttttcttgatttactgagacttgaatggacttaaacggagctcggatgaattacttatgaattttagaagataaactgtgtttttattaataaagaaaaagtccttaattaattattgcgcaataatacccagggctaacgtcatccaggggggcggcgccgacaggcggggcccacgggtcagcggctcaaaggggagaggaagggggcgccggcatgtgggccccacgggcagtggctcaaggtggccggtctaccgtggaccgggaccacgcgggtggtccaccgccggtccacgggaccgacggtccggatcggccgggaggccgatcggacggcacggcggcggctaggcacggctcggctcggcttcaaaaccagccggccggccatggcaaccggcggcgacgcgcacggtcgccggcgacggcaatcggcggcgcgggaagcgacggcggacggggtacaggacagcggcgtcgaccgaaggcaacggcgagcgtgtggagagaggcggcgcaaacgagagagaggggaagagggaggagggggatcctcaccggcgagtatggcggccggagcggaggatgaaggtggcggcgacgacccggcgatgaggaggggcggacgggcggcggcggcacctacggagggagttgagaaggattaggagtagagagagtgaccacggcggccaccattgttggccggagacgaaggagaatggatagctcaccggcgtgcgaggagaaccgggctccggtggggtttagtggaaactgagcagcggccgaggtggctcacgcggcggcaatgctaatggcggcggcggcttggcgtggcggcggctctagcggctgcggcgcgcgaccggaggtggcggcaagcggcagcgctagtggcgagcggcgcggcggcggtaggaggcacgggagagcgcggcgaaaaggggaaaagggagagggagatgcggggaaattttataggggctcgagaggggcggacatggccgggaaaccccccgatttggccgccgacgtggggggagagagagagagagtgggggggattcaaatcgaatctcgcccatttgcgggcgcgcgcgcgggcgggaatggcagggagggcggcgacgtggggactcggagcgggggcgcggcgtggagcgaagaaggcggcggcgcggacggtttcggcggtggttgccgtcgtggggcgagcggctggaggaaggggacgacctgacaggtgggccccacctgtcagcgtcccggagagaggggaaaggggaacgggccggcccaaaggaaggaggccgagcgcgggagggagtgggtcgacggcccaatagagaaaaaagaaggaaaagaaaaagaaaaagaggaaaggatttttcctgggatttaaaattgcactttggtgatttttaattggttaaaattatttccaaggctctgaaaattccactaaaaatcttgttaatgcattggagcatggggaactcaagaaaaattccaccacgctatttccgattattaattgcatttattaattagggatttagctctaggttaattaagataatttcttcgggcaatttatttaaccaatttttaaagcaagaaaaggggggaaacttcagggtgtgacatctatccatattttatttgacagtagcaaaatttatgagatacttaggccctgtttagattctaacttttttcttcaaactttcaacttttccgtcacattgaactttcctacacaccttttctgtcatatcgtttcaatttcttcaaacttccaattttaacgtggaactaaacacagctttactatgttccatattcatcattatataagcttttcattaagataaaggaagccttaacttcctcacatttcatttaatgtaagtacgaggtgaagaaaaatcaagaaacatgtagacttttaactccccatacacaagaaataataagagttttactaccctcttttgatatgagtaactagatcctgatcaaatgatatgtattgataagttgattgtggagaactcaacgttgatgattcaaaaggttccggccagaacgattgatcccctctcaatcactacaacactgctctattggttatcaatcgtaccgaaatgcggttgacatcgtcaagtaggttatctcctgcaagcgaatcgagagcacaagcaagagagtagaaaaaacaatatgaatatatggcaaatattgaagccatataccaaactaagcagcgaaattgcaatagcagaataatctaagcaaagccctcctaattcattaatttttaaataaataggttctagggtcgaccaaggacccctagacgcgtacataatagatttcaacacgatacatgggccgatgacccaaaagatagtgacaacccacctggacaaattctagacaccaacttgttttgacgatttttgttgacttggaaggaatttctacgtaagatcaggtccattggaaggtagtctaattagctttccatgtatgcatagaacgtcgaaaactaagtccgaatgagatctggacaatgattttaatgcatactactcctagatctcgaggtgggcttgaacttgatttgaattggatctccatctcctagcctctttccaagtacttcttgattctcccactttcatatacaaaagagtgatggtctcatcaaatttttaattttttatatgataatcaatatggaacagaggaactaggcggagctagaatgaaatgaagaagaatgccacttgcttaatttactctattttaaatcacgtttaagcagatgcgggtgcctaaatttatattgtgggggcaccacctcccattctctacctccgccctagagaggaagtaatatggtttagctaaatttatctcgatagacttttgttcctattacagtcgatttttcagccactctccatttttttcctttcactacaaaaatgcccacgcgttgcaacggataaaagcatttttggatcgcatacattatactctttgctttgggctaaaagctcatttattccttccttttcagtcccagcctagcccgttaccttcctctgattagtctatctctctttgacctagcccacaagtggagctgtaggcccaattcgcatagccgactgccgtcatcaatttctagaagactcgcatagctgattgctgtcttcaatatctggaagacgtctcatgtcactataatgctagaaccgatcctcccatcaaatctgatcggatttttctcgatctcaccagattgagggcttttgataccctcgatctgctctttccgtttttatcaaataggagcaaa

SEQ ID NO: 61317 - DNA, 6853 bp, Oryza sativa
atctcatcttatgcgatggtagatatgcaattttcttggaagttgagaagccgaaaagtgtttttgtagcattcaaattaaaaaagagcaacccccataccgtaaaccgctcgtgcgccttccgccgccgccgcgcgcgccgtttcccccgccccccccacccacccaccccacacgccccgccggagctgtgccaaacggggcctttgtctcctctgctccttgcgccgccaagacgagtcgtggctgaacagaacactagaataggggaggggcggcgatctccatctggcgaggagagcagagcaggggaggggatcttggtgagcatccacatcctctttctgattcatctctctcccatcgggactacttttttctggaatttgcttgcgttcgttcgttaaccctagcttctcttctagatctggatattgtcaagaatcagctttcccttgcggatggcattgaagtttctagcttctcaaagttccaagaccttggtgctaattcattagatactgtcagtcaactggataatatgtgttctcttttgaagtttttaatagccaaattcaactatttccgataaggtccaagttaacactcatttatgaatcttttcagagttacctgatactgctacataatgtactgctgtttacagggttcaaagttggtgttgagaagcacagcacagaggtcattgtgaaaaaaaaaatctggaagcctgcttataaattctggaatccaaggatactcgctactaaagacaactcaggtatttcttcaacttgcttctgtgattctcaggccatcggttacatgagtgctacagcatgtttatggtgaactttttgtcgtctctggttgagtttgcatggttttgtatggactactgttgtaatgcaccgtagtgacctagttgcaatgtaccagtataacatggaatgctgtggctgtttgtgttgaagctgagtgcctatctcttttccagattagatgctgtgaaaatgggttggttgggtggcgtcctcatattttggtgctcagattgacttttcttgtttgtgggtattatgtttgggatactggccaagggaaatggacagaaatatgctagctttagtggacagggcctgtcatcgtatttgtttattctattgttaccttaagtccttaacatatatgttcttctgttaaaaaatgctagcctctgattatgccttcagccctccatggccttgaagtgcctgttgtcctgttggattctgtacatttcttgtggtgtagtctggcagcatttcttttgtaatcaactcagatgcagagcctggcagcctgcacggcagcatatatatgcttctgcctctaaagaataaaactaacgcttaaacctggttaggcagtatgcttcttttcatactgtctttgttttatgctgtgtgcttcttttcttattcagtttggcagtgatcattgaactgtgtcgtttctgtacttaagcaccctcccttgccgccgtccgctaccatggctgaaatcgaaactatctccagcctcgccgacgccgacgatgtcctggaaaacagggggatcaatcaggttgaagggatcaatcaggttcaatttcgtctagacgagcagatatccctcgtagctgcaacagaagtcaaggtgaggacccgtcctggaaggctcggattcaggttgttaaatcctgaactcatggattgcaagttccaaacaaaggtcaagctggacgaggcctacgagcggatgttcacagagtgtatgattgagtgtgaccaagagctcgtccctctcgaggcccacatcgccgagctgaagagactgttgctgctgcccaacaacgagattgaagatatcggacccgatattatgcagaggggtcgaggattgcagcaggtgctgtatctgcatccaccggtataactctcttttcatgctctccccctcttttctaaatcgtttttcagtttgtgttttttttttcagttctctctttttctgaatattatttttttcccagtttcctttgtatcctgagtacgagtatcatcctcctccgcaaccgcaaataccgtaccaaccagcatatgccactgctaaagaaagagagaatgcaagatctcgagaccgccgtgctcagagagcgtggtggcatgccaaccttactcttctggagactaagaaaaagatcttggaagggaaaagaatagacctggagagagggctgaggtctgaaatgaggaaagctttggagagtcaatctgacctgggggccggttataccaactaccattttcgccatagataggtaagcctttgtgtgtttcttcttagatctgttggtcttcaatcttcacttcttagaatcaaatcgaatggatggatggagggatgaactgggtggcggttcttgggcatggcttctgctttcgattgaattgttttttggattagggcctgcggattttaggatgtttatgtatatgatgaattatttgatttgagtgatataaaacactatgaattttaggataaagggtcctgtgttttcaatttgctcagcagtatgatcagtggcttgggaagcgaagctggccatgctgttgtcaggtgtcccttgcagatatctgctgcaggtaatgagacaaaaaattaggtgttcagattaggaacaatgtaggaccgttgaaccagagttgtaatttcagaaaataggcgctcaaacatgatgcatctatacttagttagagcccctgctaaccactattaccgatgctttagataaatgctgctgctattttttttcattgggatctattccgcgactgttttagtaattctactaattgaattgaaatttcccaaaagcaatccttctgttaagcttggttggactgaatagcagttttaccttggccatcagtgctcactttgagttgtcagataatgaatagctcatcactgatttttttttcagaaaaaaggtgctcatatatgcatgcatagatctctagaaaaaacggctggataatgaatagctcatcactttcctgttgatttgatgcaggggaggaataagctggttggatgcatgatcaatgggaaatcatgtttagttttctccctagatcatgatgctttgaactcaagccctgtttggattcagctataacaagttttgttgtgcaagtagtcacgtgatgtaacaagttttgcctcatgttacagattttgtaaggatgcttctctggtagcaatttaatatcatgttacagatttgcatacttcagttgaggtagatgtgagaggcgacgtcttgaattcaaattgtagcaatttttcagttgaggtagatgtgagaggcgacgtcttgaactaaagcagcctggtttgagcacctgcaaacaaaaccacacctccggttgtcgatcaatcagcttctagatttgccaaaattaatatatgaaaatcttgcaatggtcgagcacgtttaatacacgtctaataaaaccattttctatatacagacttagaacatattgtttttctcaattttatcaaaattatctaattgattgttgtggtttgtcagatacacattaaaacaaaaccctgctgaaattatctgaacttcgcattttaactccacctgctgaatcacggtaaaacaaaaacatttttttctctgaaccttgatgttcatcgccaaagttgggttaggcagtatccaacacatgggcctaaattatccctttaggcaatatacatacatatatacatatgaggtagtgtaagacaaaaacattttttctctgaaccttgatgtttatcgccaaagttgggttaggcagtatcaaacatatgggcctaaattgtccctttaggcaatatacatacatatgaggtagtgtaagagataaaggaatttggagagcaacaatatttacagtgctctgctgtctaaacaaatcgttccctgcttcaattatcttgagacatgtggtctatactccgtccatttcaataatcttgagacatgttgtctataatcagtccattacaatgctctccagtctaaacaggtgaaatggattgaagccataactcctactacgagtatatgaaataagagtattaacaatgtatatatttcttaccaacaatattgtagatatgcaataccagcatgacggcgtaggcagcgccgttgtaggacacgacgtcgacggagcactcaaagtagaccggggccaccggcgtcggctccggcgcgccacccaccccgacgccgccgtgagcagagagagaagagcggggaggacaccggcgccggctccgacaccgccacccgacctaacgtcgccgccagggaagggagaaaaaggggtagagggcagtgggcgccggctccgatgccgccgcgaggggaaggagaagaggggaggggtgcacgcgacgtcccgtgcaagggcggcggacaatgaaggagaagatggtgccgcacccgttggcctccgccgctccgtcgctagcgcctatggtggtcatcctcctccgtcgcgccgtcttctccaatcgccagatccgacggcggcgttagatctagccgcgggcgtagccaccgcgccagatcgggaggggagggccgccgctgccacctccctcccccctcccgacagagccgccgctcgtccaccctccaagccgcctccgccctccacctccgctggatttgggaggagggaggggagccgccgctggatccacccttcgcgtagccatagcctagagccgctgccgccacaggccttcggtcgaatccgcgccgagagatgagaggtgggatgggaaggggggtttagtgtaggacgttttgcagaaaaccccctatggcttttacgtttacaacgctacctctggaagcggaatttttgtatttttcatggaatacaagaggttatacgtaataaatacaacgtgatgtcaggtatatgtgatattatgtgtaaacacgagttttttgcaagacccccacaacgcccaaaatttcgtttgaccggttacagcttacgagcagtcaacgtgtaaagcaacgagatagccaaaaaaaattcgaaaaacggagaaaaaaggaatggttaggctggtaattggctgatgatatgtaaataaggaatggttaggctggtaattggcttatgatatgtaaatcactttgttgcaacgcactaacattatttctagtaatttaaaagaaaaattgttttaaatatcagtgtggattgtagagtgaactttggagataatagggtttcgcggcccggacaaaggaggcagtagggtgcccgaggcggcagacatacggatcgggagcaaaaccacatactacgtcaacacaggaaaacttttataaagcgcggcaccggtgacatttgcagcagctgcaacacagcatagatatgacatgatattataccatgggctgtcaagaccagcttcttagcacatctcacaagtgcaaggcaatgctcaatctcacaagtgcaacatcatgaacatgcgcgtatcagatagcacccaagaaaaataggataacatgcaaaactatattaacaggagtgacaagttagtgtagccagtacaattaacctgaataaatgcattctcatgatacatatgtacacaattttaggccattaagagaactcacggttgccacacacttcagcatttaccagagtatcccatctattattccaaaggtacagttgtctgaaattttggaatattaaggttcacatggcagttttcgaagcacgtcagcatctcggatttgatacagcggctgcaaaccagaaacatcacaaatatcgttttaaattaacagcagtcatgcctgtagagacattgcattcagtaaacgtggatgtagatgctcagattcaagggtctttttcttttattgttggcaaaaatcaagatgcatggtgtgcagtggtgactgatgctagttaagtttcaagatgctcacgtttgatgggagcaaactaagtgcaacctacatatagagtatagatgagacagcggcgtgtataactgatcaaaagcagcatataagtaactttaccagatatgatgactgactacaatataaagatgcatgtgaaggttactaaacatgaagctcataatgacaatctaataaagctaaaagattaccagaatttcgccgcttaaccctagggccttgatagaaatctatggaatcgctgtacttttacagcataagctttcacaaaatccgccttttcaggtatggttccactagatgaaactctcctctttcttatatgaaataagaaatcttcagtatcaaggacataggaaacctgcaaataagatattgagcattacaaaatacaacattaaaatggtcaaaatggtatcatgatcaatcaaaagggttctgctagatacaatgttaacttgcaatggggcacaaaattctcgctaaaattatgagtacctttgaggatttgcaggatatcttgcattcaagaccattagtaaccatgaaagcatcaatggccttcaaagaagcttgagagtcatcgtttcccccacgcttccgtttattcctgggaaatgatgtccaacaatgaaaatagccgtggaaagtaaaattgagactccaacataagatcaggaaagtacctcccaaggaagatatcgtcatacaatttagtattagaaatacttgacagatactcattatatagataagacgaaaaatttggatcaattgacactgcagttactt

SEQ ID NO: 61318 - DNA, 11248 bp, Oryza sativa
atgagcgtaaatatttgtactttgctttagaaaaaagtacttagctagtagtaattcagtccacaattccagttgatagaataataagaatataaggtgcatgactatactgcgagccaattattagcgtggtcggtgcaacacggagccgttgcgcccaagtgatcgatggcacgggctggcggcacgccccttgcggtgggcgcgcgcgcacggccggctgctcggctgctcctagcgccgtacatagccgggaagagaggccgtgtgccgtgacgcgcgcgagctcgcggtagcggggggagagccccactggccagccacgtgcaaaccccaggcccccccgcggtgccgggggtggggtgcgagggacgcaaatccctcgggatcgttcacgcccattttgttatacactcccctctcgatcgatgcgtcgcgtgcggcgtaccgtcgttcgacgggtacgctgtgggaaccgcgatttcctcacacgcggttaggctctcgcgacgcaaccgcgcatcacggccaccggaccacgacgcgcgcgcgcgcgcacccgctcgatcgcaagttaatttttgcaaccagatccagctgcatagcgggttggcgcgctttgggacttgggatacgcgcgcccgggttacttgcacatgtgcatgcgagtttgcgacgcatagaatcgggccgacctgtatgcagtgtgaatatgtaatttagtttggggtttaagaaagagattagggagctcccaactgattacgtacccctaacaagccgagattgtgtgcagtatagtctctcttaagttgctacagtagtcgtgtcatgtcatcgcataatgatgccacaaccaatgtgctcctgatcgaaggacgttgcttccaccgtttcgggcccctttgaatcacaggaatgaaaaaacagaggaatagaaaaaacgtaggatttttgtaggaatggaaccgtaaaaacagaggattgcaaaacataggaaagttatgttactagccctttgaatgggtataggaatttcacaggaaagagagtgtcaggaatttcacaggaaagagagtgtcaggaatttcacaggaaagagagtgtcaggaagtgtattaatacatgtcactttggccttatccacaatatcgcaatatatattttcttctaaaagaacaacaatgatgcatatgtctgtcatttacctcgatcctacgcacacatgatggaaaaaagaggttagggtggatgttttctttcctatgttttccatgtgaaatgagttccaaaggaaaatttcctctaactttcctatgccctaatcctatgaatcaaaggctgctacagtgcctaatcctaaatcctatatttttcctatgaaattcctattaatcaaaggaggcattcacgtctaaattaaatgacagttctactgagaaatgacagtagtaaaaataaataaaaaaatctacgtccagcttacagtacgagaactgataggtgcaagcagacaacccaatggttcccgcattttatcgctccatgcacgtcgaaagaatttcgatgattctttccacggttagttggtgcatagtgatgcgtggcatggcggtgcccagcctgctacaacagggcctcatagctagccgaattattgttcttttttaccctgagggaaagctggctagccgaattggttcgataaagtgtctcgatacattttgaaaaacatacaaattttatattttagaataaataaagcatcagatcaatttgaatctctccataattacaatattgtttatgatactcatatggatatgtgtctttagtcgaatcatgagaaagtgttttcatcctctaagctgatatctccttgttttttatgtcatcaaaatagtgataacaaattgaaaaatgtttggtagatcaatatataaaatataacactccacaaacatacaaatttaaattcaacatactccctccattccataatataaggcacaaccacttttttagagattctataatatataaggtatgcatgtaggcatgcatgtaagcatgcaattaaccatgacatcttctccattaaattattattttttaaaatcatccactctcatgttacataatcctattggatgcatgcattatatttattaggatgatccaaactacaagacgataataattatttattggtatttgggttaaggtgattgtgccttatattttagaacggagggagtatacaaatagaaacacaattttatattgtataagttatttttgaacttacatatttgtaaagtgatatatctcatattgatctaccttaccatttttcaactttttaaataaattatgagtggcatgcacaaaacgggaggatattccctcaaggatggtatccacattcgaatcttgtgatacgactgcttaagttgtacttcctgtgttctacaatatagcaatatggtataggatgagaagtgtgctcgcgaaaaaaagtataggatgagaagtatccttagtataaatttattgtattagggtgtgtctaatcctatagtagattgttatatttgaaaagaaaacacttagtaggcatatctattcaaggaatggtttattaattgggtatcttcttttctttgatgatgacgattgttttgtgctcggggactccacagcaaaaccgggtcctatttatgtttgtttcccctgatccatcgaactaacaacggcgcccatgcatgcaaggtggtccaaagtacgtatagacaacagtacagtacagggctactgcaggctacacagacaacagcgagatgatgacagattgacgttttgacaggtcggtggccggtccctcgcccaatcatacctcgccaagacacacggccggacaagcgcgcactggtgtgcctggtggtgtgtactctgccgccctccatccgcccccctccccccgccacccgcacggcgcctctgcgacgtacggcacggcgcacgctcgaccgagtcttgcacggtgacatgcctgccatgccatcgccgcctactactactggtactgcctcgtaccatccgatgtctctctgcgtggcccagcctctctcgatcgcgatctgtcgtgtagggcagctagctggtcggagtggtttttgatggcgacagtgagtacattccgactccggccggacgtgtacaacgtttatttgatggacgtacgtaccggtcgacttgcgcggtgctgatcacccatgtggctcgttgaggtacgtcgtacgggcccggtggcatgcatgagcgttccttggccctaatcatacgcaattaagggggaacacggaccatcaaccacaaatttgacttgcttgcgcgagaaagcgatccagctgatgagatagctgcaacaagatgagctcgctctgacaaaagtaatgaggagctctaattttatatgttgaatttgaatttatgtgtttatggaacaacatatctcatattgatctgtcattcgattttaaaaatttgttaataactactactatttgactgtcatacaaaaataagggatatcccattaaggaataaaaagagtttctcaggtaaacgtaacaatgcatctagattaatctattaaatggaaaacaaataagattaaagttacatattttttaagagaatttattccataccactaagtttactctaattcaacgatttgtcatatactttacctccatttataatacaccattgactttgtcaaaaaaattacaatgtatcattgagtagatacttttaaggaaatgactaaaatacccttcaagtcatataagggttgacacttgattgacccactagtagttatttttttaaaaaaaaataaaattttgtgtgtgtatattttaagatatagaagtgtgtgtgtatattttaagattttctttcttgtttttttaaattattatgtagcatatatatgaaagaggtaaccccataaaaaagaattataaagcatatggatgatgatttatgtgaaaggacattaacacaagagtattctattagtacataaattataaattatatttccaaaaataataatacacgcgaaataaaaatcttgaaatatacacacttctatattatgtaaggaggctacataaaaaaatttcatgttttttggaaacttctactatatcaattaattgttatgcctttgtcggtgatatgggcccgggggtatcaggtttagagggaggaggctgccccccgatgccacgtagccctcctccgaggggagtcaggcccgaggtggggtggcggccactccttccctcaaagactagtcggaggaggctgccccccgatgccacgtggccctcccccgaggggagtcaggcccgaggtaagacggcggccactccttcccagagactggatggagcaggctgccctccaatgccacgtggccctcccccgaggggggtcgggcccgaggtagggcagcggccactccctggccgagactagagggagaaggccgccccaggcgccacgtggctccccccccccaggggggatcgggcccgaggtcgggcggcgaccgcccccctcccgtgactaggggtcgggctcccccgaccccctctctaggtcaccacatacggtgggttaggtgtccgcctccaggtacccacctacccgcatttatggcgtcccgagcagtcgcgccacgccgcatttaatgcggcgtgcagtgcactcaaccggtctgtgaccggtcgaatgaccgatgggactggctagtgcgcctgtgcgctgcttgtgtgtcaggcggcgtgcaacctgacatgtcccatcaaatagtgatggtgagaggttctcatcctcttatcccagccggagtcggtcctcctgctctggtcaaagtaaggctcccgtttcccggtgtaataggagcccagaagtcttcacccattaaatggtgactgacaggggcaccccccgtgtcaggcggcaagatttgacaggtcccatcatcaagatgacatgtgcttggctttccaagtcaagagacaagacatgcatttaatgcaaagattataatacttctccaccggagctaggttagattgttgggcccatgtggtaaccccttgaggtataaaaggaggtccaggcctagtgatggaggggggacttccgagcgaactggcgcttgggtctcacaaccccaaacacttgtgttctacattcaatcaatcatacacaggagtagggtattacgcttctcagtggcccgaacctgtataaatctcttttgtctcatcatcttggaggggcctaaccccctcaagatcacacagctccgctcaccaagccctcgaatctcacccactgcccccggccgaactcacaaaggggggcttcacggttccctggtggaggagttcattctccgacagccttaaaggcaattttggtatttttttaaaaaaaatattcaccccaacagcatactattgacgtaaaaagacaaagtcaatgacatatttaaaaaaaaagagacaaagtcgatggcaaatcgttgaacaagagtaaactttcctccaaaaattatattggaggtgtagttattcgtgagtttaggctaatcattgtgctaaagtggattgagaacttaaaataaaatcatgcgaatgacaaatagccaaaaacaataaaaggaaagcgttagtgtcctgattggtccgcgcgaaattatcggctttgtttgtgtcaaagaaaaagatgaggaatcgcaaattcgcaatccaaacaaacgtgcaaggccaaacggcaagtcttgtgagtggcagatcgccagatacatgcactccactcatgcaggtgccaagtcctgagtcctgacagcattctaagttcacggcctgataacacgatatatacccttctgtaataaagtgaaaacattttgaatttgtcgctagatcacaactcgtagatgctgtaactgtgaggtaattaagcactgataacaagtcaaccatggatcagcagatcaaacaggaagtgcttgtacagagcaggaaaaaaaaagagtaactatagaatgttctgttccggggagaatccacaaaggacgagatactgcagtatatactgaactgaatgcttgcagcgtgcccccacactgtaaaagttagagcaatgtatcacgttacttcattaatcggccaaagagtacacatggaactgacgctgttcgtcaccggctgaattgtctttttgatatgcatacacattgggtcaggtactcaggtggtttgtactttcagacgatctcatattcagcgatcgttgatgtctagctacttctattcatgtaacgttaatgctgtacatatacagttttacatgagctaacatgcatgttcttgtctgaaagtaacttatatagtactagtaaaacataaaagtttaacagccgtcttcatttcattgccgcataaataacattttgtctgcgaagtattcctccgtttcacaatataaatcattctagcatttcattaacatcaataggaatgtgggatatactagaataacttacattgtgaaacggagggagtactatgtttcttaggcagcaacagttcagatacctattagattaggctttggggattattgatccactgcattctctctttttcttcccctgttttatgtgattttctgaagatgctttcacaagagttacaggctgcaaattttacctcagaggtgatccagccctctgtggggatcacggcaatgatttagctgggacagacccgctacctaaactgttagagttgcttaagccacactcttccgtttgagctactagtaagcatcagccacacacgcagaggagagtagtatcagcaatcataacatggactattgcaattaattgctctgtgcaggggagaaaatgagcaggcaatgcagtaatgcatgcaggccaggatcatggcgattggcaagggccaagggctagtagacttgaacaaccttacattgataggacagtcgctgtacaaggatggatggatggattggttggaacaaacaaacaagggcaatacgctggcattcgtgcatggaccagggccttgtccaacagactgagaattaagcgtttgtacgtactgggaacagtaggcatggaggatgagctgcatgcacgcaggtacaggtgcagtgcatgagaaagcaaccgttagccttgtgatggaacgacaaagtgggatatggaggatggacgaatattacgtgcaattccgacaaaccagttctatccaatgcatcatatataggctcttctcagttattttattatttattgccaaaaaaaaactaaggttagtgatggcagaattaggaatgaaccatgcttgtgtccaaactccaaagtcgcctcagaaatagtcacggaaaataacaaaacactaccatgtttcctcaaccgtgtattcaatatatctggctgggagcagaggacttgctggatggtaccaagacaccgtgatcaatataatagtatatgctctgcatatgtatgtacttattaccaaaaatttatcacaatttgaaaggcgtaatatattgagcctggagcactgaagtatactttgatccctgttcaatatcctacgccgacagttacactttcgatctgaataatggacttaccagctggtacagatcgattaatgaacgtgcttacccgtacgtgtttggaccagttagtactcattactacgtacttataaatctaccggactaccgcgacaacagccagcaagcttatataggcaatggctgatcaatcaagggtgagagatctatgcagtgtccaaagcctaggcatgacaaagtaagtaacaaaccatgcacatcccctcttcggaaaagttgagaggtgtaaacttgtgataggtagtacgtacaacgtacgaacgtactccatctcggtgcaaactgtacatggtttaccaggccggccggccggccggcccggggaccatgcgatgcatgatgccagcatgcagctgatgtgcacctcacctcataatcccttccttgaaacccaatcaacagagacaatacgcgagcacgacagggctctcgctcagctagcgcaagggcgcgcggcgcgttgacaaaacccctcatgcaccgcgagtcgatcgagaccgagacgcccgcgcgccccggccggccgcgaaccagcgatcgacgactgagccccgcgcgtacggcgcccgcgggggccgcgcggcagggtggggggttgccggcgggttggtgtggccggctggccgcatgggaggagcgcgtgggacgtgccgtaccgtgggtgttctgccgggtggtgaggccgcgggcgcgcgactggcgcgagtcccctatgatgcctgggcctgtggaccacgcggcggagagactcgatcgcggcaactgccgcgcccgtcgcccgatatggtgtacgcgcggggggggtcacatgggttttggatccgtgcgcctgcctccttcaatgcgcgacggcgacgtcggcacgaaccggaactggagggaagtggggcgcggtcttgttggagatgtcgaccgcagcattgtcgtagacgacggcggctgatccagattccgtcgagcgactagcgtgcaggcgtgaatctgcgccatatgatcgatcgagcgcccaagttaacaagcctggcagtcgtgtccgatgcaacaatctagctaggcccagacgccgagtgttatactggtgacggattcgtgaacaaggcgaggtcaggtgagaaaatgacaggtgtgtgttttggcaaagggagtgtacgtgttcgggcctagcccaatcattcatcctgattcctgaatgaaaaaggccgaaaggagcttttcatagtgcgggcctgctcagatctcgtgataaaggcccagttacgacaatacgatcacaccccagaaaacaaccaattaacgaatttgttgtatatttgtcgacaaattttcctccaaaaatttatcaaatgtaattacagtataatcgtagtgtaattatgtaactttcaaaaatctctcggtaacatgttatttcagtaaaatagaggtcgtgggaacaaatcctttcacatatgtgtgtgctgtgattatttttcttcctcactagaacaaatcttgtaaatagatctaacgatcaaaattacgtgaaacttacatacaagttacactgtagttacatgcaagttacagtgtaattacatacaagttatagtgtaattatactacgattatactataattacatctgtcaaatttttagtagaaaatttatcgacaaatatataggtggtcccaccaattaatgttctttcttcatcagaaaatgtcatctggaatgcaaacgaaggaaaaaaaaaaagcaacgccagttcaacaacaatcttgatacattcttccataaagaaccaacaaattcgttgtgttcgctccgggatattgataacttaataactttaggcgtgcgctttttgttcttgtcaatctcatcctcttctctttttctgttgggaagaaacctctccttgctcctgcgttacaagttggacagggacccatcaagctaatgagcgatccgacacgtacatacaggacagtggattctgatcatcaagatatgtgtgctagactgctagtgtagtgcagtggagcctttcgctgtgcgtttttgcacacgtcgagtacgtgtgccttcgcccttcgccgatcgttacgcgacagccgatcgatcacgcgtccaaagcccgtcaatcgagtgggcatgcatgcatgcgctccatctggaaagttaatttaagctatttctgagagtgagatctcatcagatcagatatatactccgtactacattcgtgctagtctcctaatctagaagattagtagctacagggtactatatatctggctcatttttcctgttctagcttgtaacaaaaaattcactgctatgatctgaaacgttgtactccatcaaagtatcaaacgaatccacttggaaatttcggaccgaccggttttagattcccgccaactgagcctgtgaaaatagtaaccgataaaaacgaaataaaaatggtaaaagatatagaaacataaacatatttctcttataccgactgttttcgtattttaccatattccacttggaaatttcggaccgaccggttttagattcctgccaactgagcctgtgaaaatagtaaccgataaaaacgaaatgaaaatggtaaaagatatagaaacataaacatatttctcttataccgactgttttcgtattttaccatattcctattgaaattacctttttataatattgataattaccatatttttaaataccctaatatgtgtggtttgatacatagtttagaggctcgttaattcctcaatcaaatcctaagttgagtgcatggcataagaagggagaaagtttataatttaagctagtgtaagcttgaatttgttttcgcatattatattatatagttatattaagttaaatatattatttttacagcttaatatttccagaatttatatcggtttccgggcgataactctgtttttcctccgtatagtgacatttctgatttcctgatattttttacaccgctttcattttcgatttgaccctttttatcctattttctagaataatatggttaaaaaatgactgagctgtttttcgaccattttcttccctatgagtgaccatgtgtgtagaagatttatccattttctttttattttttgcgtacttttcctgtggctcatgcagaactgaagggctggaagcctggaacatgcatatacagtactctgttgtaaattttacagacgtccattaattattagggtaatttggaaccatgccattataattttgtaaagtttaaaatatatcatcggtatctcaatgacatgcaggacccatatgagtcaatgacatgtaggtcaggatggcatatgtcggtgacatgggatcaggagtatcatgactagaggtttgaggcagacacaatcgcacacgtggcctggtacccccgagggacgtcgggcccgagggtgatgcgttcgccctcctcttagtccccccgagggg

SEQ ID NO: 61319 - DNA, 4052 bp, Oryza sativa
agaattaagcgtttgtacgtactgggaacagtaggcatggaggatgagctgcatgcacgcaggtacaggtgcagtgcatgagaaagcaaccgttagccttgtgatggaacgacaaagtgggatatggaggatggacgaatattacgtgcaattccgacaaaccagttctatccaatgcatcatatataggctcttctcagttattttattatttattgccaaaaaaaaactaaggttagtgatggcagaattaggaatgaaccatgcttgtgtccaaactccaaagtcgcctcagaaatagtcacggaaaataacaaaacactaccatgtttcctcaaccgtgtattcaatatatctggctgggagcagaggacttgctggatggtaccaagacaccgtgatcaatataatagtatatgctctgcatatgtatgtacttattaccaaaaatttatcacaatttgaaaggcgtaatatattgagcctggagcactgaagtatactttgatccctgttcaatatcctacgccgacagttacactttcgatctgaataatggacttaccagctggtacagatcgattaatgaacgtgcttacccgtacgtgtttggaccagttagtactcattactacgtacttataaatctaccggactaccgcgacaacagccagcaagcttatataggcaatggctgatcaatcaagggtgagagatctatgcagtgtccaaagcctaggcatgacaaagtaagtaacaaaccatgcacatcccctcttcggaaaagttgagaggtgtaaacttgtgataggtagtacgtacaacgtacgaacgtactccatctcggtgcaaactgtacatggtttaccaggccggccggccggccggcccggggaccatgcgatgcatgatgccagcatgcagctgatgtgcacctcacctcataatcccttccttgaaacccaatcaacagagacaatacgcgagcacgacagggctctcgctcagctagcgcaagggcgcgcggcgcgttgacaaaacccctcatgcaccgcgagtcgatcgagaccgagacgcccgcgcgccccggccggccgcgaaccagcgatcgacgactgagccccgcgcgtacggcgcccgcgggggccgcgcggcagggtggggggttgccggcgggttggtgtggccggctggccgcatgggaggagcgcgtgggacgtgccgtaccgtgggtgttctgccgggtggtgaggccgcgggcgcgcgactggcgcgagtcccctatgatgcctgggcctgtggaccacgcggcggagagactcgatcgcggcaactgccgcgcccgtcgcccgatatggtgtacgcgcggggggggtcacatgggttttggatccgtgcgcctgcctccttcaatgcgcgacggcgacgtcggcacgaaccggaactggagggaagtggggcgcggtcttgttggaaatgtcaaccgcagaattgtcgtaaacgacggcggttgatccagattccgtcgagcgactagcgtgcaggcgtgaatctgcgccatatgatcgatcgagcgcccaagttaacaagcctggcagtcgtgtccgatgcaacaatctagctaggcccagacgccgagtgttatactggtgacggattcgtgaacaaggcgaggtcaggtgagaaaatgacaggtgtgtgttttggcaaagggagtgtacgtgttcgggcctagcccaatcattcatcctgattcctgaatgaaaaaggccgaaaggagctttttatagtgcgggcctgctcagatctcgtgataaaggcccagttacgacaattcgatcacaccccagaaaacaaccaattaacgaatttggttgtatatttgtcgacaaattttcctccaaaaatttatcaaatgtaattacagtttaatcgtagtgtaattatgtaactttcaaaaatctctcggtaacatgttatttcagtaaaatagaggtcgtgggaacaaatcctttcacatatgtgtgtgctgtgattatttttcttcctcactagaacaaatcttgtaaatagatctaacgatcaaaattacgtgaaacttacatacaagttacactgtagttacatgcaagttacagtgtaattacatacaagttatagtgtaattatactacgattatactataattacatctgtcaaatttttagtagaaaatttatcgacaaatatataggtggtcccaccaattaatgttctttcttcatcagaaaatgtcatctggaatgcaaacgaaggaaaaaaaaaaaagcaacgccagttcaacaacaatcttgatacattcttccataaagaaccaacaaattcgttgtgttcgctccgggatattgataacttaataactttaggcgtgcgctttttgttcttgtcaatctcatcctcttctctttttctgttgggaagaaacctctccttgctcctgcgttacaagttggacagggacccatcaagctaatgagcgatccgacacgtacatacaggacagtggattctgatcatcaagatatgtgtgctagactgctagtgtagtgcagtggagcctttcgctgtgcgtttttgcacacgtcgagtacgtgtgccttcgcccttcgccgatcgttacgcgacagccgatcgatcacgcgtccaaagcccgtcaatcgagtgggcatgcatgcatgcgctccatctggaaagttaatttaagctatttctgagagtgagatctcatcagatcagatatatactccgtactacattcgtgctagtctcctaatctagaagattagtagctacagggtactatatatctggctcatttttcctgttctagcttgtaacaaaaaattcactgctatgatctgaaacgttgtactccatcaaagtatcaaacgaatccacttggaaatttcggaccgaccggttttagattcccgccaactgagcctgtgaaaatagtaaccgataaaaacgaaataaaaatggtaaaagatatagaaacataaacatatttctcttataccgactgttttcgtattttaccatattccacttggaaatttcggaccgaccggttttagattcctgccaactgagcctgtgaaaatagtaaccgataaaaacgaaatgaaaatggtaaaagatatagaaacataaacatatttctcttataccgactgttttcgtattttaccatattcctattgaaattacctttttataatattgataattaccatatttttaaataccctaatatgtgtggtttgatacatagtttagaggctcgttaattcctcaatcaaatcctaagttgagtgcatggcataagaagggagaaagtttataatttaagctagtgtaagcttgaatttgttttcgcatattatattatatagttatattaagttaaatatattatttttacagcttaatatttccagaatttatatcggtttccgggcgataactctgtttttcctccgtatagtgacatttctgatttcctgatattttttacaccgctttcattttcgatttgaccctttttatcctattttctagaataatatggttaaaaaatgactgagctgtttttcgaccattttcttccctatgagtgaccatgtgtgtagaagatttatccattttctttttattttttgcgtacttttcctgtggctcatgcagaactgaagggctggaagcctggaacatgcatatacagtactctgttgtaaattttacagacgtccattaattattagggtaatttggaaccatgccattataattttgtaaagtttaaaatatatcatcggtatctcaatgacatgcaggacccatatgagtcaatgacatgtaggtcaggatggcatatgtcggtgacatgggatcaggagtatcatgactagaggtttgaggcagacacaatcgcacacgtggcctggtacccccgagggacgtcgggcccgagggtgatgcgttcgccctcctcttagtccccccgaggggg

SEQ ID NO: 61320 - DNA, 1153 bp, Oryza sativa
  unsure (1)..(1153): unsure at all n locations
attcancggcgtcatctattaaaaaacggagggagtatgtagaatgatgattcaaatgtaaaagtaggatgttgtgcttttatgagagaacagaagaaagaagatcatttagaccatgcatctaagggctaaaaaattaaaatgatacggcttaatgagagaagaaaagaagagagataatttaaaccgtagattaatcatctaaggactaaaaacaattgatgcaatatgacttaataagagaaaagaaaaataacatgaactaagtgaggatgaactgtaggtatataggatattctaaaaaataaagagataaattgaacatattatgtgaattatgtgggatgatttgacatgcttacattttaaatctctaaaatttaataaattattaagttatagataatatagcatgcttgcatgatgtttaaatataacaattcttagtggggatgatgtggatcattgcatgttaatttttaggaattagtgtgctataattaactttatataagagaggatttctcgattttaagtgtattatataaaatcttgtatgaccagataactcactgcacgataagtcaagtgactccaatgccttgagatcactgagttctcgtgtattcttctacacagattgttttgagataagttcaaattctttagcgtaactagctagagcattgatctcattagggatctttcagtaaataatctgttgcaagataaaatcgaggtttactgtgtacacttgtggagaaatcatttttactcccggttggtaaccccctatagtcccgattttccaaccgggagtacgaatctaagactaaagatcggttcaaatatctttgatcttcagtcccggttggtgttaccaactaggaaaaaagagaggaatctttagtcccagttgataacaccaaccgggactaaagagagagtagcactttttttttcttttgccagatttaatctctatattttctcccgaatctagtgccatgtatatccctaaatcaatccccaaatccccaattcaaagtaacatcccaaatcttaagttacttataaatataaatcaaatacatcacaaatcctaaaaaatacacacaaatcaaatacatcacagattatacatctcatatcc

SEQ ID NO: 61321 - DNA, 1467 bp, Oryza sativa
cgattctgttccgaacaacaacctaacatctcttgaaactctggacctttcacttaataatttcaacaagaggattgcacccaattggttttgggatttaactagtcttaaacttctagatatctcagatagcggtttctatggaccatttccaaacgagataggcaatatgacctctattgtggatattgatttatcaggcaataatcttgtgggaatgataccatttaacctgaagaacctatgtaacttggagaaatttaatgttgctggaaccaacatcaatgggaatataacggaaatattcaatagattgcctagatgctcatggaataagttacaagtgttgtttctaccggactgcaacttgactggaagcctaccaacaacactagaacccttgagcaatttgagcatgcttgagcttggtaataacaatatcacaggtcccatcccactttggataggagagctcagtaatctaacaatgttgggcctcagctccaacaatctagatggggtcatacatgaaggccatttatcaggcctagaaagtctagatttgttgatcttgtctgataataaccacatagccatcaaggtgaattctacctgggttcctcctttcaagcaaataacagatattgaacttcggtcctgtcagttagggcctaaattcccaacatggctcaggtatctaacagatgtatacaatcttgatatctcaaacacaagcatatcagacaaggttcctgactggttttggaaagcagcgtcatcagtaacacatttaaatatgagaaacaatcagattgcaggtgcccttccatctacattggaatacatgagaacgatcgtaatggatctcagttctaataagtttagtggtccaatacccaagcttcctgtcagtctaaccagcttagacttctcaaagaacaatttatccgggcctctaccatcagacataggagcgtcagctctagtatcacttgttctgtatggcaactccctttctggttcaattccatcttatttgtgcaagatgcagtctctggaactgttggatatatcaagaaacaagataactgggccaatttctgattgtgcaatcgattcaagctcagcaaactacacatgtacgaatattatcaatataagcttaagaaaaaataacctctcaggacaatttccttcgttctttaagaactgcaaaaaccttgtttttctggatcttgctgaaaatcaattctctgggacactgcctgcatggattggggaaaaattaccttctttggtattcttacggctgcgttctaatagctttagtggtcatattccaattgaacttaccagtctggcgggtcttcaatatttagaccttgcacataacaacttttcaggatgcataccgaattctttggcgaaatttcataggatgacactcgaacaagataaagaagacag

SEQ ID NO: 61322 - DNA, 1022 bp, Oryza sativa
tggtgtgtgctggaaaggtggcagtggggccaagctcgaaaaggttaggtgttaggccaacggcgaggagaagaagaggaggcgacgattagagtttgtgtgtttgcatgaagtgtttgaaacgaaaattcacaaggtattctaggtttttttttcatatgtagagtaacgctagggagtgacggcgaaggtggtggggtcaagttcaagatattgggagctgtggcggcggaggaggagcgggggactagggtttaggtgtttgcacgaattccaaagcgatccgacgtttcagaattcacaagatatttatgggctattttttttctaaatgtacaatagtcagttacttcatttattcgtctcacattcctaatttccaattaagacagggacctaacagcaaaaaggccaaaccctcccgcgacagaacgggcagtcgggcacgaccgagaccctcgcgcccacgcagcaacctccgtacacacgtcgcacttgacttgcgtggactccaacttcccattttacccctccgtgctcaaccaaattgccactaaaccgctcaccactcactaatctatcaggggcaagatcgtattttgccactaatcccactaatccccctgcgcgcttctcgtataactactccccactgctctcttcgatcccctcttctgctttttagcgaaatccgagaaaaaaattgcctgcaaaaaaaaaaatcgaaacgtcgttctgatcgatcggccgttcgagttcacggcggagatggagcacgagcgcggtggcggtggccgcggccgcgggaggggtcgcggtggcgggcgtggcggcagtggcggcgatggtcgcggaggcggttatggtggtgctggtggtggtggtgtcggcgggcgcggtgggcgtgggcctcctggtggtggtggtggacgccggtacgagcccggcggcgggcgtgggtactgtggccgcggccgccgtggtggacgtgggtatggcggcggacgcggccgtggtgggta

SEQ ID NO: 61323 - DNA, 805 bp, Oryza sativa
cagggcgagggcgatcagaagattcgactgtactcgaacaacggttaaacgattcaaacccgaattgattcctcttcccctcacacactatgtaagcccaccaccgaattaattcatgcactatataatcccaccaccgaattgattcacgcactatataagcccaccagcgaattgattcctctccctctcacgcactatataagcccaccatcgatagaccttgaacaacagataaacttatcgaaggaccctaattgattcctctccccctcacgaactatactatataagtccatcaccgatagacctcacaatggataaacgattcaatccgatttgattatcaaaggacccaaattgattcatctccccctcatgtattatataagcccaccaccactcatgcactatataagcctaacaccaatagatagaggaaatacaactatgatcacgtgcactattttatcatcggtggtatgtcttcttctgttcctgtgttgcacctctgcttccccagttcggagcacttttgcgtgcacaagtgtttaggagagtatctatacgggtaggcaggtgatcaaatttttggggagcgcttcctagcgcgactgctctgctgcgtcagttctgcacgacgtcgtcttcttcatctgcatcgttcactttgactacttccactacaacggcatgtctactggaggaggaaatgatagaggcgctagcagcaacggcacacctggaggcggtaacagcactcctattggtgacgagaacatcaacatcaatggaggcaacaatg

SEQ ID NO: 61324 - DNA, 1667 bp, Oryza sativa
catatgtatgtgcaactcagtgataattttgaattttctgatgttcaaaatttgctttacacattttaacatcttgaaaaatgctttttaaatacttaatgtactctgtcctttccaggtttatttgctaccaaaagtttgccctggcaatggattattcttttattcttgtacttacctgagctatattaatcggagttttttttttatttgtaggttcaagaaaagaaggtcaaaaaggtatctgagatgaatttgagcccttcaaatgcatctgcaaatggtagacctgctggcagtaatgctagtggttcgagcgcatatctcccaaatggtggcatttcaaaacctgttggactcaattcgcttcgcctgcctgtggtggtagtaccgaacttaaaattttcattaccacaagaaaatctattcgaaattggtctcagacagtattattgagctaattcctgccatttctgttgtgcctagcatgcatcttcaactattcagttgtttttattgcctcatatgtatttcctgtgtttattgtaactttatttctttgatttgttatatttacttaactttgtatgacaggttacaagccaagaaacaagtctttctgcaagttgccgaagagtctttacgcatgcacatgactaccatataaactctatttcaaataacaggtcttctacattattaatttttttatttagttgtataatagatattatttgaacttgttgctattgaatatgaccacgaccattagctccaaatgagtgttgctagaaaagggccttcttaagggcaaaagcttatttggtttcaccttgcacatgataactgcatctagcatatttgtaaccaaccaagccacctagcttcacagtttctgcatatatgataaatttgcatcccacaatatgccaaatttatttgctctttgacataccagaataaagttctcaatatccttttagggactctttgtttgataatctcaatgtaaaacataccttaatgtgccttaactagtacggaaatcagggtagcgaaagcctaacagattcatatctactacctctgtagtaatattgtatagttttgggaagttcatctgaaccctgtagcccaagatcactatagtcaattcattctccacaggagatttttgatgcttgtgccgtatttgtgtgcgcgctgaaaatttgtcatctgtagtaatatcgtctgtgattgagctgtatgccatcagctatagataatttaatacaccacctcctactttccatgtgtgtttgctatatattttgctgatgtgcatctcatatacattcgattagatgtaatgtaccctttcgagttttatgtagtgacatattgttgcctgctcttttttttttcgacagtgatggtgagactttcatatcagcagatgatttgcggataaatctttggaatttggaaattagcaaccaaagttttaacattattgatgttaaacctacaaacatggaggacctgactggtataactttcaaatcttcaaactcttagctatgctgactagtgagtattaacatatacagccttttctcacacaatgggaaaaaaatgcagtcctatatagctacagtaagcaaaattatgtgactgatgttcaa

SEQ ID NO: 61325 - DNA, 686 bp, Oryza sativa
aacaaaactcaaattactatatgtatatttacaattaaatttgttatttttgttacaagttatagaagttgaatttgaacttgtatatttatgtaatgatatattacatatttatctatcttgccaaaattttttaaaaaaatttcgcaaccatctaattaatatgtaataaacggtggacgtttactcgagctattagtatccatctcccaaaacaccaccacaccaaaccaagtaactatccacgctataactatcagcatatccttggaactccttcaccgtccgatggtctacgatggtctaggccgagaaaatcggacggccaggaataggtcaacacgccgaaatggctcggcttgaacaagcatggtttcagacttaaaaacgaaggtggccaataattaaaaaaaaaatcatgtcgatcggtgacgacggcgtgtgaactgaattttttttttggatggagaaagatagcgaacttgcaacagtacagctcaagaacaggatcatcatgcttgcaccttgcagagttgcaggcttcaaaattaggatgcaggtgttctcatggcaagcatcaattcaagctcaacaactcaatacaacgtaaaaatcttcagcacaagtcaaacgtagcaaagcagagatggattatcatcaagcgattattcattcctgacaggcta

SEQ ID NO: 61326 - DNA, 3066 bp, Oryza sativa
gccctcctcgcccccgtcgtctccgagctctaccactccgccaagccccggagggaggccgaggccctggtcgaggccgtcctcagctacatcagcatctgcagcagccgcgccgcccccgccgccggcgatggcgccggcgccggcgccgacgccgggagcctgctaccggccttcggcgagctggtgaaggtgtggagcgtgcgccactcgagggacaggtgcccgttccaggtgctcttccctcttgtcggggaggacgccaggcgggagctcatgagggaaggtgcagcgtcgccttcctcgccggggcggtggttgccgaggcgttcctgctcaggctctgcctcaaggtgcagggcgcggcaggcgcgtcacgcgccgagctgcagaaggagctcaggatctgggcagtgagctccatctcggtcttccagaaccagcaattcttcggtaagacttgatatgatgctacctgtgtttgtatcatggtttctcttaggattcaggtgcagtgacccgattgtgatgaccgttgtgctgatggatttcgcaggggttctgctgaacatgctcgtgaatcctccgctacctgtttattcactactggtacgtgtttcatgcttaatgattgatttgagggatatagttagtgtatgactaggctagcaacataggggtagtatgcactagcctcttaatgcatttcggcatcatgaacattgtatttccacagtattgtcattccaatatgtatcacaagaagcctaggatttgaaattaacttaataagctcatgccttgaattaacaagcgggtgtaagctcaggtttatcattatctgttgtgtgtttagttaattagcacaaattacctttgtgaaataagaactctgcaacttgttcctttgtacttcaattgtgcttggactcaggagtctgtgttaacttgcggaaattaaagaggagaacagtattaggaatattatgtttcccaatgctggtgttactgtaccattattgctgtcgatgtatcctcaaggaggctgaattgggatggagttctatctcatctttgggatgagcaaacaggttgaagtctgaactgtggatattcttacacccttttattcaattgataatatgatattcactaggaatgactatgctgtgttgtgagaagctagcaaacttgatgttgcctgaacaaatattattcgttatactgtttacttgtaaggaaatgctgatcatggccatattatttactccctaattaattaagttcaccaatataatcatcatatattgttgcgaaactaatttattttgtatatcgcacttgttcttatgtgttccttgagtagatgactacttgatcagtttccttcatttactctggtaatatttcatttagaagagtgagctgttagttattagccatcaaatgtgggttgtgacgatgccattgctgggattttgtgccatcttattgatgctgcatattggtttcttatgcataattcagagtgctgatgatgaaatcttggtgagagatgtcctttatgatgctctgattttggtggattattctttcattaacaaaggagcaggagttgatcaagctgatagctcccttttgcccctttatgtgtcaagattgcttatcactcatgatgccatcaatgacgccaggtgataaagtgtttgtgtaaccggaacttagctgatgttagaaatttctcctcattccatttccttctgacaggagcaaaggtgatcaaggaagggcgatgtctttcatgaatgccttcttcacttcaaacatccccacttattttgccaagtgcgctactagtcaagttggcttcaaccaactcagcaaaccagctgctatcacacctcaagctcttctcagtatgtattgatatagcatgattcacttgattttcagtagagtgggttgatgtttttatagagtaactaatgaaatccctatatgtttgctttttgacagagtggcttgtagatctggaagataagggcttcaaagtatttggagagaatgtttccaggattagggagaggctgatgtatgacgaggtcaagaatggttaccagagcaggatgactcactcagatgctgaccttttcttcattgacaagcagagcggtggggaggttatggacacaagagctggtgaggatgaagaagctgttgagatggaaacagcagacaatgcttttatggctgctgctcagtctatgaaggcgatggctaatggcatgaggaaaaggaaggattgcggggctgaagacgcaaatgtggtcaagtttgtgaagtacaaggttgaagacagctcagtgaaggattacttcttgtcggcaaataatggtatgagcagtggtagtgaggtagagaatccacagtctgatgatgagatggaagaaactgattgatggatagagaggaaaccatccgctaatgcttacttgggagagtcttttggcgagtctggagttgggacgattgctgttgcttcaggttccccttctgtaggatgtcatgcagcttctgtctggatgatgaatgaagcgggattctaggataataatctgcaacgcagagcccgaccccagccaggcttaccgatatagtagtaactgcttagctaacttagactcgatgcatgatgctacaaactatatatcatgttctcttctatatgcaatagagactttaaaatgtagatctactttaaagacttctgtaagagaagagtaccttttatgttatcccacggaacatcttttaagttagtgaaatcttagcatttgtgtagctgttacgattagtgtttctacattgcaacattggcatgttctgtgtagagttgctattttctgtgacgatcatggtgaagacgtgaaatatcggtggattgttcggtaggacgctcgggtgaaaattgaggtgttgcatcacaagttacgtttagatgttgtagagtagttgcttgtgccgtttagatgggaatcatgtgatccctttaaagcataaaatgtg

SEQ ID NO: 61327 - DNA, 3541 bp, Oryza sativa
cttgcatgcctgcaggtcgactctagatttttccacataaagtttttagaccatcctgtttaggaaccggggtgacacaactgaacaagttagaggacctaaacgagtgatctacgagtttagggatcaggatgacacagttgaacaagtttgaggacttgaacggtcgatttgcgagtttagggaccgggatgacacaacggtacaaatttagggaccggtgatggactttactctattatacagtacatatggaacaagaatgtgcatggtaggcgcacaggcgacaagagagaacacttttgattctacgatggaccactgttagttaaattccaaggatttctgtacatcagttccctactgtaatccttccctcatttcctccaacctgctcagctcagacttggggatttgccagccaggtttcaaatcctgaaacctgcaagacaatcaaacattcgtgaataaataagaatgaattgcaacgcaaactttagtgttagtttgattttgtgaaaattacctgaacttctgttcacaagatgggaccagtgaattgtgtatctgtgttaccggtgatgctcctctgagttccgggctcccggctaaacatgaaccgactggtatgcacttgttcatcgcaataattcaggatgtgaatgagcaatagagcaagtgagacctcagttagtagtgatgctgtcaaaacattatccacagaccataattttattggtaaacttgtttattcacagaccgcacaccgacagttctgactttgaatttatactgaggaagctcttcttcctcttcatcctcatcttcacttgagtcatcttcaactttgtcccattttgagtaatcaagtcctgaatgtccctttggttttgcgatggtctcccacccttgtggtttttgaggcagactgggaggcacctcaacctttggaggttcagttgcatgtttcttttcaagaataagttcagttgcaggtttcttttcaagaatcagttcagttgcaggtttattttcgacaataagttctgttgtaggtttctttttgagaatcatttcagttgcaggtttatcagacttggtaatacaaatctcgatatttacatttctctctggacgcaactcttgcttatcttcttcaagatataacgattcctcttcagattctggaatgggagctagtgcctataaaggttaaaataacacagataacaggttaacaggcagtaggataataagtaaacaagctaaggtatagtttctttcattcagaaaacatttgtaaataaaggggagaagttatgtgctggtagcaactaaaaagcatatttgaattatgtaaggatatttgttgtagttatatcgaatgaaattgcaactagagtaatgccgatgcaagaagctaaagcaaagtgaatcaattagcacagcaaagagaatgaaaaacttacaagctgtgtcttcagtcgtgcatgaaggttccgatatacttcagatgacggatttatctcaatcagcctgttcacatcaaatagagctgactggtaatccttcagagtgacaagtgtctgtgcacgtaacatgagagctccagcatgctccctatccaactcaaggacagatgtgcactcttctgcagcctacagaattttgaaaagaagaaaaaacacgctggtaaaagtgatgataacatagaaaaataaacaaatgatgtcaggtgccaacttattccggagaaacacacagcctactgcagttttcatcagaccatcaaggcatcaactaccccacaagtatttcagatgaaatgaaccgtaattttgtctcattaactaatgctggtttctaaagggagcatgattttgcccctgtatatagttggtcatcaaaacagaggtttaattatcctacaaatttggatgccgcaattaaactttctccatagaaatcatgcattctatagactattgaaacctaccaggattattagaaagttcattcaaatactcaatagtagcctaatcattcgccaagtggttcactacatcgaaatcgatctgtgccagatcaatttgaactactattattgggaaggaaacacaggtttttcacgaagcaaggcattaggcccagtacatggattgcaaagtgtcactcagcacgaaatttaacaggatttgagctcaatctacagaccaccacaatatagtaaacaagccacgattgatgagagttcgtgttggctataatcgaatctctcatccaaccgaacagattcctgaatctgcttctcctcccgacctccccaaaccagagtttgcacaggtaaatcaaaaaccccgccgttgaactggaatcacaaaccacgactaggcatcgatgactaacaaattaagcctttattactctaaacaacacttggaagcggcaacgggcgctcaaatctactcaagtcaaagaagagagagagagagagagagagagagagagagaaacagaaccctcgagaagcgagaccttgtggaagtcgtggagcttgaggtagcacgcggcgcggttgctgtgcagcgcgatgcgctgcgcgggtccccgcgccgccgccagcgccgccgtgtacagctcgagcgcgtcccggtgtcgccctccccggtagagctcgtgcgcctgctccaccgccgcccccgccatcgccgccggcgaggaagcctcggtgtgctgatttcgggggaggaggaggaggattagatgagagaatcgcgaatttgggggagattacgaggattggaatggaattaattgtggaaattcggatgaggagcggtggggagatttgaatgtggacggacggatcggatggattggatactttagcggtgcgggttgtcgggttgctgcccgcgacggatgcgggttactcccctcctgtgaattgacggatttgcccctgccctcctttcatgcaggaatgacgtgtcgtgtaaccgtgtataaagcattacttcagtgggaaaagaagacaaactcgtttggctgatttgaggaaaaaacgaaaagttgtattaataaatgaaaaataaatttatgaataaagcttttataacgtgtttttaatgattaaaagtaaaggttgaaaataaactacgatgaaaaaaaaaaaaatatccaaaaataaactctgaatttaagattaaaaatttaaattttctgataattataagcgaaaagatgaggacatttgtttcgcggctatcttagaaattagaacgtgtagaatgccataaaaaagtcactatctcaccaaaccgacacctaaatagtaccggagaaacattgcaaccagcagcttagctaacagtatcatcagtcctcgtgcttctaatgatgatattaacaaaagaatatttacacaaaagcaattgctactttgttagcccttcatctgcgtggtgtgtactgtgaaaagggcacaccctcttgcgcattggaggagaaaaagggaaacaaaagaacaaggccaaaggga

SEQ ID NO: 61328 - DNA, 9329 bp, Oryza sativa
gtgagtttgagtgtggtgtgtatgcatgagtgactttgtgtgttcaacttgtacttgaaaaaaaaaatgtaaacttactgtgatatgtttgcgatgttcatttgcgatagttttgattttgatattctgatatttttggtattgtttttatttccaacgttattttgattacatatttgaggggaaaaatatgggaacggaaaaggttaggacaaattttcgaccgtttttatcactagtagcgggtattctctgccaagtgtttctctggctttgatgaaatacaattttggcatgttttgctatgggcacttattttacaaaacttttgagacccaaaccaaatgcaagcagtttttatacctcgatactgtttctcaagacttgagatgtttactaattcaaatcagactggtttatactgaagatgattatcatcactcctgtacactaactcagagaagcggaagcatgtccaagaaaacactgaaaaatgagatggcaaataaaaacaagacttcccttttaaaaaaaggactagccggtggtggtggtcgtggggtggggggatactggtcggtgttggggcagccaattatgataaggtctatgtacaggtggttataagctggactcgcttggtgcaaaaaacacaaggcaatgcagcatgaagagcctgtgtttgctgccagtgaattattgaactagtatctaaatacctcataactcaatgaataagttctactgttctacaaggtagaagatgcactccataatctttttcttccaaggaaaaaaatatatatactctaatggcaactgcactatgccttttttttcttagtaataagattcatttttttctccaatagcattgcaatacagtactacttaccgtttaataatttggatatcaaaattctatttgtaagaagggtagagacctcggcatatggatacgggtcattctatgacagatttgcaggtccagtactggagtttccaaggggaaagtttcataccttgacttgtgcagtaatcatttctcagtacctttgatccatttcgttcatcaattgatagagatataggaagaagtgtcagccaaacattgctgttctagctacagcaaccttggatttggaatttgtagagcggatcagcctctgtaagggaagcccatgacacagactggcgacctggccacaccgacctctgaatcggtggcggctcccgtctcccctaaatcgtgaggttctccagtataaacgagctgcttggggcccgcccagccgcgctgcctcttggatcgatttcccatcgatcgttgctgtgtcgagctccggtcaggcatacgatcgaacacctcgaggggatcatcgtccacctccgcccggcaagccgccacggaaggggcggcccagctgaggaagcaaccgtggtgcttcctgaccccgacctcaccggcaggacgcggcacgcgctagccctgcactgcagcgagcgcgcgaggaaggccggcggcggcgagtcggtccgcagttgccgccggtgcaccgcggccaatcgcatgcgcaggagggccgtgcgcctgtggatgggccataaaacggctagtacaggagcaagtctatttagcctctctctcagctgtttccattgatcgaaaaagtatactttggacaatttcgtttcccccccccccccccactttatctctaatattaattttgtcttctattttttaggattttcgtttttgctcatactttttttttaactgaaagagacgtttacctcttatttggatgatggaagttagttggatggggtttatggcagaaaaaaaatagaaaaataaagagaataaagatttttcgaattagtgatttaactttttacccctggaattctcctctcctcaaacccgagacctagccggcggcgcaggcggcggcggaaagcgggcgtcggccgctcctctcggcgcgagcaggaggcggcggcgaccggccggcggccaagcggcgaggctgctaaacatggcgccaaacacagcgaggctgctgccgttgcacgggccgtcgtgggcgaacacgaagttcatcgccatcatcagcgacagcgcgtccttgccggcggcgacgacgtacatcccctgcgcgcgtccgaccagcctcgaggaggtcaggttgggaccgtcggtgagcgggttgtcgatcaccaccaccgtcccgaaccacgtcgccgaggcgttcgtcgtcggcgcctccgccacctgcgccaccgtggagttgggagcaccgccgcaaacacgaaggaggaggaggcagccattacttagctctgtgttggtcgcatggttctaattaagatagcttaattagctagctgtctgatctattggtttgcctatgatagatgtggtagagggtataaatgtcctatttaacaccgttaactccatccaaaacaggggcaaaagtatttttcggtttaaaaaagtgagggaaaaaacgaaaaccctaaaaagtaggggcaaaatcaatattaaagatcaaagtgggagcaaaaacgaaattgtccctatattttaacatcaaaaatcggtgcattgatttgcaccagttctttttaaaaaatggggaaaacgttatatccggttttatatttaagggacaagaatttcaaaaaaagacaaaaatagacttatttaggtagaagttctatctgtcggtaataccgtgtaccgacaggctttccactgacacatcctctctatcgccagaggccttttccgacggactattgatgttaaaggtggtcttcgccgacagattagttgttgccaattttgggacatggtgtagtggtagtatatatgatccatccaaattcctactttgatccagattccagcacaaaacctaaggtgcgaatgagtggggcagtgtttgctaatgagccagatttcatagccgctcctaaagctttgggcttccaaatgggcgaagtcctccatctgctcacttgtcgccacaacacataggcgttccgctccgcaactctcgtgctgacctatctaccacacaaggtcaaggagctgtcggatgaaattcctcgcagctcatcagctctcacagcattgagacgtttcaacttgttctcgatgaccaggcatttcggtgtatgttggcaaccaaaatatttcctccatttcaaaatgtatgacgtcgttcaatttttcgtataacgtttaaccattcgtcatattcaaaaaaatttatacaagtattatttattttcttgtaacttgttttaccattaaataaaatataattttaacttatacttttacatatttatttttttaataagacgaatggtcaaatatttttaactaaaaatcaacagtgtcatacattttgaaaagaatgtactctctctgtttcaggtcataagacgttttgactttggatcaagtttgtagaaaataataataacattttcaagccaagacaaatttattatgaaaatatattcgattattgatttcataaaactaatttagtattataaatattactatatttgtctataaacttagttaaacttgaaacagtttgactttgaccaaagtcaaaacgtcttataatctaaaacggaggaagtaatatttttgtttctcctttagtcaaagaattgttcagaaaccttaaaggaaattcgcttcccccaccgggtcacacatcccctcatactcgggccttgtttagttccaaattttttcttcaaacttccaactttttcatcacatcaaaactttcctatacacataaactttaaacttttccatcacatcgttccaatttcaaccaaactttcaattttgccgtgaactaaacacaccctcattggaactgattattggataaaaatccaagcaatgacactgatcgatcttcctgttcacatatggaattaacgtgatagggagcctcctgcctgatcccccacgctaaagatacaatggcagcatccatatatccaaaggagtaaaaaggacatctacccaaaaagacaaccgaactgctaccaaatgaagtctttggtcttccgataagcatagaatcatagatgcttcataaccatcccgttcgtgctcttagcctcttacaactcttgtgaaattaggttcaacagccaattagttactccaccaactgaggtcaatatgtctaaactggcgctcctcctccgaggagctgcaatgatcttgtggctactcatctcgcagacaccatctacctgttgtgttcatgcgagatgcgtcaccggcgagcgtgatgcgctgctctccttcaaggcaagccttctggacccttctggcaggctgtcgtcatggcagggtgacgactgctgccagtggaagggagtccggtgcagcaacagaactggcaatatcgttgcgcttaacctccgcaacactaataatttctggtacgatttctatgatgctgatgggttgaacctattgagaggcggtgacttgagcctattgggaggtgaattgagctcctctttgattgctttacatcatctgaggcatctcgatctgagttgcaatttcttcaacggaacgagcatacctgttttcatgggctctttcaagaacttgagatatctcaacctctcctgggcaggtttcggtgggaaaataccttcgcaaattggtaatatttccagcttacaataccttgatgttagctcgaattatttcttccatgaacagaacacgtttttcatgtcttcaactgatctttcttggttgccacgtctcacctttttgaggcatgttgacatgactgacgttgacctcagttccgtgagggattgggttcacatggtgaacatgcttcctgctcttcaagttcttcgtttgtccgagtgtggccttaaccatactgtatctaaactatcccattcaaacctcacaaatcttgaggtccttgatctatcattcaatcaatttagctacacgccactccgacacaactggttttgggatctcactagcctcgaggagctttatctctcagaatatgcatggtttgcacctgcagaacctatccctgatagattgggtaacatgtctgccctacgtgtcttagatctaagttacagttctattgttggtttgtttccgaagaccttagagaatatgtgtaatttgcaagtattgctaatggatggcaacaatattgatgcggacttaagggaattcatggaacggttgccaatgtgctcgttgaattctttggaagagttgaatttagaatacacaaatatgagtggaacattcccaacgttcattcacaaaatgagcaatctcagcgttcttctattgtttggaaacaagttggttggcgagctacctgctggtgtcggagcgctgggtaatttgaaaatattggctcttagcaacaataacttcagaggtctagtgccgcttgaaacagtaagtagtttggatactttgtatcttaacaacaacaagttcaacggttttgtgcctcttgaagttggagcagtaagtaacttgaaaaagttgtttcttgcgtacaatactttcagcggccctgcaccatcatggattggaacactaggtaatttgacaatattggatcttagctacaataacctcagtggtccagtaccgcttgagattggagctgtaaatttgaaaattttgtatcttaacaacaataagttcagcggttttgtgcctcttggaattggagcagtaagtcatttgaaagtgttgtatcttagctacaataatttcagcggccctgcaccatcgtgggttggagcattaggtaatttacaaattttggatctttcccacaatagcttcagtggacctgtaccaccagggattggatcactcagtaatttgacaacattggatcttagctataacaggttccaaggcgtaatctctaaggatcatgttgaacatttatctcgtctgaagtatctggatttgtcagacaacttcttgaaaatagatatacatacaaattcttctccgccattcaaactaagaaacgcagctttccgatcatgtcagctggggccgcgctttccattgtggcttagatggcagactgacattgatgttcttgttcttgaaaatacaaaattggatgatgttattccggattggttctgggtgacattttcccgagcttcattcttgcaagcatcaggaaataagttgcatggctcattaccgccaagtctagaacacatctcagttggtcgcatatatctcggttccaacttgttgacaggtcaagttcctcaactccctataagtatgactcgcttgaatttgtcttcaaactttttgtcagggccattgccatctctcaaagctccactgctggaggagctgttgcttgccaataataatattacaggcagcatcccaccatccatgtgccaattgactggtttgaaacgtttggacctgtcaggaaacaaaataacaggagatcttgaacaaatgcaatgctggaaacagtcagatatgaccaatacaaactctgcagataaatttggttctagtatgctcagtcttgccttgaaccacaatgaactttcaggtatatttcctcaatttcttcaaaatgcctcacaattattgttcctggatctttcacacaacaggttttttggaagtttgccaaagtggttaccagaaagaatgccaaacttgcaaatcttgaggttgcggtcaaatattttccatggccatattcccaagaacattatttaccttggtaaacttcattttctggacatagcacacaacaacatatcaggatccataccagactccttagcaaacttcaaagcaatgactgttatagctcagaatagtgaggactatatttttgaagagagcataccagtaatcacgaaagatcaacagcgtgactacacctttgaaatctacaatcaggtggttaatcttgatttttcatgtaacaagttaacagggcatattccagaagaaatacatttacttattggacttaccaatttaaatttatcaagtaatcagttcagtggaacaatccatgatcaaattggtgatttgaagcagttggaatcccttgacttgtcctacaatgaattatctggtgaaatccccccaagtttgtcagctctaacttctctaagccacttgaacctatcatacaacaatttatcaggcacaataccatcaggatcacagctacaagcactcgatgaccagatttatatatatgttggaaatcctggtctttgtgggcctcctctcttgaagaactgttcaactaatggtacacaacaaagtttctatgaagatagaagccatatgagatctctctacctcgggatgagcataggatttgtgattggtctatggactgtgttttgcaccatgatgatgaagagaacctggatgatggcttactttcggatcattgacaatttatatgataaggcctatgtacaagtggctataagctggagtcgcttgatgcggaaaaaccaagatgcagcgtgaagagcgttgtttccactgcaaatgaattattcaagctactagtttctgaaaaacctagtaactcaaagaataattttaggtgttttactattccaagtggatatttactgttcctactataatatctggtttccgatgaaacctactagcatatttgtctgtaatgtgcttgacattctgttgtcattgtattatatgttgttgttatatgatttattttttaagctggatggattgaagctagtaaagataatatataatataactgccctctgccttttcaaggtacttaccttcctgtctgaacatttgcatgtcataatgctagttgtagggtgtgtccgtacttaccttcttattcataataagaatatgtatatgcctcattttaacagatttgcatgtccacagctgaagttcccaagggatgtttcataccttgaatccttgatttgtcagtaaccctttgtcaaaaatgttctagctaagcttgagctccaacgtgacggactggagattatcttgtctaacataataactgaccatgatgatccagtgtctttggtctctgggtggccacaacggatggatatacgggaagttccatccatgttgatgcaggatggctggatatatggggaaattcctacagaacataggtttagctaccagcaccttggaatctgtggacggatcaacctggaggggaagctcatcgtgacatatcggcgacctggtcacatactcacatcaatccatcatatccctgaataggagtaaacggaaaaatccgcaacctgcccacacggccacaccaacctctgaatcggaggagactccccgaaactgtgagactgagacattgctccagtctccactgaccagcttgggggctcgcactgttgatctggtcgagttcccggcttcccgtcgattcatttgatgcaccgcgccccggtcaggcaaacggtcgagcacctcgaggggatcgacgcccaccgccacccggcactcccccgccgaaagaacgccggccctgcagatgaagcaacagtgcgcggtgcgccttcctgaatccctgacctcgtcggcaggctgtggcacgcgctggcccggcgagtcccgccggcgccgccaccaatcgcctgctctgctgaccgcggtgctaaggccgaactcgcagattcgcgggtgctgggattggatgcggcagcgcagttgatggcgccccgtcggcggcgaggtggatgggccatcgagaggcccatttacgtccagctgacattccggcccacacgctcgcgagtagcccgttcagaagtccggctgctatttggaaaaagtacaccgaagatcccttaacttgtcatcgagttacaaatcgtccccgaaccgcaaaaccggatacaacgcatcccataacttacaaaaccagtgcaaactagatccctcagcggttttaactccagttttgaccgacgtgcagctgactcagcgtgggacccacataggtcccacgtgtcagcctctacttcccctcccatctccacctctcttcctctctctcctcccacgaaagcagctgggtacggttcggctggcgcggcggatggctggtgcggaaaaactgggcggcgccagcgggggaggagctgggcggcggcggtgacaggtgacgcggggacgcgggagaatgggcgacacggtg

SEQ ID NO: 61329 - DNA, 2654 bp, Oryza sativa
aatctataggatttatatttttagatttatcatttttatattatattgtttacatcttgttaagctacatggatttttaaaaattaataatcaaatataaatatatttgatttaagataaacaaaaacgagaagtaatttgaacatagccttatctgtcgcatctaattaaagataattaagatcatagacaaagcggacataagaggagcatctgctctgcgcagatcttaagttctcaactagataagtccatatgattccttgccattatctgaaaaaaatatatatatgcatgattgcttgcgtctgctaactgtctacttgatccatgttggtgtttactgtgcacagcattttcagcgtatattaatcagtttattaattgacaaactcactattgagaacttaagatgacgctggagtagtttgttatagttaaagaatgttatagtcgctcttcaataatggctcttaaaaatatgtgtgaaaaggtcatatatatgcagtgtttgaaattttgggaacgaaatttctggaaatttcggaaattttgccccccaccaaaatgctaacatctcgcccaaatttcggttttttgcaatttttttatgaatttggtcaaattttatttaaatttattcaaaatccgtcaaaaaataaaaaaaattcgtacgaaatttatccgaaattccagaaatttcggttctatcactcagcagcggcagaactgctgcttccgaaatttaaaaccctgtatatatgttcaaacaaagttgaatcgactgccacactttattgatttaaccggtgtagtttaaaagcatatatttgacaaaccattactttttttactgatagaataggcatgatgcacatgagcaggttaatttatgcaattaaccgtgctatcacgaaccacctaataccatgataaattactgtctccatcgctccatggaaaataaaaagaaatgaccaaaggttgatccggagatcaatccagctttataggaaagccaaagacggttcacacaaaatttcaatctcccaaaaacggtgactgattatataattgttccaatagaacatatattctattataagacgctttaacttttttaatcaaatatttttaagtttgattaaatttataggaaaacatagtaacattctcaacgtaaaacaaatattattaatatgtattcaatattatatttaataaaattaatttggtgttgtagctagtgctaaatttttctataactttaatcaaacctataaaagtttgaaaagaaatcatgatgtcttgtaatataaaagaaacaaagaatttactagcaacattcagtagacattagaccatatgaaacatgagacacagaaaggcagtgaaaaaaggaagaagattctacctgtcgatgatcagttgccaactctgatgactgactgaccagtgaccacagccccggttagctggcgatgctgcaagactaatcaagcaaaagtcttgaataatcttttctctggtcctgcttcatgcttgtgtgcatagataaataggtaaaggctggcagaacccagacagaaagcacaagatccgaggagcagatcgaccaaaagtttctgatcccctcttcttctcgcttgcttctctcctactcgatcaatctcgctagagcttcttgcttgctttgatctctcgagcctctagcctagcttagctagctaagctagctactcatcagtgtcctaagtagagttgctagctagctaagcatggcgagcaatggcgaggcgacgacggggagcgagacggcggcgccggcgccggtgccggagccgaccccgccgccgtgccaggggaggctcatcaccgtgctgagcatcgacggcggcggcatccgcggcctcatcccggccaccatcctcgcctgcctcgaggccaagctccaggtatatacgtagcaagaacacacacacactgctgctagctcatcagctgatcagctcagctatggtgaaatcaaatgctgatctgcaaggaacggaacaatcgtgtgttcaacagcgaaaacatagtcgctacaatagagaagagtcaagggatcgatgatatcaaaggggatcgcagaccgtccatcagagatgcattgatgatagtgaatccaataagatgtcgtcccttgactgatcttgatccctattgctacacctaaactatttggaacatctaaatccctggttttaatataaatgatacaaggttttccgtattcggaaaaaaaatatgatgattaatttggtgatgattaattcaggagctggacgggccggaggcgaggatcgcggactacttcgacgtgatcgccgggacgagcaccggggcgctgatcacgtccatgctggcggcgccggacgacgaccggcggccgctcttcgccgccggcgacctcaccaacttctacctcgagaacgggcccaagatcttcccgcagcggaggtgcgtgtcgaatatcgatcgatctctgtctttttttcagagaatcgattcgcgatcgcatcacatgtcgatgatcatatcgctgcatttttgttgaatgctaatgttgattcgttcgtgacgggcatatgcacatgcaggttaattaattc

SEQ ID NO: 61330 - DNA, 2173 bp, Oryza sativa
atgggttaaagaaggaagattgctgagcgaaacggcttaatatatatatatatgagctaccacctgaacttcagtaactccaatgacgttaacgtttggtgcagatcccttcacgtgaagtgcagttatcagaaaattttgagcttgccaagcacggagcacaattggaatgtcttcttcgtcacgagctggatcaccaaccgactgccccaacagttcaaatagcaagcctcctgcaactcttacagggacctgaaataagttaaaaaaaagatacgaggtttggagggagagacgtccctccaaatatttttcaagaagaaattgtaagtgtgctggggattgaacacgagaccttagggttgaaaccacatgccccttgccactacactatcaagtgaagaaaatccagacaatattccaagtaacagtaagcttagataaatactgcatctaggtagacacactaattcaggacattccgcaattgtgcatgtagtacatgggagcagggttcactctattggttctggggtttccatcgggggtcaccgaaatcctgaaatttcggaaattttggtccgaaatttccgaaattttgaacaaaatttaattgaatttgaacaaatattatccaaattcatgaaaaaattgaaaaattcaaaaacttcggccgaattaatatcgtatcgggggtcaccgaaatgagtagcccatatgaaatcatcaaagagtttcagtctttcagacattcaagctaagaagtggcagtagagtcacactgaaacattgacactcgtagtctcctacatatctaaatgaacatatatttttagataatggaatatattttatgcctttgcttaacttgctacagccaattattacacaaattggcttacaagcgtttacgcacgaaagagtgtttaattctagatagaacatcaatagactcaaaatctattatataattaaagtaatagaaaaagaagcctccacgttcgctctcatggcctagaaattctgacattaatcggagaaaaagaaaaaaaacagagtccatatagaaatacaatttagaaatagctgaaattcggaattaaaaaataaggaatattagaaaaggtgactagagtccatatagaaatacactttagaaatagttgaaattcagaattaaaaaataaggaatattagaagaggatactagagtccatatagaaatacaattagaaaataactgaaattcggaattaaaaaaataaggaatattagaaaagagactagagtccatatagaaatacaattacgaaataactgaaattcggaattaaaaataagaaatattagaagtagagcatagagtccatatagaaatacaattaagaaaaaaaaagaaatttggaattaaaaaataaggaatattagaagtagagtatagagtccatattggaatttaaaaccaactaaaatccggaataaaaaggagcctccacgttcgctcttatggcctagaaattctcacattaatcggagaaaaagaaaaagcagagtccatatagaaatacaatttagaaatagttgaaattcagaattagaaaataaggaatattagaagagaagactagagtagttattacacatgagtagtttcgtaaagttattgcaaaatttaatattatgttgtcattgtaatatattttaataatataataagaaaacatatatgatattatatgagagaaaatataatgatgctagccgcgcaatctgcacgggccaccatgctagttgaacatatgtagtcataatgatttgcatacaaatagtaccaagacatggtgctttctatcaaaaagccggcctcttttggctttccctctaaaaaatggtaccttaaacatataaaacagtagaaaatggatgaattacccaatctcttgggtagtgcagtgctggatttctttctagctttcggtagaaaatttggagtagaaaaccgcggagaagtatggtaaggtaaagctcacctcgtagagcagatgcttcatcttctcactgatgagcacgctctcgtccctgagcgccacgcagatcgccgggtggagccaccgcgcggcggccagccacgcgtccaccgccgggtgccccgccggcacgtggcaccaccagg

SEQ ID NO: 61331 - DNA, 3122 bp, Oryza sativa
gtcagcaagcaaatagcttgcttgacttgatgactataagagctttccatagcaagatattgcggcgttttagcctcgggacagcagtgggattccgcatcaggaaaggggatctaacagatatccctgcaatccttgtctttgttgctcgcaaggttcataagaagtggcttaatccagcacaatgtcttcctgctattcttgaggtgcggaaacttaatctccattgttgtttgaatttggtttgggacggtctaagtttttctgctaaatctttcacttagttggatcattaacagggtccaggaggtgtttggtgtgtaggaataagtcttggctggttggtcttggtcttgtggtgcctttttcctgcttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggacatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcaccagcagcaccggttgcccctccttcccctttcccttccccctctccacacagcagccccccggaggtgcgccatgtccgacgctcggtctcggcgttcggtcgcctcgagcactcggcgtcagcaggacgccgagctcgccgcagcagaagagcgcaggcgagcatcggctcagaccgctgcagcagcagcgagggcggccagactggcggcagcggagttggcagcagccagggcggagccgtaggcggaggcggcggaacatgcggcacgtgcggcggaggtagaggttgagaccttgcgcagcagcatcaacggctccatcgccggcgacatcaccgctgacagggagcttgaggagctggcaagaggaagggcacgggagcgagcagagcggtgggcagcagcccacctccacggcggcggcggcggcccaagggaccgtgcgcccgccgacgggaacccagacgggcgcgggcgtgccggcggcagcccggagcccgcacgcggccctcgcaggcggcacggctccctctcccctgaccggcgccatggtcaccacggcgtccagacggtggtcagggattttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagttccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtacaggcagatcgctcgctcgattgaatctctgctggacctctccacgatgtcgatcgaggaggcgttaggtcgcctcaaggtcgtcgatggtgatgagccacggcctctctcggggcccatcaccatcggcgggaagctccatctcactcgggagcagtgggaggcctctcagggtgacgggaggaagggggagtcatcttccccgacaggcggccataagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacaggtggaggaggaagagccggctctgctcctagctcacgcaagcatcgagctacctccagcggcaccggccgcagcggctttcctccaccttgatgagccgaaggtactcgtctccctctgtgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactttacatcctcagcgcgcaggtcgcacatccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacaaagcagcggcggctcccctttccccagcagacgagcttccgagccaaggagcggctcgggctcgtgcacggggacttgtgtggcccagtgacaccggccacaccaggaggacgacgttatttcctgctgctcgtcgacgacctctcccgctacatgtgggtgatggtcctcggcagcaagggagaggctgcggacgccatcaggcatgcgcaggctgctgcagaggcgg

SEQ ID NO: 61332 - DNA, 1227 bp, Oryza sativa
aacgggtgtaaccggacgaccaagcgggagcaattttccttataaccttgtgcatcataaacaacgaaaaacagagtccctgagtccccatcccctacctaacaagatttcctcgagggtaacaatcgaaaagtacaaaccggtatgcaccgtagattagaatattatagattagtataattagtcccaaccgacgcacctaaaatctgtgcagccaaagataatccaagagacagatgaccgaaagcccaccgaaaccggtaaatcctagcgctaaacccacaacccaacacgcacaagaagcagcgggaaagtgcgaaggacgagcagctctcacccaccaggagagagtcctccgctgctctcctctcctctcctccggctaagtggttggctggtctcagcgacagcgatccctttcggggtactagtagctagtagccgcgacgacggatggtggaacccgtgggtgcaggtggtggcggtagtggctggggcgcggaggggttggcgctgctggcctctgctcctccagctcgcgataagggtcttcgtcgtcgtcgtcgtcctcgcatgaccgctcatggccgcgacattgacgatggccaggtgagtatgattgttgagttagatgtatcttgcgtgatggtgctcattatagctgtttgttcgtgtgcctgtgcatggcacggaagctgtttgtgttaatgcgtcagagggagcaaccgagcaactgtaattgtgatcaagaggtgtttgcctgagaagatgatgctttttaggatttcttagttttgttggttgaatgataacttagctcactgagtgacaggtttttttggatagcttttaccatactctttagataatgcacctgagtgacaattgaaagcgaactatgagtcggcatcagtcctggtctcaaaatgatcctcttttggcaaattgaccgtgatgggttctttgtttccgtttgctttaccatttttgttccttttccttttcttagtttttttaccctgatttggttacttcacttcaattatggtagtagggcatgcagcttcgataatactataatgttaaattgtttggtcagggaaatgaagatgtcaaccggcgaaaacttacaggcggggttattgtctaggacgcctccatttggtctgaggctatgggttgtgcttggcattagcatttgggctgcaattctgtttgtcctaggtt

SEQ ID NO: 61333 - DNA, 723 bp, Oryza sativa
tatattatgaaatgtcacgtactgtttgttctagttagtgaattgtcatatggtaagaatatataaaaattaggttttctggactctatcttccaatgtatttttggatcctataacaaaatattttcataaatatattttttaagaatctaaacttttttgaaataaaagagcaacaaagaaaataaaaacgctctctcgtaagtaactcgtgaagatccatcgagagccactcgtttgaatcgtcgacacaaaagaacacttcattgattgcttttcgtcaattagccgcacagcacagtactctccaatctgctaaaccaaaaccaatctcatccatccatacccttcttgacaccaagtggcaactcctgattggacgcgccctatcctacatggcacccccaagattctctcgataggctacaggggccacaccgaccctccacgtcatcgtccacgtcaccctcatcccggcccatccagccaatcccagcccagcaaaaaatcttcccaagtggccaccagataagcctctccacgtattaatacgccaagtgttcgtcgccatgacacagcacgcacacacaccccaccagcagcagcagcagtagctgagcttgaagcagcagagcgaggtagacatggccgccgccaccatggccctctcgtccccggcgctggccggcaaggccgccgcgaaggtgttcggcgaggggcgca

SEQ ID NO: 61334 - DNA, 1358 bp, Oryza sativa
ccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaggaaaatggcgggaccagcccagccattgcgaaggggaggaagaaaatggaccgccccgggtagtctggtgccgggcgcccttcgcccagcatcactatctcccgaccggtggcggactccggcatgaagcggcgcggcagtccggcgtgcctctcgttcacgatgcgggaaggcggtaatacactgccgtcgagcagagcagagccccgtgccatggcggtggaggaagagatgattgagaacgagcgcgtgtggcgaaagtagggcgcagcagagaaagagttagagctcaggcggcgaaggcaagaggaacaatggcgaaaggaaggaagcaaatcctttcctcgatgcttttatacccttgccatcgctgggcctggctcctcgtttctcgcgcccactacctcgctccctcgtatctcgctatctcgctccctcgtttcccgtgcccacgctttcactaatcccattcgcccgcttacggcgcatgaagtggatatgcggttgtggcaatcgaaatggattgtatcgtgcgcgcgttaattacgctcgccgaccgaagcggcgttaccgtatctccgggcgagataaatctgctcacccagattcgcgcgctgctcaagaggtgtggcagtcttgaatagaccgcccattatggacaaccaaagttaccaataccaatgcgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacataatcgcccacgtggcctggcaccttcggggacgtcgggcccgagggtgaggtgtccgccctcctcttgatctcccccgaggggggggtcgggttgcgcttgccccggccccgagggccgaggcaccccgaccccttaaggaagtctgcgccacatatatgggataagtgagcacagctgtgctcacctaacagcatttattgtagtctggtcaagcgtgtcacgctgcatgcaacgcagtacagcgcgttcctttacccggtctgtgaccagtcacaga

SEQ ID NO: 61335 - DNA, 3962 bp, Oryza sativa
gtgtgatagtgcattgtgcatataattctagtttttgccaaaatatagacgttcttgatttactattcccatcaggacttacttcgttagaggatttctacatagtccagttggtgtttacagaatcaccatcatatttcatagtggctataacttaaaaaggttcagcaacgcctttttgtgtttttctcttttttcagagtgtttctttgtgaagcgctctgctgtacatattttctcttcttcttaatgaaatgaaacgcgtggctcttgcattttcgagaaaaaaaaaacttgaaaaggtgttatggaacttacaactcaaccaatcatctatactcaaaactcatctctttcagaaattcaacaaaacatgttgtaaatatctgatttggtcaagtttcaggaatttatcacaaaatgttttggcagggcctataccgtcattcattggggagttgactaatatgcaatacatgtgagatatataactcaaaacataattacattaaatgcatttgttttgcaataagtctcacatttttctcccttcaacacactaggacttttggcatcaatgcattatctggacctattccaaaggagctcggtaaccttacaaatctcatatcactgtaagaactgtatttacattatttcgtggacgtaattcatcatacaactctactatcatgaaatgcttataatgtaaaaatcattaaagaagcagtgaagcacagcataattgtgaatatatgccaatttcctcatgtttatgctattcaattaaggattccaaaatattgagccggagagcaaatagcatattcatttttgcaacattcttttatttgggtattgcagttggactcagttggaagaatagctatgctgacagtgttatttcttcatagaatataaattccaatacaactttatgtggctgacatggaatttttttgaggtttatcttcaggggttgtggttgttcacgagcaagagcggctgccttaaagagttgggaaccctgttcaaccttgaggaattgcgcgtttaactaattattagtcgctatgtttttttttatcgaaccattttattttcttggactactgagcctaacgtgttctgctatttgcatctctcaattgcaggtatattgacagttctggcttaagtggagcactaccatcatcgtttgccaatcttacaagaatgaaaatattgtatagacctttcaaaagacatgttcttgttgacattaatgtcagattccatgatatctgtgtatcctttcacttgttcaggtgggcatcggataataattttactggacaaataccagattacattgggagctggaatttaacagaccctgtaagtttgctgttagcctctctatattgtacagtaatttatttttttaagatgaaatcaatgaacacaaaggggagttaaaaacttttcatataattctaaagaatatgggtacagtttgctacagttttacactgagctttagtttgagagagaaagactagatttaaggtaacacaaaaagtctttactggtatttcatacttgaccttgggtgtgttgaatcgcctgagatctctttatttaataaataaatcctcaataatgcatcttgctgactcaccatccatgaagagattgatgctagttttgaataaggcactagtgttagtaagcattgattctgtttatatcatttctatttacactggaaaagaagttgtgctttagctacgtaagtttgcccttttttcttagcactactagtttaatttgccactgaataaatgataatttaaattaacaaactactctttctacatctatgaatctctaggcggttgcaagggaattcttttcaaggtccacttccagccactctttctaatcttgtccaattaacaaacttgtaagtgcctactgctggcaagaatgtttatacatcgttcttaaatatcaaaggtttcatcaagggaaacattaacaacctatttctgtggtgcagacgaattggcgacatagcaagcggaatctcctcttcactggcattcatcagtagcatgacatctttgaatacactgtatgcaaaaattttgttcactttcacgattcaaactacggttcagattttaatgtagttcaaaccaaattgttaaatactataattaaatagcatcattgtttgcaggattttgaggaactgtatgatatctaatagtcttgaatctatagacttctcaaaatatgcaagtttaaccttactgtaagtattttatatttatagtaaacaataggcaagtgtattttgtccaagatattagacgaattgctgtggatcaagcactgacctctggccattctcaatattttttaatattacagggatttcagttttaacaatatcactggcccaataccgcaagccctgttgaatctgaattcactcaactatttgtacggattatctttctttccaagcttatttcttggaatagaagggttatttgtttatctagctaatgcttgcaaattttgtatgatcagatttcttgggaataatagtcttacaggaaaacttccaacatcaataggacgttcgttcagagttttgtatgttcatatgattcatttattgtaacaacaaaatgtgtttgatttatttctaatgatgatttggcattttattttctgcagagatttttcttacaaccagctttcaggatatctcccttcttgggttagtgggaaagatttacaattgtaagtaccaacttctgaaacctccattaactaactaacttcagccaaattgagggcatgtttggcctattattaggcttttgaactggcgtattaggattacttttgatgcatttgcttataggtcttcacaaagttgttggatctataatgtcatctgtgattcagattcttctgttaagggtatactttcagattataagttattttgacttcgttcaaagtcaaactactttaaatttaaccaagtttaaagacaaatagtgatatttacaacaccaaattagtttcattaaatctataattgaatacattttttataatatatttatcttggttgaaaatgttactactttttttataaacttgatcaaacatagaggagtttgactttgaccaaagtcaaaacgacttataatctaaaacaaagggagttgatactaactattactccctccattctaagatataacaacttttactcctcaggatttgtcccaaaatataactacttctccaccaacattttcttcccaacaaatcacaaccctatattattcacttttcctacctacctccactacttatccaatcacaaccctgcactattcacttctacctacttttttaataaccatatccaactctaaaacttgttatattcaagaacagagggagtaagaggtattttggggattttctcatctctgttatacagagtacaacacatatttgccttttaggtttatgtgaatgcaaaagttaaattctcaatttaactcttcttcactaaacttagattaaatttcactttgggtcatcagatgttcagatttggtctaccctttaaccaatgtttttactttggatcagataatcttacctttgctgtaatagttcaattcccaattaactcttcttcactaaatttaaagtaaatttcactttaggccaccttttattaccaagtgttttattttatactaccctttaaccaatgttttcatttttgcctagataatcttatctttgttgtactttggactactctaactctcttcatatgaacatccgttacgccggctctgatttgtcactaaactcccaccgctttatatagataatttatttgacatatcatgatgtgcataaacaaaagggtgatt

SEQ ID NO: 61336 - DNA, 1778 bp, Oryza sativa
ccgatcatgtcgatgtcgccgtggtcacggcgtgcgcgcaccgtggcgacctcttcgctgatacggtgctccaccccctctcccgccgccttcacctgcgccctctccggccggcaccagctgctgtcgcgtcactgctgccgctgctcgcctgccacggcccccgcgccccaagcccctctactcctcctgagcccagagccgccgctccgcagccgcactcgcccgccgcgtcccccgcatcccaagcccctccattcctcccgagcccggagccgccactcgcttgccaccgctcttacctgccaccgccgatgctccgcagccgctgccactccccctctcggccaagaaaaaagcgattgaggagaagattgctgactaggattgttgaccccacatttttttctcacttacatgtgggctccacatatttatttttttctgactaggatgctatgtcagcaaaaccggacaaaaatactgccatgggaccttctttgaacggtttgagtgagtttaggggtacacatttctgattttataattaagggaccttaaaaaatctcgcggttaagttgaggaacctcaggtgaacttattccgccaggaaataaaccaggtttcacccaactactattcctgcttagccgtttcaaaaggaggcctttccatagctgctgcgaacaatatgggaaatggaagtgagttgattcatatctagcgcaagttgctaacactaaccatgaaaaagcagtcagctactctacaatctgtgctgaagcctgacggtgcctttgttcatgagcaaagcacggatcctatcagagatcccgaaagagacgccatagaacggatccgtattgctgctgtacagatgaaaatactacttcctccgtttcacaatgtaagattttctagcattgtcatttagatgttaataaatctagacatatgtatgtgtttaaattcattaacatctatatgtatgtggacaatgctagaaagttttatattatgaaacggagggagtacatttctttccggaggaaaaaaaacaacacgttgccttaccctaaagtatgaagtatgaacacaaatatttcaggccttctggtgataaaaagtgatcgtacgtaacgcttatacaaaagctgtatcgtatctcgccgatgtcccggacggctcacgccgccctgaaccgtcgccgtcgccgcatcgccccatcgggctcctccgatccttgagcaagagcgcatacaaaaacttcaggtggttcaggcgttcagcatcgacaccgacggcgacaaaatggttgctactaataattgatttagggagaaaaaaacaaaataaagaagatgctaaaaacaaacctgccgtgatgatagcgcaacatcatcggcctccagcatgcggacgacgctgcccatcgtgggccgcttgtccgctttggggtcgacgcacttgagggcagccacgagcgcgcgcctcagctgccgtttggttggcttggcctccatcgcagggtctactacctcctcggctcttctgctgctagccatcagcttgatccactccagcaggtgcacctgcaaacagcacgtcttgtgttattgaagggggaaaaaaatgaagcttgaagtatccacgtgtgcatagagaacaacacacagctctgagattcagtcgatgtagaaataaactgttttactgcttttaaatgtgagaactccatattaagaaaataatggcgaccgggcagcaagggtgacaga

SEQ ID NO: 61337 - DNA, 2356 bp, Oryza sativa
ttgtgaaacgaagggaatagtatttaacacagcagtagctataggccctatttaaagagttcaaggttgtgaaaaacaactactcccttcatcccatagggcagtaaacatttcgtacgacaaatctggatatgcgacatgttcaaattcattatattataaacaacaaatttggataagagacattgtcggtgatatgggaccgggagtatcatgaccagaggcttgaggcagacataatcgcccacgtggcctggcaccttcggggacgtcgggcccgagggtgaggtgtccgccctcctcttgatctcccccgaggggggggtcgggttgcgcttgccccggccccgagggccgaggcaccccgaccccttaaggaagtctgcgccacatatatgggataagtgagcacagctgtgctcacctaacagcatttattgtagtctggtcaagcgtgtcacgctgcatgcaacgcagtacagcgcgttcctttacccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggttagatttataccaggcttcatcctaaccattacaggcaaggtgttacacgaagaagggcaaaacatgcacgttgttaaactgacgcgtgggggacaagaatgaccggtctgacactggtcgcatcagcaacgggcagccacgatcccgcgtcatctccgtctccgccgggagtggaggtaggtgtgggctgtcccatcagaagggctcccggatggaaaccgtaccgatctccgcccattaaagagaaaaagaacagtccagtttggaaagagaagggtgcatgtggtatccccttgaagtataaaaggaggaccttgcccatagagaagggggttgattctttccagattcagagcctagaacgagggagaggtgggctcacactttgtaacttgtccatacacaaatccacaaaaacacaggagtagggtattacgcttccgagcggcccgaacctgtatagatcgtccgtgtctcgcgtttcttgctggctgacgatccttccacatacagagagagagagagagcttgggatctcaccctaagcccccggccgaaccggcaaaggggggcctgcgcggtctcccggtgaggagcctcgagctccgtcatctggcgcgccaggtagggggctcagcgtgtttttttctgagctctcatactcttccgtgtgcgccaagcttcccttgttcaacctaatggctgagcaagcaaaggcgcacgacctctctccgagtgtgagcggcgacgacggggagccaaacccacgccgtcgagctcgtactccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcggcggcggctgcacgtcattcggctgctactccctcgtcgacaccttcgactcgggaggatcagcatggggagccggatgcccgcctcaacatcgagcgccggcgtaataaccggcgtactccccgcgcaacggagggcgcctcttcgtccagagtgtcacctcgacatggacgtgagaatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacatggccctaaaaggacaggcgcggggttggctaatgaacctgccacccgcgtcggtccactcctgggaagatttgtgccaacagttcaccatgaacttccaaggcacatatccgcgcccaggcgaagaagcgacttgcatgcagtacagcgaggcga

SEQ ID NO: 61338 - DNA, 1993 bp, Oryza sativa
tgcaggtttccttcagctttgtcctttttctttcctggtcaaagttggttgcctgtgaaccgtgtcgttggtgttcataatcttcagtagtgcttcaccaaccatagtccaataggcaattttgggcgatattttggtaagctgaaagatattttaaattgagctagaacgattttgggcgcattgagaaaacaaaaggatttttttttcaaactggttgatatatttgtgcaactactatatttatttcaaaatatagtaacctagagccagataaaattcatctattactacgaatctggacactgaaaaatcattttggcatgtggccattagccaataattctggctggtttccttcagtgtgtccggggtccctcttctttcctggtcaaagttgatagcttgtgcatgtcaatatcgttttggtattcgtaagctttagtgctacttcaccaacaaataaccctaggccagctgatatcagattaaaagacatatagtacaccttttagttgagcttgaaagataattttggtgcgtagctagagaaaataagggcgctttgatttgtaggaaaaatataagaattttggaggatttcaatcctatgaaaaaaaatccattgaaggcctttgaaacaaaggattgaatcctatccaatcctttaaaattcctatggaatgggtaatcctatgcacattttggaggaaaattagtaagaggtctaacctcttggaacatttcctctaagtctatctctctcatctgattcctgcgttttttcctgtggtccaatcaaacggtcattcctgtgtttttcttgtgtttttcaatcctttgttttacaattatattcctgtcagaatgtgtttttcctattcctctgttttttcattcctacgatttaaaggagccctaaaagggagaagaaattttacctgaaaaaaaaaacactcgtggcttcagtttgcaggcatccagctatcgatccagattgtctcatctttcttttcttttcatttttatataaaatcctttttgagaagaagatcgcccttctttgatcttgaattcctgactgctaatgcacaatatacatgagtgtgtagtagtggcggtgtactacgtatgttttttaatagatgatctagtgatcttttaagaaaacgttagatcatttatctcattaaaaaataatataaatatactaaaatataagtcatatttcaagtttctttaataataaaataaataacatttatgacaaacgatcaaacgccgtgcaagtcaacaacgtcatctattaatataagtctggatgggcccaaatcgtttttaatgggtgagcccaaaagtttgaggatgaatgtcataccatcaagctaaatgggccagaatttactttaaaaaaaggaataagtttatctaaggtcccttaacttgtcgacgaatccgattttcgtcattcaactgcaaaaccagatacagcgggtccatcaactgtcaaaaccagtgcagtagaggtcccttagcgatttagacagtgattttggctgacgtggcgcctacttggctaatttgatttggtcttcatctgacgtgacaatgacgtgtcgcttacgtggcaatttgatccagaaaaataataaacctcgtgggacccacatgtcagtgccacatacaaattaataaaaaatttagtggggcccacatgttattctcagcccccttcttcctcctctctccccatctccctcactttcaactctctctcccctctcctctctcgcgacggagagacagcggctcgcggcggcggaggcaaggctctggcggctgtgggcggaagagccgcaccacgtcggggagtccaggcacgaggaacggctcgtcgtccgacgcgacgcagtcctgtggggcgtggagcagcagtgctcgctgcaccgagagcgcgaagcaccccatccccgtgaacgcgtaccgcgggatg

SEQ ID NO: 61339 - DNA, 979 bp, Oryza sativa
ttcaagaagccgtcgccgcggctctgcgagtcctgcggcggcggcggcggctgctgctgctgatacccgccgtagtcggcggcgactggcggcggcgcgccgtacgccggcggtgggtaccccgtccccggtggcgggtacgctgcaacagtagataatcacacatgcatcagctgatgaatttgtccatcaaaacgaactcagaaaaaaaaaataaaaaatgtcgggatgcatgtattttctcctaatcttaataaaatttgtcgcgtttcttcccgaccaggcaaaaaaaaaaagaaacaaagaaaaaaaaaggagacctgacacacaactctcacaattattttctctgtgctaaatcacaaaccagggagttctccaatcagatcaagaaaccaagagatttcaatacctgcagtgccgggaggaggaccttggtagctcatgatcactactactcaatagtagtaaatcctccaaagagcaagaagagatgcaaaccaagaacaagaatgcaagataatggagatgagaaatccaagctctcctcagtttatttaacgctggactctctatctcctagctatatatactcctacatatatagtgctactaaactttatttatttccttagccgcgttaataattaattaatgacaagaagaaaaagaacgccgaatggctgctgcttatcccactcttctgaaaaacgcgttgttttacgtcgtttacgctacatttatttagacgtacgggatcgggttctccatctcttctacatgcctttttcatttttcaaattgaaaaatattgaaaaggcgtcgtttttagattgtttgaacatgcactatgtgtctatatgtactgccttttcagttttcaaatgttgatcagagatggcggggaactgaagaaggctcgtttgtcaatttgacagaatcttcttctaagcaatgcagggataagctagctaactta

SEQ ID NO: 61340 - DNA, 1140 bp, Oryza sativa
tctgtcaagcctttaacagtgtacttctcctcagtcttcctgtgacttacagtaacacacaggcctttgagcgcattgttcaattttttcaattggtcttccaagagcgggtattccatgaacttcatagtcttaacaaggtccaacacagatccagctttccaacatggcaaaaccgaatagtccacacacaggatcagccctttctgagtgcatttaaggctctgctgggttcctttgagagctacaatattgctatcactgatggcctcactgccgctctgcgggtaaaatccctgaccaaggacaatcttgccgaagctagatgcctcacgcacaatgacatcaaggccctgcatgacatctctaggcccaggccgctgctccaagagttggcttaaaggcagcggcttcttcaacttcactgatacaatgtaggtccgtgaactgtccttcacacggaatttgctcacagggactatgcagtcttctggtagttcagcacaagtgtataaatttctctctccatcataagcaacagctgacgaaagctcctgaaggctctcgtgctcgaagagctcattcttgactgtaagaagctctgcctttgagagctttctgttgggaccgtcaccaagcttgattcgtatttcatagtgaaaaaaggttgattcctttgggtagtcgactgaaaaatggttcaccaacaatttgacctcgcctttagataatggacctccaccaccaggtggtcttgccattggcctatgtttggtaggtggttcttctcttttattcttgttactggaagcaattggggttgccggtggttcttctttttcatcctcaccgtagggaatgcgctctaaaggaaacggaagagtggttagaaacagagaatgtcaagtttacacaagcaaacccaccaactcaacgtgtagttaaacttaaaactagaacagaagggatcaccaatctgtagatcgatattccccctaaagtaatatgattcacattcaagcaaggaattactcttcctatgaattttctgaaatctaaatgcagccctgcctctagaaaaaaaaatgttgatggtacgtgacgtcaacaaaaaaaaattgatcgtatattcagattcac

SEQ ID NO: 61341 - DNA, 690 bp, Oryza sativa
ggcacctattgaacgacgggcagtcgacaaagccctgtcgaacggctggcgttcgacacgctcacctgtcgaacggagggagttcgacagggcccaccacccgcgccgcgaggcctgtcgaaccgggggcgttcgacagggccctccaccgaccctgtcgaacaatgggcgttcgacaggccggcttaaagccccgtccacccaggccgcgagttcgatttgtttgaggaccacatcgccagccgccgccgagagtcgccacatcgtcgccgtgagcgccgaagggagcgaggggaggggatagcaggccggggaggaggccgaggaggcgccggccgggaggaaagggttgacgacgccctccagcagtgaagttaaggtatacattagtaatccctaagtacaatgcatatgaaagtttaataaaaaattggtttaagagttgttaattgttttgcattattcgatgttagtatgtatggttagcacatatttgttattgctaaatgttggtagaagtatttaagtaattgtacggttaaattagttcttagtagtacatattattgatatgttgtgtgttaaaataggtacaaaagtgttatattttatttggattattaaactagttgtttgttactaatagttgtaaattagtacacggcaatgtagtataagttgtaatagggt

SEQ ID NO: 61342 - DNA, 10864 bp, Oryza sativa
ttgccaccaccctacctaggtgcgccgcactcgcgaacaccattcaccgtcggcgtctccacctcccaaccacgggcgcccctcctctgtctcctcttgtttgctcggcagaaggaggaagagggaggaagacgagaggaagaagaaaagaaagaaaaataaaaagaaaagaatattccttgataggtgggcccttacacagatgctatttaattcaagggttaattggatccataccattatagattctttagttttgaaatatgtcattactattcaactatttagaacgatgtcattataatttttcaggtaatgaaaatatatcactacataccctttaccctttcaatgtgtttaacaaaattcttagaccaaaatgccatcttcttcttccttggtctgcttccatctatcctgttcatcttattcctctcgattcatgttgcgggttcagtgcaaggggttgccgatcaggacgggctagctcaagtcggctttaccaaagatcgttcaccatcgctatctttactgcactcaaggatctcctgcagtcagcctttagttttattttgattttgtggcaacaaatcagaaaccaattagcagaggggaagcgtgttggattcatccgttgggctgttgctgctcctgcttccatcttcgcagctgctgcagccagtcagagctacccgacctgcctcctgttcatcttcttcctcccatttctcgcacatggttggttttcagctgctggaggacgtactcgtagttggttgcctgctgctcggcagaagctagtggaacggattttgggatgtttgaccaactcaattaggcacatagaaaagatcgatgttcagtttgagattacacaagaaaaaagccactctgtcagatcatgcacgtgtggtgaagccgccgaggcgaacaacaccagctgcaccttccacaacgacgcgtcgacgacgagctccactccttggttggccagtgaagggaagaagaggaactagatggcgcagcatgacgctggcatcatggctgagagaggaaataggaaggaagaagacagcttgccagattcggatccagaaggggaaaaataggaggaagaagatgaacaggagatgggatgagaaagatgagggcaatttggtctaaaaattttgttaaacacatccaagaggtatgtagtggcatatgtctaatacctgaaaaattgtaatgacatggctctgaatagttgaatagtaatggcttatgtcaaaattgaaaaatttataatggtatggatccaattaacccttaattcaaatcctatttttagaagcccatatctcctaaaccgtagatcccatctcagtgaaacttggacccaaattcatctaagttcaaaccctacattttgatactaaatttgctaatttaagattttatttgaattttcttaatttatttaaataccatttgaattatatatatttgatttaaacttatatttgaattttcaatttaaacttatatttgattttcaaatatttccttttatcccaaaatacctattagccactaaaaagccgtcagttggaactttacgccttccatagggacgttcgtgtggtctatgggcctcgacgtcataccgttggttgtaaatcctggtagaaccaaatccaaggtcaaagtgttgctcctcgcaccccacgcctcgatgcatacagtggtcggagcttcactattccctcgacctccacaacacgctgcacagtaagctctcgggctctgtgtgatcctagccgctccgtcgccactcacagctgtcgaactaacacttccgccccgctaaacctgcaccagcctcctattcctctagccgatatgttgtctgttgacaccggctagagaagatacaaaacctagtcattatgctgcccaactctagcaacgactagcaaacaaccaaaccctagccaatatattaccctaccttaataacagcacaaatagttaaaccctaattgccatattatcgaaaatccacacccgttacaatatcacccatttaccatttcccatattctacctcacctgaaccatacactctccaactacctagaatctatacatacaatataaatcctagccgatatgctatcctactccacaattggctcaaatataaccaaaccctagccattatactacccaaacctaccaccagctaatattagccacatatctgcttaaccagttctattatccagtatattccctactctccaagcaaccaaagcccacacatgaaatttaagcgacattagttgcttaattccctctccaccttacacccctaaccttccaaacctatatatgatatataagcctagtaatccctataccttacaaaggaggtagattataccctaaacctagcctttctcaccattcatcattttcttgttattttatggcttttattgaatttggctcttcctcttctttagtagagtttattatattttggaggcaacctgtggcatttcaaggatcgggtaatcaagttgcttatctcgaatttatttgcattggagcaaggcaagttattattcctccccttcgaacaaaattatcctatattctatatctccattatcttatgcattagtcatacatgattttgaatgcataacctgaacatagaaaactagatatatgctagctttgcttagccctacctagttagactatgcataaaatataatgaacttagattggaacggtacgctagaaaagaaatatttcctcgtggctagtactgtttcaatcgacataggccttgccaagtacgtgtgaagaatgaacgagtacgaccacaattctcgagtgggtatggacctagcggattaagttatctagcaaaggtggtacctctgtatagtggttctatatttaagtcctcgagcagggtaattgtgatatttaccgaggtgcaggtaaatatattgattatcttgcgagctatacttttgtgaaaccctgattgcgatgacgtggtgtcatacaatcagttctctctaaagaccccaagaacgccagaactcatctcgctgctgataacgcacgttcagagcgtatgaggattagagtttatggaacaggtaccactgatgttagtaaccgaaaagctgggccatgacaagactaatgtgtttggcacgtcatggattgcgggtaaagcgtacatctactgcagtatgaatattcttaaaactattcgaatagccatgctcgtggttatcaagcatcgggactcacaatggcatcttggctataaacttaattccagattttattaaataatgttgcatttcaaacattctaggttcaatacttctacattctcggccttctgcaagtaaacctagccttactcaaatataattattacatgtattcattacttgatataatagcttgatgagtacattgtattcacccttgctttaacccttctagagttgatttgaagttcttacttaagccgggagttcaatcatataagttagtcccatttaaacttagtttccaagtctagcatagttagatggtttaattttatagcaaaatagtagagttggttcattctatagcttctgctgtaatagttagcaacaatcttgtaaataacctattatattttgtaataaaatatcctttgaaaccttcttcaaatgtatgcaacgaagatccagattgttgaacttgtatcaatctattgatccagggcttgatacaaaacatgtcggttaccgaatcttaaattttgagacccgacagtgtgatgtgtcatgaggtcaaatccacgtacaaatctaatgaaattacactaagaacaacgagaaactgcacgcacgaacctctcccctacaagaataaagagtgatcagcaagaaacaagcacacgagccgcacgcactaatctcgacgcaaaatcataggctgaaaattcgacagatttggcaaaaaaaatatctatcgacgcatatatagcaaaaccgctgttttgcccttaaaaatatcccaaagagatggcaattcacttggtcattggttcttttcacatctaacttgtgcttaatgttgattagctgatccatctttgttaagtatgattcgctcgtagacctctactcctgtcgtaaaaacatgcctggcgtcttgcatgttgggaatatatgatatgcacacacacatacacaccaactaataaatatgatcaaaattttttgaagaatatatacgtacattttcaatagtattatatatacatgtaaagtctcatcgtcaaatttagtatacatacataaaaaaaagataaaattctgacaaactcaaaattgccataatttttgtttctttacagctaaaatataataaatttgaggttaaaattttacacataggcataatacttttgaaagtatatgcataaatttttttagattttttcacgatatttgttagttggtgcacatgaagcgtgcacgtgaaatttatgtccagatgatatattcccgtcttgcctatcaatatataggtacggtcttttaatttcaaacacaactaccgccaccactttcttttgagaatatttcaaaaccaaaaaagatttatataatatgcttgattttcatatatcaaaatctaagtatttaaaaacattaaaagtatagtaatattcaaaccttgtaaagtgtaagatcgaatcccaaataccaagccaaccagagggaaggtgaatggttgtaacaccaaaaaccaaaaactttaagcggaaattaaagttaccctcttttcgatgtagatcgccgccatcgccgctgctgtcaaaacgccgccgccggtctgaccgctcgagctccccggtctgactgcccagtcgccgccagtctgaccggtgtatattcgccggttggaccgtcgcctctcgccggttagaccgcccgtagtacttcggtctgaccgtcgagatccagaacaacaccggtaaaaacacttgaagatatagatcaaatcacacgactttattgcataaactagtgtttacaaagtgcaaccacagcactcctctccacaatttcgactaatatcaaaaccctaactcaaagctctaaaagcttgatctaaaactccatataactcacaccaagagacaacaccctgcccctctatttataccctcatcacggctgcccctagccacgaatcctactcatacaagaagtcctaatctcataggaaacctcccatacaagcaacaaactcaacactatccaaatttggactcctaccaaatttgactccgctttccatacacatacaacaccacgtgtacgccatatggaaaccttcacctctacatgcattgttctctagcctgagcatcccgcatgatatcctcgaccgtctagacctcaacttctcccaagcctagtcttgatccatcaccggctatactcccatagcctcaagcaacacttgcacgtgaacaacaaagaaactccatatccgagtgcaagttatccccaacttgactcatattagcataacaccagtatccacacgtatagaaaccaacttaaagtcaaatccacaaaggaaacatccaaatccaaatccaacaagaagtcggctcactctgtcaactctgcctgtcagaccacgtgccggtcggtctgacacctccggtctgaccggccgccttagcccggtctgaccggtacacaaccgtcagcacaaacactattcaccgtctgaaaacatatctccgtattttcacaaacacttacctttgacaattgttcatcaccaagatcatcacatgatccaacaatctcccccttgatgaatacattggcaacgtctccaaaatgcaatttagtgtttttgaaaaacgaaaacaaaaacgaatcaaaaagctcagacggctcaaaaatcacaaacgtgacgaaaagaaaactctcccctttttaaaagaaagaatttcccatatttgaaagaatttcccatatttgaaatccaaaacttcaaaatcaactatttttaaaatggaagcaaatcaattctccccctttcaagaagcatgcattttgtatgtttctccccctttgacaatgatttcatcaagaatgcaaaagagaaataataacaaatatatcacaaatgcaatatttttattttctaagttttttatcatcgagagctttaaagtataccaaaagcaattcatgatcatgttttgcaataacaaggagataaatttattaactagttaacaagcatacactatagtataaacatgaatcaaaaatattacaattaagctcaacttagcaataaagattcatgatttcaaacgatttataatgcaacgtattcacaagcatataggttgaaaaaataaacatctatacatatacacctgctgcatttatcactctttctcaaataagctttagcacaaaacaatcaagagaatttttaacttttatttgagcttctttttgctcatattttttctctcaagactgtttccaaggattcggcacccattatttttgctcacatcgaatacgtcctcaagactgtttccaaggattcggtattcattattttctctcatagatattttttattctcttgtccaatgaatatttaaaagctatttgaggaataacaaatccataaagcatatatatataaacattcatcattcaatcaatatgctagcatcaatattgcatattttcttaattcaagtaaaataattagtgtcatgcattatctcacttaaaagcaatatttaagcttcatgaaaagactaaaatgcatacaagctaacatagcaataaataaatctcaactattttgctagcatgcacaagaatatactagaggtataaaacaaagctctctttttatcattatatttattttcatatttctaaacaaatgcataaaaaataaacatgaatacatgaaaaagcacaaactccccctcaaattaacctccaatttccctcgaagaaaaatcaagaagaaataaaagatttgaaaaagacatccaattgccaatgatatcaccaaggttctcatgaattgacatatattcatttgaattaaccaaaactactatctcacaaactagcacatgaaaagctaataattgagaaagtagaacaaaattatgtcaatccaaaattaccttgatgttacctttaaaagcaaccgtcatctcaacgttgaacactcatggggagtatgcccaaaaatacctacgaaagagaaaatgtcgaggcctccgtgttggggttagaaataagaaattttggaatccaacactgagtcacacgaccaatagaaccagtaggtacatatgcacgaacaaaatcagaatcagacttacctgaaaacttaccttgaggcttcacaaaagtccgatttaaattacacgcaaaatagccctgaggccggtctgaccgtcgctgtccctgcggtctgaccggacctggctgccagtctgaccgtcggtacacttgcagtctgaccgctggccgtgaccggtctgaccaactggtcagtgtcgatctaaccgagctcctcgatccaaaacccgatttttgccaccgttgtttagcaaaagcaatttctctttcttttttctgtttatgagcaagtctaaaacaaaacccaaccaaatgtccatcttttccaaaaaaagaacaagtatacttctcacgacaagaaatttttgcagtagatggttttgaaattgatggttttgcaaaagactttttctcttgaatcattgaagaaagagaagccaaaatttcaccgaatttaaaaatcgttttcttttgttcgggttttgtcaaaacagcacctttttcagttatgctcaaaacagcaggttggtgatttgtaaaataggcattagtattaaaacctacaccacgattgaaagtgctcacttttgattgatccaaaatcatgttaagtttctttttaccatctgaaaacttttccaaagaacttttcaaataaaaaacttcttttttcaaattaacgcaattttcacaatcaaccaaaacacctttatttttgcgacacttagaacaagaaagtacttcatcttgttttacaatatttttgtcacgccccaaactagccccgagcagaggccagtataaggcgatccaaattaacctgtatgcctgtaccagtcccaggaaatagcgctggtacaacaggaagacagaatatcacaacaacagcggtctctttattaagagtaggattacaaccaaggttggaactgcggacagaacccgagttcgcaacaacattacaaaaaggcggaagcggaaagcggagactagccctaagccacaagcaaagccttggggaaaggccgaaaccctactactgctcgaagtctgcttgctcctggaagaactcttcatcagccgggtccacctcttcgtcttcaagaactgggggggtttaattatatagagcaagggtgagtatgggagtactcagcaagtcaggggaattaagtgtttaatgcaagcttcaagggaaagccagttgtttttcacaattgattttagtttaagactttcagaaacatctaagtgagtgcttctcaacggcgcggacgagaaagtgcgtctcatccggccggagcagtgaaaatgtgtcgattgattcttgtcggcacgagaggctcccagccaatcgtttaccgacccggctgctccaacagccacacgcgagaggctccctgccaatcgctcaccagcaccggtgcaccaacagccacgaatcaaacacgtcggaacaagaggctccctgccaatcgttcaccgacaccggctgctccaacagcctcgaatcaaacacgtcggaacgagaggctccctgccaatcgttcaccgacaccggctgctccaacagcctcaaaccaatcacaaaagggaaaaactcacacaccaacagcaatttccaaagtgttcactaaaactacgctaaggaatcacctcacatcctcccatgaccgtgggcacggctgttcgaatagttattaacctctgcagaaggggtacactttacccacacgacgttactaaccccgaatcacccagcccgcgactctcggtcacgtctggcgaccttgaggctttcacgacaaggcatttcgaaagccgactcagggtcatcttatgccaactggaggggtcccacggaccaacaccaggttaggtcccagaccatactgtgccaggaagcccaggggtcctccccgacaccaccccagcgaatccacttgtcccttggcagcaagatttccctggcctagctaattactcagccaggggcgtcccatatcacccatgtggtcgtacttgacatatgctcggatgtaattcccaaggaatcggtccttagagcgagaacggacagaccgtacctccagtacgtcttccgtaccgcgagttttagaaactcactttattttcaaggcaccaacccaagtgtcgggttttccaagcattttgtaaactcaagttttacccaggtgatcaattttagagtttgaggggagtctcgatattcgtacgcgaggtgcgaataccgagatttcacctgacgggtgtcaagggtgttagggtattcaaatatcaaggaaggtgaatgcagcaaatgggtagggcctgccggttgtattgcaaaccgaggccaagtgccaagtgtaacctagttaatgcatagtttgcggaaatcaaaatacttaatttaaactataggttcaattgatcaaaggtgacttgccttgctcgagatcttgagcttcttcctcgaaatccgcgcactgcgggtcttcgggctccgagactacacgcagaacgagacgactcaacaaagcgataaaaagaagccctattaaagaccattaagcatgccattggatagatctcgatttttgagaaattttggaagtggaacggagtcaatcggacgatcggttgagaagatatgaatttccgaagattaaaggattttctggaaaaagaaaaggaattattaattccctggaaaaagaaaagaaggagggatgcaatttagatttcattttgggcggctaagggcagcccaatagaatggaatgtacgcggccgaaataatgggccgacggtccgaaggagtcggcccacagccgagtggcgcggcctggtccggcctcccgagtgactcggggccgtccggcctcccgagtgactcggggccgactgggccggaccgagtgactcgggccgactggacacggaggccgagtgggccaaggaggggtgggaggccgagtggcccgaggccaactgggccgagcgggaaagaggccgagtggccgagtggagaggagggggccgatgggccgcggcaggccgcgacctacgcgggcggctggtccggtggaccgtgtccaccgcgcgggcgctagggcggggcccgcccggtagcggcacagtctacgcggaccgagcgcacggaggggaaaagagggagtgtgccggctggcgcttgcgtggcgcctgcgtggcggccacgtgggccggccgggcgaatgaggggagaaggcccgggcgacggcggcgacggcagaggggctcgggcgacacggtgcgaggccggagaggggaggggagcgcaccgggatggagaggagagatagagggagtgagccggcggctcggttcgccgggagaaggccgacggcgactgacgacgacgcgcaacggcg

SEQ ID NO: 61343 - DNA, 5880 bp, Oryza sativa
ggtgaccgaggtgctgcacggcgctgcgaggcgagaggtgaagacggagcgacgcggcggcggctaaggcgacggtggcacacggctggagacggcgtatggtggaggtggctcgggatgcacggtggaagggtggttgcggtggtggaatggggaaacggagcggaggccggggtagagcttggcacggcgttgccggcggcgcaagcggcgaggtgcggcgacgactagcgcggcggcagcggccggctgaaggcggtgtgtggcggtagtggctcggcctcgcgatgggaaggtggttccggcggtggaggagggagatggagtggatgccggggtgcggcgaggcgctgtgatgctataggtggcggcggcgcagcgcggcagcgacgggagcggcggtggcgggcggctggagatcgccggcgagcggcggtgaaggggatcggcgtggagagctcggtagagggtgtgggggactcgggaaaacggggaaaaaggaagaggagtccacggggattgattttatagctcaagggggcgaggagagggccggggagcggcggacttcgagggggagtggggcggcgtcatgggggtgtggcggctcggcgtggcgtcgattcccgcggggagagagggggagtggggcgggatgtggtcgcgaggtggaaggggtctcgggtccacgccggttgggacgaggggaggtgcgggatcggcagagggagtgggcggcgtggccgacggttggagctggccggaggttggggatgacaggtggggtccacgggtcccacctgtcggagagagagagagagggagaggccggctggggaggcggaacagacttgagggagggagagagccgagcgggccgagggaggaggccggcccgagagggagagaaagggggcgcgcgggccgcgggagagaaggaagacttgggccgaaaatggcccaaagagaggaagggggattttctttgttttctttttattttaattgattcaatgatccttgtgctattaaaattatttctcgagctccgaaaattcgcgggaaatttcagagagtattttagggcacaaagaatattacaaaatattctcggccaatgatttttaaaggaaatttttaattccctcaataattcacttggataaattgcttaactttttatttaatttctaggaaatgcattattaaatgatttttaatcccgaacgaaaattggggcgttacaaatctaccccccttacaggaatctcgccccgagattctgggatggctagaaagaaagctggtgtaggctgtcggtctgactgatctgacgggtctgcacactgcactgcccctttctatcttgaactgactgattgactgattgatcaaacctgcaccattgaaatggctggattcgacctttctattcctttgctttgccaaaactagaccggctagttctgcttgaactgacccggaccagaactgtggctgctcacgaaacttacttatcttgatctgaactgttgacactggcagtttgataacctgacaattcaccaagctggctagagaagggtgaagttgttcctaagacttgcatctggcatttgtaactcattgatcctacgtccgcttgaacgggtcctggctcgaatgacacgtaattccaggaaacctgcttgacctgtcttttgtctgaactgcaaccgtccctgatgctgcttctcaaagctgagctattgacctagcctcaccggtgtacctcagaattcaatcagataacttgagatcggtgtaactctgctgacaccttgcaactggcttcttcaagtactacccggattgttgcactgggttgaaccttcaactaaaacagcgatgaggtgagccaaaactcatctccgagacctaccccccttacaggaagtagtcttactttcgcctgactgggaacaattggactattgtccttggaaaaaaaaataaccaacacttctctgacttacaaagaccctcactttgaaaactgaaacttcgtcgattcatcaaaatagagcaatgacgacacactttcatcccagcaaaatttggaatttaaccctcagttgctgataggaaattccacataaagaaattctcatttagctcctgatcttactaactcttaactgactttcccatcagtactaactgctggcatgactgtccttcttctgacctgacttcggtgtcgtccacctaaatgggttgtgtagttgatatctcaaaactaaactgaccgactcgcattggaattgacacaacttgaggaactggggtgctgcgagtagagctgttgtcttgatgacgctaacgccttgtcgttgaacaaccttgcaagaactgaccttgtaaaccataaccactataggtagcacttgttgcctctgggattggtggtgacttagctgtgctggtctgctgaagacttggtggcgtactgtctgaggttgcaggtgcttgctcttggaaaacaaactgactttcgctctgatcctgattccggcttgcatctgagcttgtacttgttgttggagacattgtcgttgcatctgctgctttggactctgcggttgcggtatcaacatctgacacatccatcattagatcttggctagccaggatctgaccagagcgaggtgctccgactcagctggtagcttgttgtcttgaactgatccactgactctgactgcaacacactactgctagagttgcttccgctacattcgaccttgcatcgagctttgcatctcctgcatcaatacacccatcttctgatcctggataccaaatgttgatcacgagcaggggttcttctggcatcgggagtacctggtagctttcgactgatccattgatctgtgactttcatacaccgttgttgttgctcttctctctgatactgaccatctgctgccagaacagaagagaggtggaagagaggggttgctaaagataaggtactaaaccacttgcctattgatctgttgtgagtagatttttatggtttaagttgcttaagcaaacaacctagtatggtcgcatccccaccaatgatgcaaaccatacccctgcacacaagcaaacaacacacgatcttgctaacgaaactacccttcagggaaggattgggtttaggtgaacttcgggaaaactcttcttgatcttcgcggaacgacgactctgaactgaccttctcgctctttgctgcacgaagcttgatgcttgacttgacttccgaacagacacgaagctgacagtttgtcctccacggtttaacaactataagaattggagggacaaggaggagaattttgaaaaaccgtttcgcaaagaaaagccgaagggcgaggggagacattttgcaaatagggttttcagaaagcttgtccttagggtttgaccatttggctcaacctacagtcgagttggctctgataccactttgtcacgcccagaaatttagcccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggtgatcctagcggggcttcagctccactccacaggcaaaactcaactggggtctgagccttggtcctctaactccatcttcagctcagaagcgctacacttctgaaaagggggaataatagcaaggctgagtacaaccaccgtactcagcaagccacaccaacgatgcagacgtgcaaggggatacaaggacggtttgtggctatttgcataaaggcggttgtaaaacattttatttaacaaacagtaaaattgttgaataattaaagtaacattaaaatctccactgatcaacgctacaccacgttgaacaggcccaaccaacccacctggactacagtgtattgggtcgatttattaagatgggactaatcacggtgaatctggtcgatcgcccataaccgcgggcacggctatttgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacatgagctagatgatttatcacccaaggttgacaaaggatagatatcaagtaaacatggcacaagcgagcagataggtaaaccctgaccccgtgtaattagcaaaacatgcatatttatttgtaaacggtaaaacatttataaattgggatcaacatgctcaaggggaatgtgtgacttgccttgcttcttcacttggattttctgaactcttttcctcgcgaccgcgatcttccgaaacaacggattctacacgctggcacgcaaaacgaggaaaaactctaataaagaccaagcaaacagtacataaaaagtaaacaaacatgtagagctcaattttagatgaattttgcaagttgaatggctcaatttggagttcgaatgaattagatatgaattttagaaggttttgagccattttaatgaatttctagaattattaccgatttattgcgcaatttaaatcaattatgacgtcatccgacgggggagaggtggcgccggcaagcgggccccacctgtcggtgactcacgggtggcgggcgcaccgtggaccgagtccacgcacgcactggtccgcgggcgcaccacgtggcagacacgtggcggccacgacggacggctagcggaggtggcgccgacgtggcgccacagaggcaccgacgcgggcggcacgggaaggccacgtggacgacccagaccgccccgaaggaggatcgggcggccacgggcgagcgggagccggctcaccggtcgaccggccgggagcgacggcgcacggcccgatggtcgctggcgacgaccacaggcgcgacggcacgcgcgggaggcggcgcaaagagggaaaaaggagaggaaacggagggggtcctcaccgaggagcgccggcgacgggacgaccatggggaggcgaccggcggcggaaaggatggcggcggccggcacgggaggcgacgggaacggcgttccgacgacgcccgaccatggcggagccacggccgagggccggcaagacctggggaaattattggagcggttagggagggaaataggcgaccggagcggcgagaataccacgccggagaggagaggaatggtggggctcaccggcgaccgagagataccacgttccggtgggtttccggcgatgaacaacggtgaccgaggtgctgcacggc

SEQ ID NO: 61344 - DNA, 29939 bp, Oryza sativa
attctcttgctcttttgatccaaacgttagttttatagcttgggtcttgacactaggaattgttttggacaggttgattaggttgctctcgctgttgggtgggtgcattagtgaacatattgttgacaggttgagttttctggtcttttgtttccatgggagtataactaaggatgacgaacttacacatgttcacaccacacaaacacaaacacaagcgaactagtgtgcaccaagtacacagttcaaataataaaaggaacttcccaaacccaggcatgaatgtactcccaataaatatatccttagtattaaatggcttaaaaattcccttttcacagtacagtagctagcgagagtgtgaaccacgtcacgtaaaaaatggaacattccacacctcgacacttttttattagtaacgcccgtgtgggtatttctccaaataaatgtgggtagaacaaacatccctagctagtacccaccattgtgtcatcgacactttcaattcagcctagctaagtcagtaaaaaatagttgcattgaagataaaagcaacattgagatgttttgccatttattagttccctgaaacaaatctttagcatacataaataaagataaaatagtaaatgtgattcaagacagaaggtttatgctgacctcactgtagatacatagtccatatcaaacccaattcaacattttgccctttaatagcatatagaggacataacactaaggattcacatgtgatgtttctcaatgaaaaaaactatatattatctatatttaatcatgtgatcattttttgctctgtacttacaaactttttatgtatgtaaagattgtgtgatcgatattattgctcacaaatacccttttcacactacataagtgagcaagagtgcgaaccatgccacatataaaaatggaacattccaatctcaaaacttttttcattaaaaaaaaagctcgtgtgggtatttattccaaagaaatgtgggtgcaacaaacacatgagtacccaccattgtgtcatcgacactttcaatttagcctagctaactgagtaaaaaatagtggcattgaataaacatttggatggttttgttctcaacataattccagcaattaaccttttcattaaacacacgtatatgtacctttcattaaacatttggatggttgttcccaacatgtacctttatgatagttcttccgatctggagcacatggatactggtgccaaggtacctgctcaaaggacgggcgcatgttggcgatcttgttcacagacatgtaaggactcatgactatgatgggcctcagatgatggcacgctcaagggatggagctttcaggaagttgagctccttcatatggaccatagagagaaccaagcttttcatggtggggctcatgatgtccatggaaaagggcatgtcattggggttgatcaacgagagcagctcaatctcagggcagctgacgagcaaccggtcaaagtcattagcttgagtgtatccctcgcacaggatgagctcccgcaggcttggcaggaagacggctttgctggccctcagggtcaacttttacggtggttggccaaagagcgcgacagtgtggcacaccatggaggtgcaggtgaggatcttgggcgggagggtggcggcacagcgcatgccgctgaggtgcacgatgacaagatcctagacgttgtcattgcgttccaaggcacggatccaatacctgaggctgtcgtggcggttgaagctggtgatggtgagtcggacggagtggaaggggcccgggtgggagtcagtggtgcgcgacaccgtcttcaccaccgcagagtgtgtttttggaagcccctggcaacggggcccactatgggacaaaacagggcatcatcgaggacggaggggcacaaatccctagatccaggcctagggatgggacagcaccattggcggcaggcaggcgggacacaaggtcgcgaggagctcgggtgggagctggctgatgccggttctatcagatgggggagtggtgttggtggaggctggcggcagcggaaggtaggcaaggatttcatgcatgcactcgttgtgctccatatgatcggcggcggccgacagcgagaggagagcggcacactgtgagagggaatagggaaacaacgatgaaggaacaagagagcgaagatgagttgcatcagaaatgagaacaatgctagggttccgtgccgttgagccgacaacgtggtgggccacagtggaagtagggtcagccgtagccctcgcctcatgaggctgcccctgcccctgacttgcgccatgtcaggttgaacaaatcttatagcagtttttctagccttccaaaccatcacccccatggaagcttgaggtcgaggccattgatcgcctcccaaatccatggttgcgatgcgagactgtggatgctttctaaggccctgactcctaatggttctttgacaacaaataatgcggataaatgacgccagggcaaaaaaatgtatgtgaagtatacaatatcagcctagcacaaaggggatttttttaaaatttttctaggatcttggtgatagaatgttctatcttcctgttctctgttctacacatatttttttgttcagtatgtcgcctggtccaaccgtccaagccattttaacatttgtatttatgcacccgttcatgaataattatgtatggtgcattttttattaatacgagatatgattatgtctcagccattttgctatatatatatatatatatataattgggcttattaggataaatggctggttggataggatttttttagcaagggcatgagagcccccatttccattttgtatggttggataggttaggccatattgatgtgttgagttttgaaatcctttatttttgtgcgagtataactaaggatggcaaatggcgagtataactaaggatggcaaacttacacatgttcatagcacacaaacacaaatgtgagcccacaagtgtgcagtctactacttatgtgataaatattggaactatccgaaccttgaaacatttatttattttccattaaacacaaatcttctgctatttccccacaaaaaaaaaaagatctgctgctatttactctaaataaatttaaactgaggtgggtgggaacaaattaacacccttcatcccgcggcactgtggttgataaaataatatcatgggtgtaaatagtgttaataacattttctatccagcctaagtgtgacaaaacagtgaaccttaatgccatagctaaagtgttttgcaattccttgaacattaacacatcaaattcaatttgtcttgcttgaatttgcctgagtcagatcgaacaaaaattcagcgctcttgatatattataatctgaacactggttaatttggcagcctatcgaagatcctcagtctacccagcttgatgactttgagttctgggaggagatcaattcagttgaatgtgtcagatccagcatcaagaaggtagtgttccatgggttctcctggaagaattctgagatagcgttcatcaattccatcgccgaaggaggattggtgctcgggaagatctgtatcttccagagtcgacatggtactgccccagatgatgatgaactgaatgctaagctgagcatggtagcttctctgaacatcggccttggccgtacagagatcatattttcaggtgaagatccaacctggtgctctagggcggcagctgatctttctcgtgctgatcctagtaatggtaatgatctttcatattttcatagcgagatgtttttgccatttaatttcctgaaaaaaatctttaacacaatataaatgggatgcaagggagaaggtttatgctgacctcactacactagcccacataaatcccaattcagcattttgcccgttattgaaagacggagctctagggtctaaaccacaaaatcacatgcacatccatccatgccaatcagtggtggagtcagcactgccgtaaaacctgggcgactagtagcgtttttaaatgaccgactgatttttgtacgtgtcaacggctaacgacaatggagacggtagtggcggagcccaagtagccgaccgacctgccttccgccgctgatgccaacaattctcagagatttttgacatttaattccctgaatactaaagcaataatcagaagtttttgccttttaattagatgaaacaaatcttcaacagaaataaatgaattagatgtaattataaattattgtcaatatatgtagttactgattgtcgatatatgtagactgtgtaatcgtatttcctttttcttgttttgagcccaatggcataaaacgtagactcaagatttcaaggttacaccaaaatcagaaaatatacaaaaacttcatctgatgaacattattgaagatattagctaggtttcatcaataatttttatgctagctaatcaattttgatattgaatcacaaaaggtctggacctagatccatgatggctgattaattaataatttgtggactttaaataataataatttgtggattattattattattattattattattattattattattattattattattattattattattattactattattattattattattattattattatttcatttcaccttctctatgtatgaaagatcccttttctgaatactgagagattttcagatacaagaatgcatgatattaattctgacttaggtgtataatttgttctctctctctctctctctcttgccagagtgaagctttattttaacacaaactctgatagctctgtagttcagttgtaacttttgtaacagtagaataaatttcttgatttgttacactattgtttttacataaataaacatattttgatatatgtgtaacaaaaattaacaaatgcagtctacagataagtgtacaactaaggattataaacttacacatattagttacatcacacaaacactagcgagcgagtgtgcaccaagtatatacacattccaactttccaaacctcaacataattttctcattgagcacacccgtgcttgtgtgtaatccaaataaatgtataattaagatagaattgcttacaaatacccttctcacaccacgcaaacacaagcgccaagcaagtacaccacacacgccaaatataaaatggaattttccagacctctaatttttttttccaaaaaacacactcgtgcaggtatttactctaaataaatgtgtgtgtgtggggggggggaggggggacaaacactcttactacccaccattgtgtcgttgacactttaaattcagcctaagtgagaaataaaaaaaaataaggtggcattgaagcaacaattggatatggtttttgcgaacgtaattccattaattaaacacacgtctatataaacaataaatcaaatatgcaacacaaagggttaaactcagtttggtgggaaacacacatcatccttggcactactgtcattttacatccagcctaagtgacaaaatactgaacatttttaaacaatagttagagggtttttccattaaatcagttagagggttttgccattcaattccctgaagacattaaagaagcagtgaagggatttgctatttaattcacagaacattaaaagcaaccgtgagatattttgccatttattgattccttgaaacaaatctttagcagaaataaatgaagatacaatcataaatacgtgatgacagagagaagatttatgcttacctcattgcagctagtccaccatcaattccacttcatcctttcgccctttaatagcacatataggcacacaaccctaaggattaaccccaaaattcccccaccaccgcactgtgcccgctgccaaatcccatccgtgtcaatcaccatgttctccctcctttcccttgcccacaaactctgccctcgattcatctcccccaacaccgcgagcggcacacctctactaatgatggtcaagaccaaatcactgccctccccaacaatctcctctctgaaatcgtctcccgcctccccatcattgatgccatccgtaccaccacactttcccaaggctggtcaaggatttggcactcggtgccgctcagcctcgatcactcccagatccgacgtgccggggagaacatcctcgatgatctctccaacagcgccatggtcgctagggtctccagcatcctgtcctcccaccctggccccttcaacagtatccatctgacctgcagcagtatggggtctcacaatgacgccctcaagagctggttcaaggcatttgctgacaagcacctcaaggagcttgccttcctcaacctgaactacccaaatgacatcatggtacctactgatctcttctgttgcaagtccctgaagcggctctaccttggtggtgtccagctgcctgcaaacactggcatcatcccttgttcccacacattccatgaactctgggagatctgtttgtatcgatgcatcctgcacgagtgggacattgagaacctgctgacctgcagcccaaaggtggagaagctctcgctggtcaacagtgcttgtggttggccactgcggctgcacatccgcagccacagcctccgatgcatgctgcattgggcctcctcgttggaggagctcgctatggtatccactccatgcctcgagcgcctcatcctttggagggatgatgctttgcactggagtgactgtaagaagatcaagatctgctctatgcctaagctccaggtcatcggatatctcaaccctgcggaccatgttcttcagattcgtgatactgtgatcaaggaatggagctctagatctcctgtttgtgtttctttaattaatttggattattagtatctaaaattaaacttatgtatgagtgtgtgatttatttagtggtgatattactttgcggtttggtttaatttcatatattcataatgtagaatgacatgaaggctagcgctgctacggttgttcctagtgtcgaggtcttggcaatgactatccgttttggtgttcacgaggaagagcggatggtgccttgcttcctcaagtgtttccctagcgtaaaaatattgcatgttaaggtggggatattaattgtgttccccctttgattttgtttagttaatttttacattatttttaatgaggccatccacccactgacttaacttttgttacaatggtttttgtagtctattgcacgtactcagactaccaatgaggttaacttggagttctggaaagatgttggatccatccaatgtgttcggtcaatcatcaagagggtgatatttgatgactttagtggagaggagtgtgaacttgcattcctctctttcattgcacaaaatgcaaatcagctggaagagatttacatcatcccttccaagaaggatctttctgcagggagttctctggggaatgtcataaatcacttcatgtcttcaatattatgggcttctgcatattgcagggtacaagtttgtgccagtgcaaaaaatgcttggaactaccaaatggcatcagatctctctctttatgacccttttggttatatcgtgtcagcaataacgacagcttcttgtccttccctggtacatggttaagctacgagtggtgcctaaatgtgaacattcttctattgtaaaccagatcaggcagttctggtgaattcataataatgtaatagtaagacaatactgcatgttcaagctgtctgttgtctaaaccttataggttgtattcgatccatatgtttcagatgagatgttgttagttttctcaatgaaaaaactatgtattgtccaacatttaatcatgtaataattttttgctctgttttttactgattgtcaatatatatagattgcgtaatcgtaattcctttttacccttttttatgctttgtgcccaaaggcatacgacacatcccttctttctatataattacaaccacgagcagccaccatgcatatttagccatctaatcagaatagtttcaaccatcggatcgatctgcagtaggtgttagatgaaagtcccctccacttccttaccaattaaaatgatgctattaatctttttccaaccatctaaaaattatttaatctggcagtcaactggacactaatgacatcaattttggatcgacattaccattccattcatctttccgttcagttttatatgcatatactaataaaaaaatgtatgcatatacataggaaagcatacatattttgttttccctcacaatgcttgtacttggtgaacagtaatcaacatgccgatcatggaagcatgcaatttgcctatgtttcatattcatacagattcctgcagcaatgctaggggtatcaacaaataagactaaagatttcatgggacacctagatcagaaaaaaaaaatacaacaagttcattcgatgaacattcaaaatgttaattagactttagcagtactttctattagctactcagtttgaatattaaatcttcagaacatttgatctggatccatgaaaatgtagagaatcatggttgattgaaatttggtggattttacatgtaacatatactggttgttttgtttcaccatactaggaaccatctgaaatgcggggaacttttcctattccagcataaagttaagtttttcatgtaaaccacttatgaactcactgcattctaaatagaatgaaggaatttatgccattacaagaaaattattttgtcataacataattgatgtttacatagcttcagcaaaacatcttaatgtatactaattggagtctctcctagcaacccctacattaatctaaaaggtaaacaagctagaagttcccaaattaatagaaaagctagaaattctcacactaatgtaattaaaaaggataaaatcatatacgttcgtctatcaaatcaattaatgagatcttttccacctcataatatattcatctatgaaaataggaaatcataaatatatggttgtattcggtttagactcttaattatagttttttcatgattgaatcatttcaaaatttgaaattaataaatgtagagttgtactcgttctgaagtctcagttattttagacaaaaggcagtcacctgcccagtttttcattgcaagcataagagttcgtacaaagcaaaataaaaggaaagtaaaaacaagttgctggggtttccagctttcaggatcagtacagagagccttccaagacttcacagcagaagtgcctaattttgaaatataaggactatgctgctggcacagcagaacaagccagagagggaaaaatcaagattcagcgtttggagagctgccaagccctcctgtctcgctaatgctggcaagcagagatccccttaatgtatccaggtctcccctcagtttcgcaggtgctaagcgcctccactgtattaagaaggagacaactttgtgaggcaggttaatcacatcagctagcagcttattattaaacacccaatcatttctagcaatccatatggcctagaagtaggcatcaaaaattgtgagccaaacagagttcttcccactcttcttttgcataatctctaggagatcagctctacacacatgcactttgtcccaattaaaagcatctctcaggcaacaccacataaactgtgcaggggcacacatgaacagcaagtggtcaatctcttcttctctaccacacaatttgcagttagcaaccccccccccccccctacttcattttctttagttgagcagctgtttgggtccttcctttcaaagctaaccaaaagaagatttttattttcagagggattgaagccttccaaatatcctgtgggatctagtatctttgacacctccgaagatcatctccctatacagagttttggtagtaaattctcctgtttttgtcaatttccatatcattgtgtctttgttagaagttagctgtatgtctcttagtttctcatgcaaatcattccactcccctacttctctgtttccaattgttcttcttataccaatctcccattccccccagtgttcatttgtttcacagtactgttagggttataacaaatactaaacaacatgggatactgggtttttaaaggaatttcacctaaccacacatcactctagaatctaattgacttcccatttcccagcttataacaactaccaaggaacatccatttcttcacttcatgcaaacccttccaaaattgtgaaccccccctcagcagaagattgaaagaaacctcccccatttctcatatacttcatcctcaacatcctataacaggggtcattagctcctgattccagcttaaaaatacacttacaaagcagagccctattcattatctttgtgttaatgaaaccaagtcctccaaattccttaggtctgcttagagcttcccatttcaacatgtggtatttcctcttcttttccaggccctcccaaaagaacctggctctgaagtctcagttatagttttgaatgatctaataatattctgaaattctgaatcaatcaaaagaaagttatacttgacctgtagtttcaattacaatttttttatgattggtttaattcttctaaaatttgtattaataaaagaccaaatcatactcagttctttatttaataaatccaaatttaagaattaacaaatcataatagttaattaatgaatattaggtcttggttggcctacaacctcaataagttttttccctatattttaatgattctaaattaataaatattgagttgtccttagtgtgaaacttcaattataatataattgtaatttaataatttggaaatctaaattagtaaattccaagaagatattgattgtttaaaatatgtagtgcctgggaatgtacaaattaatggcttgcaaacataattaaaagcatattcctagaattcctttaatttattcaataactaaaatacccaatggatggtccatctatagcaattaatattcttaattcatgtgaagaattaaagaaattagctgatcgattgatcgaactattggtaaccgctattgtcagtacgacaaaaagatgataatggcaagctagggcaaggcgagattaggggagcgaaatttgaacgcctacgtgggagaaaatatctcataattgagagtgatcggaagcggattggcttaaagtaaatgttgatggctcttattgcgcattctctgttgaggcggacattgccattgccatgagagactcagcatggcaagttcttatatcttcttcgtgagtaatctgggatggtgtggcaggagagaaagttgaagctatggcatgccgagaaaggctagctctcgccgcagagtgggttcgcaaacccattaccttgagtcatattgtgtggcaatgacatgtttccttacatcaaatatagttgattggtcatcaatgaagccaaacgtataatataatgtggttgtttccgaaggtgaaggttaggcatatatatattagaagagagtgtaaaagcatagcgcatgagttagcacagtttgccatggattaagcatagtgcacgatgttccctacttatatccatttttatataatggaagttttattgaattcagtacattacattgaggtgataaagttgtcttaaaaaatacttatatccatgatcttataatcctcaaggatgattaattaatataacacccttttttcttgtaaaaaaaagtaatgcatgagatcctactacagagtagagacatgtaaacaatcaggaaaaagtaggggactgaaaacagacctcccacacacacacgaaagagtacacgagggatgtgactgctggctcacatccagtcattggcttagctagctgccaaatgggccccaacaacgtacacacaaccctctcccctctccctagctcatgcgctccaaccttgcaccacaaccacactgcatgcgctccgtccagccgcagctaacaaactgatgagccgtgtagcaatcagcaactggcaaacgggccccacgcagccacgcctcctatatccacgctgcccagcggcgcccacctcgattcccccttctcctccacaccaccgcgcctcactagcctcgtgccctcgtagctgccctcgcgcgccaccaccatgccgtccgccatgaacatgatcaccgccgccttccgccgatacctcggctgcttctccgccggatcaacccaccgccgccgccgcggcgccgctgaacccgtcctcgccggctcacttacacttcccgccgccgccggcggtgacaacgcggccaggcgccttgatgtcgtcgtccccgcccccagccgccctgatggtgtcactgtgagcggcgaagatttcatcggtagccttcctggccatgtccgctccgccatcgtgtcgcgcctcccggtcgcggacgccgccgctcgcaccggcgtgctgtcgtcgtcgcagtggaacgggctctggtcgtcgacgccgctcgtgttccaggactccgacctcatcctcgccgcgaacttcaccagcgtggcccccgtcgccgccaccgtgtcccgcgtcatcgagaaccacccgggccccttccacaccgtcaccctgaccagctacttcccggagtccgagcgggacaccttcgccggctggatccgcgccgtcgccgccaagggcgtccgcgacctcaccctgcacaacatcccctggtcgggcctccacgtgctccccgccgacctcctccagtgctgcgccgccctggagcgcctccgcgtctgcgtctggcggttcccggccacggccggcgtcctccaccccggcggcggcgacggcgacggcgccgcgccgccgtcgttcccgcgcctgagggagctcgtcctcaacaggagcgccatcgaggaggccgacctggagaacgtggtggcgtgcagcccggcgctgcggacgctggtgctcgccttcagccgtggcgcgccggggcgcgtccgcctcgccagcggcagcctccggtgcgtcgtgctgtgccagtcgctggtggacgagctcgccgtcgtcgccgcgccgctgctggagcggatcgtgctgcggtggtgcgcgtcgggcacccaccacggtcacctcatgaggatcaggatcagccgggcctcgtcgatcaaggcgattggttacctcaaaccaacctgtcatggcctgcatattgatgccactgttataaaggtaatctagctagctacttccatttattgattattagttatattttgagtttttatctgtacagatttgtggattagtatacttgggggctttttagatggagtgtttgtacttctgaggcactataggagtagcaaagttcacattattttttgaaacgagtagcatcaaagatagtcatgtttcatattgataaagcatggacaaaatttgcattaatttgtatcggaacctcaatagagcatggttgtacctagcctgtcagataattttgggggaaactttttccccattttaagtgataacttcatattctctcatactacctaatagataattgcatcagaaacataagatactagtcgatcaggaatgagaagcaataggaagttgttgctttgttggttatatttatttaaattttcaccaaaatttctttgttgcattcaaaattatattacagaggggattccaaattaacatatgtcattgccttgttttttttttttctctttgctctctccgatgtttacatctatttactgtagcctgggataacggctagccccgatgaagtggctgttccaagcgtcaagatattgggtttacaagttcgatttggagttgctgcggaagcaacgatggtgtcctgcatgctcagatgttttcctaacgttgaaacgctgcatatcatggtaaggcataaaattcaatttgtcttgcttgaatttgcctcaatcagatcgaacaaaaattcagcgctcttgatatattataatctgaacactggttaatttggcagcctatcgaagatcctcagtctacccagcttgatgactttgagttctgggaggagatcaattcagttgaatgtgtcagatccagcatcaagaaggtagtgttccatgggttctcctggaagaattctgagatagcgttcatcaattccatcgccgaaggaggactggtgctcgagaagatctgtatcttccagagtcgacatggtgctgccccagatgatgatgaactgaatgctaagctgagcatggtagcttctctgaacatcggccttggccgtacagagatcatattttcaggtgaagatccaacctggtgctatagggcggcggctgatctttctcgtgctgatccttttgattgctgccgttgaagatcgatgtctctgtgctttgatcatcttcgtactatatatacattttgtgcttcagaatgtcacacagtctgcaaaggttgctcaaggtagttatatagcgaataaatatgtgacatctggaaattttatcatgtgtgtgtaccagttaaattctatcctgtggtattaataaatggtactggcgaggcagtgtgcaacgctttgtactgctggattgtgttttaatttccttgagcttcttgtttctgttgtactgaatgacaatgattcaatctcatggatttccaaactagcattatatagtactgtttataactttatatagattctttctcttcagttgaaccattaatccttcaaagataaggatttagttagataataaacagatgaatatcttaaatcaaaactgtcatcccctcgatcgtcgatttttaaatggcagaactccagcctttatgttcaaaagtgtgtgtctgtgtgtgtgtgcgattatgttttatcttcttggtagactgcattacatacatatactacatacatggaatgcttacctattatcatgtgataatgttcttgacagattcttcagtccgacggtaatgtacgatgtttctaaaatcacctagtcaaaattaaaataaagcatatatactaatagtctaaaatcacttccttgaactcgtttcagggataattaatccatcaagatacaacttgttgaaatataaaaaccaagatattttttttcagatcctcaaatcaaactaagcttcataaagttcttcaaatcatgccaatatataccaatctgattcagaattggtatagagctgattcagataaaatcatgccaataccagtcaggccttgttgtaagaatctgaatttcaggcctgtgccccttcatctgcaatatcgtttgcatacggtatgcgtacattggttatctcaccttgcagcaatgcattcttctcatatgcagcgatgttatgtcagactaaaaaaaatgactgaattgaaaacaacccgcttttatttggaacatcgtatacgaaattttccagattttgtgtgcaccatactatatagggttaattggatccatgccattataaaattaccggttttgaaaaataccactactatttgtataattggaactatgccactacaacattgcgaaaattgaatccatgccatgctatacacctgatacacgttttgaattttttttctatactgtattttcacgcggaccaaaatacccctcaaattaatccaaccacaatagccaaatcgatccccttatcccgtcgatgcggagctcctagaagcagcagcggcgcggccggcgagcgtgaggttgggtacggcagcaacgtcctgcgcccaaaggcggtactggcggcgggcgtgaggtcgggtctggcggccgcgacctgcagcccagcgccggcgactagctcaacgcgagcttgctcttgacacgaaaagatacagtggcggcggtgacgcgcggtccacggcggcgatgagctgcaagcggccagtgctagcgatggaggagatggacgacagctcgccggctcgggcggttgtggacggtgacccctctatgccggcgagtgatgccgagggcagcgactggcctgccggtgttcgtggacggcgacctggctgctccaccgctcttttcttcttttttcccaattattttcctcttcttttttttcctgtgcaacttttgtacacgagatgcattcaaccattttgtactgtgaatatgaagcggcagcaatttgttgcaacggcgatttcaaatatttgatttaaaactttgttagatctgaagcattaaatcgtggagttgacatgaggaaggatagtgttgttgttcagagcttgagactacacacggttattttagaccatacgaaaatacggtagtcacaaaacaatttaaaatgtgtttcagacgtataacgtggcatagatctgattttggatgtttcatagtggcatggttccaattatacgaatattagtggtattttttaaaactagtaaatttataagggcacagctattgtgcataagataagaataaaccgcaagacaataatgcaaccaattggagtagtagttaatgaccatagcaaatagtttgtcacatataagactaactaaattaagccccaagtttatttgtgaactagattctgtatgaccaatataaacccctagttgttcataaaaaatatttaattttcatgtgactatattgttgcacaaacacttatgttggaaccaaaacagtacctactccctccgtcccataaaaacaaatttagtataggatgtgacatatcctagtactatatatgaatttggatagagcaatcctatccagttttagtatatgtcacaactgtactaggtttgtttcttatgagacggagggagtaactagctatcatagaatttccaactaaatgatcttttctaatataagcttagaggtctgatcagagtaagttgtaccacacatgagatccatgatgcaagcaggatgaccggttgactaatatattgtctatttcacaagaaaaaacttataacctacatctttctgtatatcatccatccccccaccccaccccaccccacccacacataacataccccctgcatacgcacaccaacccctcgtctcgctctctcagtctcgggtaatggttattatgcaggatatgtgtggttgttaaacatctagattaaatgtggttgctaaaaattattacaaccacaaaaatatggtcattatatgccattgaaggttccatcgttaaaagtattaacgacttcgaataaattcatgtcacgaattctttaacgaatcccactttaatggcccctatctattctcagcgatgggcccaactcaattcatgggtattaatctgaatatccaagatttttttaattaaaaaaagggtatatacatatgtaatgtgtatgtctatattttactataaaagataatagtggtggtggtggttctgccaccagcccaccaccactacttagaatgttatagtaattagtccatggtattttataatattatgtaatagcctaatatttatttaaatcaagtgagtaacataatattaaaataagcataggcatttgactagtgtatgaaaaaaacaagaaagagattgtattcaaccgaagaggttgtattcaacacttaatgcatatgctatatattataccgttagtacatgacagatattagacttttggctataaactcttttttgacccattcacattttaaatacacaacttcaaaatccagagcccgccatgtcaattctcattgatctctaacgatctccggtggtgtcttctaatagcttataatgaatcatgactaaatttggatcactaagacaaattattttgtggttttaaactatacatgtctacttacacccacatctacattagtgaaaagaggatcccaagaccccaccaggatgagccacatcatcaaacaaatatgaaccgttggatgcatgatttggatgaagataatcgttggatcaaaagaaagaaaaatcagttaaaaaagcaaaccgtatcatgaggagttctaaacccttcaaacacctcccaaaatatgtgtctaacaaagatatgagattgaaaaaaaaaagagaatgccttaaaaattgattgtataaaaagaatatcaccaatgagtattcaatagtagttgtattgtatcaataataacaagtatcattgtatatatcgtattgtatcaataataacaagtatcattgtatacataaatagctacttaacctaatactatcaattactccactatatcttaaaattaaaaaaaaacatgtggcatggaggacatagtaaattttgtaaagttgatttaaatcatatgattctaagatttgcgataaaaaagcgtatagatacttctaaactatttacatgtggcattgcaacgcgtaacagatgtagctatttacattatcagtacaaatgatgcatttagatactgaatgaagtaatggtcgcggtaatatatgataaattatttgttgttacgatatttttttatcacaaatcaagatatatataaatcctttaatgttgtaactacacttcttaaaaaatatgttcaaaaacgtatctattgttaattgttactaaacatttacgtccattaacacaagcaacatataaacacattgatagatagagatgacagtcgtgtgaacgggcaacttaataggctaggttttaacctgaaaagcattgaagcgtcttcaaattaattaatggccacattcttaataagaaaataataatatagatgaacaataatgtacataacttatatatgaccatttttttattcatccaagtaaaatagtttaattgattcttgcatcccgttgaaaaggtaaattctaatagacatcatgcatggaatattcagtcagcaccagcatttgggtggctagatagcctaattgaatagacatatatatatttaatttacaactaggaatatactgatttaattaaatagtactctgacctgaaggtgcacgtaccattgcatgtatacttatatactactcagtgaaaacaaccgaatataatgggatatatatcatgcatatatagatgtatcatattcagctaattttgagccctagaaaaacattttgccgtttatggccccaagaatttgtgttatatatgaactgaatggctacagttttttttgctggtatgtcaaaaacacaaatatttcacttttctgggatgcatttctgaatatcactagtaattaccgagctgttaaccaattttatgacaaaggtatactgtagcagagaagagttatctgaaagtagatggctcatttcatttgcttttcttgtggtgtcttcaagttgtcacctaatgatactgatttcaatatatagtagataccacctcatacattatattattagagtaattaataggaagcaatgaggacaaaaaaaaatttctagattgtatttaaagacaagacaaataatataagagctatcttgcaaaaaaaaaaaagaccacataaacttattaaggcaatgaagagggggggggggggcagaaggaatgttatagtgatgtttatggtttctactgcacttagcagtaagcacacgctatttttccaacaatctaactatataggttgatgggcacacaagagcgcgtccattgtactccccccgtcctaaaatataagcagttttggttggataggacacatcctagtactatgaatctgacagactgcctgtctaaattcctagtactaggatgcgtcccatctaaccaaaactttttatattttgttacggagagagtatattatatatgccaaacttgggtagcaaatgataatgaaaggtctaaaggtaataatagtgagaaaatacattatattaagtcggcatatgaaattggatttttttttctaataaaaagtttcaaattaacatgcatacaatgggctaatcagatcgagttttgtatggaattgtttcttcaatcatgtagcagcaacgagcaaataaaaattgaatcaagaaagcgagtaactgatttttttttcaagccaactgtaagaatcttcttgtgtgaagaaaacagaaattacttattttaaaatagaaatatggattacacaattaatgcaccccacaaacataagtcctagtctaatgtatattgttcgccagccaaacaaagttaccctcatatttatcaagtgactactactgcagggaaaaaaaatgataacattaattctcaaaacgataatttatttgtaaatctccaaatattattttacattctactcctataatgatgtgccacatcgttcagtatgcatactgcatgataaccttcaaatattactaagttattgcactatttaatttgattatacatatgcatgtcttgactgctcaatcagcagtgcctaggtggaatcaggattaccaataaaaagcggctactttatatatgagacagccaaattaaatttggttccaaactagccaaattaaatcacccgcacatatatatgagacggccggaagcacaacttacatagacattaagtcaggtagtttcgccttgaaatcagtacggtttgccatattttggaatgatttaaaaaaatgaacaaaatttgactgaattaaaaaaaatgaaaaaatcgggtaaaatagtgtcatgccagggggcattaattcccgaaatttcagatcggaattgcaaacactgcttgaaatggaacatgataaaatgctcttaaaatattacaatgctgattaattatttttttaagatgagtatagcacagtataaatgtcttttgatctggttcttgggattacaattaatcggatctttggattatatttctgatgaagaacacttatgtacagaatgccatacctaagcacagcttgtacaaggatcaaaacttgcaatcgttgtaaattttatgataggatgacaatcgcactgcaaacacactttacctgtacttgtatcagctgaatatatctgaaattgaagtgaacatccacttacagaaaactgattggcactttgtagtgcctgagactcagagcagcttgctctgaaagattctgaaaacaaaaaggacatgaattcatattattcatcatatggaaaaccatatgtttgttaagaaatttcacagagcatctgatggtcaatctactaatacttgaattccagacagaaaatttgcatcgataatgttgaaataaatttgcagagcaaaataaagggctcataacatgcctcagagcaaaaaataggaatattgttctaaagtacctgagtacaaatcgtattcatatcaggccatatgtatatatgaagctaattaaataacaaaggagcataacaagcatatgaatagaactgtaatcaccttgcagattagaaaagagaaagaagtgatggtgcagtaaaagtagatcaacattagcacagaagaatcagaaaattaacctgaaaaaatacacaggggaaattaaacatataagagattactggctataatctgaggatgcattattaattcacaaatcaaatacctgcaggtattttatgtccacgttgatctccatcgtcagattaagatcgatatcggataaagggacatatatataactagaagaagaaaattgaagagggaataattggtactagtacactactcagggaaaattgaagtgtagtagctagtgtgtcagtgtgtggaagctaaggccggtggttaccacggcctgtccctggtgtggcctggtcacgtacgatgcctcaaatgcgtgggatggcttccagatcgctgccggattcaggggtaagattgagagcttacagagattccgccagatgggtagccgccgggtgagctagccgaaccgaaccgccgccgccggccggctctcacgctgctgtgtgcgggcgaggcggcgagccaagacgtgcggggaaggtgtggtcgggatcggccgccgttgcctcgcgatcgatcgagacatggcgttggggaagggacaggggcgcggacggggtatggggccggctgggctggtttatctgatttggggcctgatttgtgtgggcgagtttagttcccgacaacttataccccgtttttcacacaaataatacaaacgcaatattttttttttatattcagcttcccaactttatttcacggttggctcagtgatgtcacgagctaccaggcgagttacaaaatgtacttgattataccaaaatgtacttgattatttcttctgccagttttcgtattggcagggggtttcagttcttttcaagatagtggaagctttatcgatcttagacgtaagggcttgttcggtttggaggttattgaatgaggattgagacggaataactctacaccgcaatagtgtgaaataaatcccctccaatccctccctcatggggattaaccgaacaaaactttaatgaacaactattatgagaaacacctccggcctctacaccagaagagtgcacacatccaacaggaatccacgatagcagaaaaaaacttcaagagccctctaaccatagcctaaaacgccacctatatgccgggtagaaaactccatggtcactagcttcaattattgacaagccccagtgatagtactccataaattgatcttttagaagatagcccatgaacggagccaatctaacttaggccctgtttgattcagcttaggattattataatctagcttattaggagtaagctgaaacaaacaagtagattattatagcagattattataatctataagccagattattataatctaataagctgctctagaggagcttttttcagattattgagtggctaaaggcccactacccctacatacttgagaaaaattacccacctatgccatcaaccaaacagatagctgagggcattatagactttatcctttcaaacccaataatccatgcctccaataatccaaacaaacaaacaactcacagcttattctatgtcagcttattataatccagcttatagtaatctggcttaataatctagattataataatcataagctgaaacaaacagggccttatactcattcgtttcacattataagatgttttggtctctgaatttctcattagattcattaatatccgagtaaactgcatattgggatatatttagttagcatttttttactttggtctaggccatacactgtgtcgtaggctctccggaccttccattatattatatttgagagataaagtgaataattcaagtcatcaaacaagcataatgaaacatccgacgcctcgagagaggaatattggagacattgctgggccattagcctgccagtcaacttcagcctgagatgtgcccgtcaaaccactcgaaggcggtgaccagatgtgttacacattcaggagacttgacaaaaatggctaaagatctacaacctctcaaatattcctaactcatactcatgtgaatctagttcccaggatgtgccctagatccacactttcatcttaagcatgattatacatagcaaacacaactaagatgaaagaaacttaagacttacaacatcttaataattacataggccgaccggccaaatagacttattagagaacagcagaagcttgactacccaatcacaagcacaccgactaggggtttaccccattaagttctcatcctagaagaagcaatcggaacccgcatcactcaaagactaagtctaaacctgcaaacaaaaggttatatcaacagcaagagtcagtacattaaacaagttaatgtattggcaagcacaagtcaatcctaccatactacatgtaaggcatatattcaaagaaaggcaatatgtagttcaatttcagcataaagcaagttttgtttcgcaattcttttgtaaaggagttgatgcttcaattaacaaaacaaaattttaagtttcaatattaagttcatcataattccatcgtaatcaatctcttgttgtcatcctttgacaacaaatcataatatatcacctcacacacacaactcaacacatttatcaatttcaaaccaatgtcacatgatcacattttaaaacataaagtctatactcatgacacatcaccaaagcgctcatgaccgtgagcacggctaatcgattagtttaaagaactctgcagagtttgtatagctttacccacatgatatgaactctctagtttgttttgagtttgtaagactccaccacactcttcatgttgaatgtgatctagaggtcataacgaagcctttacacaacttagaacctagccttgcaccagcacgatacgtgttcctccatcctaggcatacttggaatatgcctagaaccgttaagtggcgggcccacgccttaaacttaacgccgtggtggcggacacaacgggaacccacccacgtggcacaataccgttgtattggacagacttagtcacctaaactatcatgtcggggcaaataggaagttcatctgaatcatcgactaattcctcagaattatcgactaactcatacacaccggcctaccagaatgcaaggctagtcctaaatagattaatcagcttaggccatcccatactagcacatgtggatatatgaataactttaaatgggtgacacaagttcggtccttatggacttaggcaaacactccccctatcggtatgcaactagcaccatatgcacaccacttgccgcccaagtataaaatcacattttacacattttagttcgcaaatacccatcatattaattttattccagcaagggttcatgtatcaaaattcacattttaattacagatggaatgagcatttgcatatttctaagcatggctaagcaagtagttgcacatagagcatatataaacccatttgagcacaaagagtgtactctaaccatttctaagggttcaatcagcaagaggatcaattattcaaggtggggtatggagcaaataagtcataactaccttaacccaattttaaataccgatatagtctaagttcacatgcaactttgcaaacaaatattttcattcctcaaatcatgggattcaatgtgttcaaaggatgggaggagaaaacttgccttgatcagagaaatgttagcacctaatccactccttcaccgattatgcaattatctagataaaggacacgatatgcaattaaacaccaaaagagctgaaaatccaaaatgctctaaaatgcatgatttatgcatagtgattaggtactggtctaaaataaatttaggtgaaagaattcctattttatcttattccatttggatttgggagttatgaattttagaagttttatcgatttatagtaatatagtcttaggtagtgttatgaaatacttttgtaaagtgatttttattatattagacttcacagaggtgtagaggtgtgttttctaagactaatacatttggtttcacaatttttggagttataatgattttcttatagattttacaagttacaacgtgttttaggcatatagtgttttatatgtgcatgactctcaagttgtaggttcagaacatgctacttcatgtttaagttgaataaaaggaataatttagttaactaaaacatttttagttcacatgtttatgatctttactactatggttcatattttataaactagagatgctctaatctaaactagcaatatattatattaacctagaaattgttatatgagctaagttcttctaagttttagtggatgaggatggaactatggcttcactggtcaatcaagtttttatttaggtttaattagacctaaagtgtatatatacttatacatgtttatgtattacttaaacaacactatgtgtttaaattcttatttcactaagttaaggttttgatctatgttctctacaaaaggtgccaaatttaattttactatgttgaagataactatttgctggttctatagaaactttgttcatttcatttggactaaaaatgaattttctacaagttttacaaattaatggctgctctatgttagtaaatccttatatgaatatttagagacttttactacacagtaagtatataatcttatttcataacatggaaatacatgttttggtgatcctacagaacttaaatttactcaaattaaagctaaattgggttctacatgaatttctaaagtttagcttatctaaactaatcattctagagataatagttttagaggcatttgatgcaaagtaagtaattacttttatttcacctaatcagagagtgcatgatgatgaatctgtagaatttgattttgtttcaaaatgagttgagatgaattttctatgtattttataagcttgtacatgttttatgtatgacctatcttagataaattttagagacattatttgtgcagtgagtgtcaagttttatatttctaaaatagagttcataactttaagaatctacagcaactggaatcatctcaaaatgagttttatttgattttatatggattttacaagtttgggtgttttcatgttaaacatttaatgttttagttatttttcctttgcattttcagatttttatacacatgggtccactgatcggtggctgaaccaatataccaaaaaaggtccctggctttatatgaactgcatttaggtccgtgggtccacatgtaaacgactgaagttttatagtttgaaccctatgtttctgatcatttacaggacaaagtcctcatcttcaacctccagcagcccgatggactgggagcttggccatggctttggcgagctcgttggcgacgattggtggctcgattgggaatgaggtcaaaagataaaatgaagagaatgctctcacgattccattcctctagttttcttggctaggagacatcggagtagcgccgatggtgagggtgagcggaaggtatacatgagctgttactgcatgttacctagggctttgattttgctagatgcatccatgcatgtgtttcctaagaggttcaggaggctcaccaagctgtaggaagaaatcgctgaagcttggatagcagcggcttcggttggaacggttcgacggcggcgctcctcctcgggtgaacggcgacggctcgaacaggacgacgagctgctaaaggaaggcatgcaagagggttatgaggtcaaggagatggtgtatgcgcgaggaatcgaacaatggctcaccgagtcagcggtaatcgacggcagaggcgattctagatcggcgctggtgaagaaaagatgtgttctccgagtccttcacatctccggctagggttcttgaggcgtattgaagaggaggttgagacgatgacgatggcgcagcggcttgctccgaggtggacgagaatggccggacgacgacgatggttgaagcggcggcgctccggtgcgtgctccagggcgtcgttggcgtggtcacgttccggtggctgtgatgcacaaaacgggaggtggtcaacagagaagtggtttggcattgtgtggagagatggaaacgcgaaagagatagtggtgaccttgactcaaacggagatagcgatggtcgtcacctccatggccggtggtgaggtcgctggtgacggagaggcagaggacctgctcccctcggcttcttcggctctgagtgatgagtgaggaatggcgactcagactggaggagaagagagcaagaaaaggaaagcccgaggtcgtcgacacgttgtggccacgcgtcggctcgctcgatctctccctctctgtgttcttggtcggctgagggtgaggcacagagaaagggcgagctggagaggctgccaagtgggccaggacgaagtgctctaggtggaagtgagaggtgtggggaagattctgggtgaacacggttttagacgaatttttagattattttctcaaccctaactttgtagcttcataacttaatgtgtggaccaaattaattagtgttgattttactggaggtaaatgattacacctagattccattttctttggttgtactcaaaaataatgggtagactgctcacagaaattaaacaaagatgggctattagaaaggtagattgaatttttaggaagcctaaacagaggaggaaaattctagaaaaattatatttaggcatgataaataatctagtatttgaataaattattttccatgttcacttatgtacagttaaatgtacttttggatgaagtatggctttagccaattaaaattttatttgatttcttttagttttctactttgactgattaatttgtggtattaaacttagttattaacttgtaccaatattatagtgaattgcttatgctaaacatagtttacataattttttccataaatttttccatgatttcatcttgcatagattattttaaagaattagaataacatttctttgtatatgtgtccctacttcataattgcacctaatattattatagggattacattaaacttcttttgggctgagaaaaagatattagaatttaatattaagtccacatgttatcacccaagattaactatagttttgcttagtaatttttaacccttttagtttatgctcatgagacctattatgaaaagagagaccaaaatccaaatgcacaatgtatgctccaatgcttgatgacatttctagtctaatgttgggatgaaaaagttttattttgttctcaaattttaatcatgcaatggtttaagttggtcatcacctaagttaaaacggaaatttttggctctcaaaattggagaagttaatctctaactattttgacaagaaactttaagtcctgaaatttcaggtatgtcacagactggtagagaaaccatctttggtcggtcgacccaaatccacaatagtcccggttgcattaaaaaccgggactaaaaatcatttttagtcccggttgataggaggaagatgttaccaaccgggactaaaaattatctttagtcccggttggtaacttcaaccgggactaaagttcatttttagtctcggttgattccatgtcaggccgtgtcagggccctaggatctttagtcccggttagtaacaccaatcgggactaaaaacctatttttagtcccgtttgatgttactatctgggaataaaaatcaaaacacattatataatccctagtaccgatcctcttttcccgtccacacaacaaacttctccctctatctcttttttcctctctaacttcttatctctttccttatctctaactcaagcctctccttccttttttccttcactccacaacgaagaagcgtacgtgcacgagggcgggccggccaagcggcggcgcggggaccgctcagaggcggcaggcgcggcggcgcggggggcggcgcggaagcggctgcgcggcggcgggcggccggtgcggcggcgcggggggccgcgcggaggcggcctgcacggtggcgtggcggcgcggggggccgcgcggaggtggcctgcgcggtggcccggcggcgtggggggccgctcggcggcggtcggcgcagcggcgcggtaggccgcgcggcagcgggtggcggcaccggcgtggcgccagccagcgcggaggggaggcggcagtggccg

SEQ ID NO: 61345 - DNA, 7642 bp, Oryza sativa
gctttggctgaacttcattaattaaactagctgggtggcccacgcaattgcgcggctagcatccatataaaattatatatttttttaatatgattttacttaaaatttattaaatagttatctcgttgtcttaagattttaaaagaccaaaccttatcatccttgtgtttctaattttatagtttttaaaagtcacaccagttgctaccccttacttctgtcatattattctttattagcttgcttgatctaccactatttctattcattcttctttgaacctttaaaaattggatgttaagacttatagtttttagagtttattgtcctgttggtcttcttttgtataatttctagaaatcccgtcaagcgctgtcattatactcctctacgatcgtccactgcatcttctctttattgtcattgctattttaaaaatcgaacataattattgtttaggttcatttttctactttccaaaagtttcaccaaaacgtcaacgactttgtcactgtactcctctatggctccccgttgctgctcttctttattgtcattgagatttttaaatcaaacatggttatcattagggtttatttttttactttttagaagcccgaacctttaaaaatttgaccttatagttcttagagtttattgtctcattgggttttatgtttttttatatttttttagaaatcccgtcaaatgctgccactatactcctatacgacccgtccgccgcatactctttattatcattgggattgtaaaaatcgaacataactatcattgaaattcattttttaatttctagaagacccatcaaccatcggcggctctgccattgtagtcttatatgacccacccattgcctctcatttttattgtaattgagattttaaaaattaaatatgattaccattgaggtttatttttttactttctagaagtccccgccaacccccatgaccgattgcttcacgacctgtccgtcgtacttccttttaatcgtcattaggattctatttggtgttttattaatagtttttagatgtctcattaaccaccaccactctattcctctataggcatattacttaattaatctcgtcatgtgttttagatactcttttctttcaatactcaatagtcttaatttttttatcaccaatcttagttatttataaattgtattcctagttaaaatcttatttttcttttttctaatttcagaatttattttattttttgtattgtgttcttttcatatttttatttttttattttcaattttagctgtttcaaaattgtatgcctactttaactctctttttaatttgcctaatttcggatttttattttatttttttattctgaattttaattaatctactattcggttcttatatgtactcttatttctatattacttatatttaattcgaaattttagttaattttaaattgtattcctccttgaactcttattttattttcttttttctatttcctatgttttttatttttattctgaattttaattaatctcgtaatggattcttgtatggactcttctttcaatattccttgtttttaattctgaattttagttatttttaaattttattcctacttggactctcttttttttgctaattttggattttattttatttttattccgatttttgattaatttcgtattgggtttctatatgtactcttcaatattgcttactccgtttgaatcttcagaacatgtcaatatattttgccaatcactttgcattgcttaatatatttatcatattttattcagtcatagatggacggggaattctgtaattagttttgtattctaattacctattcagctccaacacatactatatgcaggcaacgtgcatgtccgattcctcgtcaattaaaatattgtaattacttctcagtttcctattatgatagaataggcttagcttagagcagtagtttctattcatattcatattcttcaaattaatctacaccgttaaaatctagtcagtttgtgatctaaaggtttaatattttttgttttttctccgattaatgtgggaatttttagccccaacaacgaacgtggtaccttcttttaagactgttttaataatataacttgttgggtggcccacgcaattgcgcggctagcacctaaacaaaatcatatatttttcatatatttttcagtatgattttacttaaaatttattaaataactatttcgttgtcttaatactttgaaatatcaaaccttagcatccccatatttctaattatgtagtttttaaaagtcacaccagctgctacctttgtcatatcgttctttatttgcttgctcgatctactactatttatattcattttctttgaaaccttaaaaaattgtatcttatagtttttagagtttattatttcgttgggtttcgtttttataatttatagaagtcccgtcaaacgctgccattatactcctctacagcctgttcactgtcttttctctttattgtcattgggattttcaaaatcgaacataagtatcattcggggttcattttttactttctataagtcccatcaaaccgtcagtggctttgccattgtattcctttatggctcacccgctgcctccattatttattgtcattgagattttaaaatcgaacatgattatcattggggttttttttactttgcagaagttccaaatctttaaaaattggaccttgtagtttttagagtttattgtcttgttgggtttcattttttataatatttagaagtcccgtcaaacaatgccactatactcctctacggtccatccaccgcctacattttattgtcattgggattctaaaaatgaaacataactatcgttggaattcattttttgttttgtagaagtctcgcgaatcgtcggcggctctgcaactatactcctatataccccgctcgctgcttctcatttttgttgtcattgatattttaaaaataaaatatgattatcaatggggtttattttttactttttagaagtcccggcaaccgccttgcccgtttgcttcacggcccgcctgccgtccctccttttaatcgtcattaggattctatttggtgttttattaacaatttttatatatcgtatcaaccgtcgccattctactccttttataggcatgttacttaatttatctcgtcatgtgttttagatggccttttcttttaacaatctttattttttatcaccaattttagttatttataaattgtactcctaattgaaatctttttttcttttctaattttaggggaaaaaatgaaattttaattaataccgtatagtgttttttgatatttttattttttttttttgaatttaagttgtttcaaaattgtattcctacttgaactttcttttagtttttctaattttagatattattttataatttattacaaattttaattaatctcgtattgagttcttatatggattcttctttcaatattgcttattttcaattacgaattttagttaattttaaattgtattcctacttgaactcttattttctttttctaatttcagactttatttttatttttattccgaatattaattaatctcgtattgattcttatatggactcttctctcaatattccttatttttaattccaaatttcaattatttttaaattgtattcctacttggactctccttttcttttctaattttgaattttattttatttttattccgaattttgattaatctcgaattgggttcttacatggactcttctttcaatattgcttattttaattccgaatttcagctatttttaaattgtatttctacttggactctctttttctttttctccgattaatgtgagaatttctagcctccacagcgaacgtggtgccttctttcaaaactgttttaataatataatagatagatagatagatagatagatatcgtttgttcctatgtcattatctagcatgttttgagggatcaatgattaaaacgatggagaatgttagtcatcgttctgctacatcgactaatttttgtaatagaatgaacccttctccacttttataatagaatgaacccttctcttctcttacgtaccctcttcctcttcaatctaaatgtgtggattgagttgagtgtggtcaggacgtcacactcctgtttgttcctcaatagtttttatgttgtagacacgtggtatgtttttttccatgttatagcctcataaagattatggttttgtaaactttttctactgtatcaatataaaccttgtaccatcttgtgcggttttgtaaaaatatttattcattgtacaacaggacgaaaaaatatttattcattgtacaacaggacgaatttggattacagcgtagagtggaaaattctgcatattgatgattatcaattgtacctgttgcaatgccgtgtcggcatgggttatagcaagaccgactaataataaagctggccaatggaaaagataaactccctctatcctatgatacaaggcatattaaacttgacacggtctctacaacttatctttgatctataatttctcatatattataaggtttgtaataacaaaattataagcatatgaaaataaattcaaattgccaatccaatggtataatttttagcaagtaaaattcaattcatattatactaaatgtagatcaaaatgttttgaaggtagaatcttaaaatgcgtggacgctttatattatgggatggagggagtaatagattagttacacacacacacacatatatatatatatatatatatatatatatatatatatatatatatatatatatatataccatgtcaattgtcgcatcttcccttggataatagtagagctcactttctactattagctcatcttaaagccaacatatataatagattagtttataaggttggttataattttcttcttctctctccatctctcacgtatttgtttttaaacttgtgataagattagctcttacatgagagtcaacactcttaattttttactacctctatcttctatctaaacttataaacttataggaggtttatagctccctactaagtagacagcaagtggccgtataaaaagtccaacttgagttcgtcgcgattccagtagtttgaccgggcctatttggttttccctgacgccgatgcaaccttgacagattaaaattaaagttgtggtctagcagtctatggtattacataattgtttccaacattgctcactctattacacaagtgggataagagttgtaattgtgtacactaatcgatttattttatgaacaaatcatgcattagcaacttgcagattcgaaactgaaagcatatttatggatatgtacggctgataagttcttaaccgtcccggtgggggaacccttgaacaccaatccaatataagatatcttaatctttcaactattaaaatcggtgcattttagctttctcggtggttttgagggtgccttcggtgacgtgacgtctacatgacggtgtgacctagtctttatcccacatagtgcttacgtgacattagaatttaaaaaataagcaagagaattgtcgatagaattaaaaaaatacatggaacttatttgtcattaaaaaaatattataagacccactgacatatgggcccccatgtcatcacttctcttcctcctccctctctacgtatatgaagacttgattcacctaccacaaaagctaaactaggatgagagcggctgcttctttccactccccggcgaccacccataccgcttcttctttgcctggtcgtccaacgaccctgagctgccgccaatcatatcggcgccggacatggacgcaatcctcggtggcgcgctcatcatcttgtgactggtgttggtgctgtagtgctgcatgtaaggccggatgcggcgcgcgcctgcttggctcggctcggtttagctcgttaggataacgagccgaacgctaagttgttagctcggctcgtcttgttggtaagctcgagccagctcgttggtaaaattgcaaggctgcacttcagtaagcagctagcacatatcaagccagccagcaagatggcagaaacgcataaagcaaatgcatatccataatacgatgttccaatccatagcctatcagcaattcacccaagaagtacaaaaatatcaaatagtaactatgcaaaattgcaaatgtaacaagccaataaagcaaaaagaaaaaagcaacaacagatcaagtcctcagtattgacgccaatgaaagaaggaacaaaacagcaggaatacaggcttgctcgacgttgacggtctcagtactgacgccgacggcagcgaggaaattaaggaggcttagggtcttcgatcaaccatttgccgatgcaccttgattagaaacttggtggcgccgatcccaatacctccaggatgctagggatgttcgctcgtcgcgcggtgcaatgggcattatcaccaccaaagcagtctattcctcttcccaaaattcgccggctctgtgccacaatggcaagtttatttgggacaacagagctccgcctcgagtttaattctttgcctggcttattgccaaggatcgcctccccacgaaggttaatctccataaaaagaacattgtgcaatcccccaaatgcaagctttgcagcgatgaagacgaaacggtgagtcatctttttcttcactgtccgttcgctgatgaattctagagatctctcaacattcaccccggcatctcacgcgtgcaagatctctcaggtctagtcgctcctaggcagctccccgctaaacacttccaagttttatatctactctgtttctggggtttatgaattcatagacatgatgttgtttttcgtgatctgcctaaatcactcctaagaatggtagcaaaatgtatggaagacgctaatctttgggctgagtgttttcgtagagaagacagggtagttgtgtcaatttggaaggatcttctctcttcctccgtacacgtcactcgtcatgctaaggtggttgatgatggcgctagctgcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaaggggggacgtggccaagagaggacgttcctggcctagggttgatcgacgggggcgtcgatctctcttaagggggtgagggtgtaacatcccggtctagggcttaataggattaatagaatactcatatcaacaagttgcaacttcttttccggaagccaatctccaaagaacttcagggttaagcgtgcttggcctggagcaatttgggatgggtgaccgactgggaaattcttcccgggtgcacacgagtgaggacaaagtgtgcagaacagacatgtgttggtttgtgagggcagtctatgacctatgaaagctatca

SEQ ID NO: 61346 - DNA, 761 bp, Oryza sativa
aaaaacttttcaactaaaatgttataggtcgcgttgagggctacaattttgatataaagcttgtcttcattagagttcacatgaaaaagttataagttattttttaatataaagtttttagaccgtcctgtttaggtaccggggtgacacaactgaacaagttggaggaactaaactagtaatctacaagtttagggaccgggatgatacagtcgaacaagcttgaggacctgaacggtcgatttgcgagtttagggaccgtgatgacacaacggtacaagtttagggaccgatgatggactttactctatagtttaaacaattaaatgtgacgatttattaagcatataatactatgtttagaaaaaagtcaacatcgtcgaactagaaaaactgagtttgcaccctaaaaggaaaaaaaaaactgagttcggttccgtgtcgaactcggtctcttcccgcaatagcgccgacccacctgatcggactccgatcgcccccgcccacccataaccctaaacccgccgccgccgccaccgccaccgccactgccgtcgaaacctacgcttcgaaaccatgtcggccacgacgcgcgacgacgaggcgtgcccgtcgacgaccaccaccaccaaatccacaacggacgacgagccggcggcgccggccgcgacgacgccagcggtgacaacaacaacaacagtcattcacgacgacggcgcccctgccccgccgtcgccgaagaggcgcaaggtggcggcggc

SEQ ID NO: 61347 - DNA, 861 bp, Oryza sativa
actagttttgttcattatgcgatagagtgagtagtacatactaggagctttatcggttttttaaaaaataagtcaaagcagaaataattttggagttgatttttaagatatttttgatgtagtttatttttttatagacttttaagttattagaaacatatattaaaattgtatacgtacattattttttggacattaataagctcttatgatttgtaattaacttttagacaactgatgagactctcctgcaaggctgcaatccaggcctgtaagaagaaatggttcaaattactacctagataggctagattgcttattgctacctgctcgaaatcgaatacagtagctcattagtactttgcttgtgttacacgtcttattttccaatttggacataacacggggatctaacagaaaaaaggccacatcccaaattctggacttcccaattattcctacccaagatgactccacgcggcaggttgccaacgtccacttgactcgtgtaaactcctcatgtcccactttgtccctcttagcgcaacaaaattgctgccggagcacacagaaacttgccatccgtcaggggcaaaatcgtattttcgcacataattctcgtgcccaagcaaaattcacctgcgcgccctcctcctataactacccctcgctgccatcttcgatcccctcctcctcctcctctgctctagcgaaagccgagagagagagagaaaaaaatccgtcacgaaatccacacgcttctgagttctgatctgtgggttcgagttcacggcggagatggccggtcgcggtggccgcgacccccggagaggctacgacggcggctacgggtacccgaga

SEQ ID NO: 61348 - DNA, 4691 bp, Oryza sativa
acatcaatgccacgtaggcgaaaaaccagttgaaaaaccattcgagggtgtaaagtgaatggtattgaaagttcgagggtgtattatactcggttttgtagtttgggggtgtaatttgtaccagcataagagttcgagggtgtaaaatggacttatcccaaaaaaaaaaaaaatctcttctcgtcgtcctcttctccaaccacgcgctcacgccgccagccggccaccgcttatccccttctccagccgagcgcgccgtctctctcctcgccgcgccgccgcgctctcgtcgtcgccgccggtggcttccggaccttcctgggtgggtgaggagatcccccacctcctccgccgccgctcatcctgctgcttccgccgcatccgttacgcacatcctctttcccatctctctctctctctctctctttacccacgcatttttcttctcgaatttgcgttaaccctagcttctgttctagaaatttgccttaaccttaatactaataacagtttgatggctcccaaaaaggtttgggggttcaactgagcagattctgttcttgttttggcgtgtatgcatgcatgtgcggcgtttttaccagttttcaatctctgaaatggatatgtgacctttatttcttctgaaaacagatagctaaaactgtccgtacgcattgtccgtgagggtaatagatgatttgctagtttggtgaacaggaatttgcagtgatttttttcatggagatacttcacaataacggtatgttcattattgtttcaaatagccttgctttctttgtagtttcatttgtatagctggtttcttatattcaactttggatccttaattcaggtttttgcgttagcttgatagacatcaacagaatcagaatgaacaagttagtgaaggtactgattctattctatatttaaagttaattttctttcagttacaacagggtggtactttggcttgaaaacaattatgaaatcatgtgtaggttagccatattaagttcttgagtatcctccactttgtaaaggaagttactgatcctactaattggtaaccatcagaagtgcagttataacctgtagcataacatgtaggattgtgtaatttccaaaaaatggcatattcttaaaaatcatgaaaatgttagatatctcattattgatatgtctgctgaagaatcaaggatcttgattgacctaatgaaatggtagcatcagttaacacatgctttattttaacttgaaagctctttgtcctgcatccacccaaatatgaagataaatgatgcatccttgtcattttccattgctgatgtctcaggcagttgggcctgttattattgttccccttcagcctgcacattattgttaactgttttattagcagataatctcacagaactaattgaaactatgttcaagaagctagtattctcataaacaatcctattactatggtggcactcaatactgaatatcacataatggagaaattcctagcagttgttcattattctttcttgtttgcagtaaatcactgttgcaatggaaaatgtttaagcgtattctctttgttcaaatgctgtgatcagttataaattcatcctttattttcttgtctcaggtaggatcccgtcctcgtcaaattgcttggggaatgtcaagaatatgctgtgagcagtctcctggtacttccagcaagagatatgagaggtatcaaagacaaccacagaatgttgatctcccagaattgctcccaaagaagaaaaagaagccatttcctgttccaattaagaagatgttgcaagcttctcgacaagataaaaggcttgcgcgaatgcgaatagagaagcctcttgagcccccaaagaatggtttgcttgttccagagcttattcctgtagcttatgaggtccttgataactggaaggtgctcatcagaggtctctctcaactgttgaatgttggtacagtttatggttgcaggtaactaaggaatgctagcctgttccatcagttgtttacatgtgcaatgatatttgtattttcttgtacataggcatgctttaatatccctgtatgatggtatattttgccaagtatcctgaacttatgtcatctggctggtggtttgtagaaaatgcccccaagtccatgttggtccagttggccaccagatccaagattgctatggaacaggaagccaacgtcggaatagccatcactcttgggtcagaggatccgtcaacgatgttctcatcccgattgaatcttatcatcaatttgacccatttgggtggagagtcaagcatgaaaccaggttttgactatgacaggattccagccatcgttgagctatgcattcaagctggtgttgagttgccacaatacccctcaaggcgacgaactgctcctgtccggatgataggcaagaaagtgatcgaccgtggtgggtttgttgacgggcctaagccacaccgttcagaagactgcatatctctgcttgctgaacttgacacattcagcaaccagcaaggccagtcatcgacgccatcaaatgtggaagagctcgcggagaaaacactgaaagcatacttaaatgtccagcgaggtgttgcacggttgatgaggaaatacacagtaaaaacatgcgggtattgctctgaggttcacgttggtccatggggccacaatgtgaagctctgtggggctttcaagcaccagtggagggacggcaagcatggatggcaggatgcagtggtggacgatgtcatcccgccaaattatgtgtggcatgtccgtgaccccactggccctcctctcagatcctctctaaggagtttctacggcaaagctccagccgtggttgagttgtgcgtgcaggcaggagctgaaatacctgaagagtaccggccgatgatgagagctgatgtcgtcatcccagactcagaagaagctaggttggctgcatgactacatttttctaccctctgcacctcttcagctgtccagagtccacatagaaccaaagggctgtataatataatggtatgactgaaccattatcaatcagagttgcaatagatccatatatgtggtaaaataatcacaccaaaaggtgatcctcgaatatcctgtcttttgtccgccttttcagcgatactgttcaatcatatatttcttatgagccattggttcgtcactttgcaggttaaacgcatgaaccgaggatgcgcggcgacaatgctgaaagtgagaaaggatggccaatggaacatgtatgatgtacatacccattttgtttaatggttgaagctgctttattctttgcctatgctagactgtgaggcacttccgatggctccatacttggccatacagatggcctcccctttgtctgctggtactatgcttaattgtcagctgattccttggattaaactaatcacggcgatttgttcgggtatttgtgcgcttggctgtaattaatcatggactgaaaaaagcaatgcacttgtgcccgtccccagatcaatccggagtatggctacagcctgcatgtaggagtacatcaggttatcagtttagtgtgctgctacttgctatgtgtactactatgtataaaaacaagtcaggagctacttgtactgttgtactgttgctactcagtttgaaacagatcatttaccagagagtaaatttcactttggaccatctttattgaccaaaatttcacattgggctagggctaggctcatgtttttacttaacaccatgtataattaccattgtttgcactttggacctggttttatagttaccattacacgaattgttgtctaggtgcttagcattttacaagaaacaatgatatggaaatttttgccatacaaatatgcttagcgcaagaacaatgattgtaacatgttaaaggatatgctatcagattaatgggacttcattactactacatatgaacattcacaacccttatactagagacaattggagaaatattgagtttaagaactatttttctagaaaagatattacatgttttacaatacccaactgtagtgttagtacaaattgttgaattataagttttctaacacaaaatagaaatgagatcagatctacaatcattatactatgtgtaatttgtgaaacccggtccaaagtgcaaatgatggtaactatatatggtgttaagtgaaaatataagtctaactctagtccaatgtgaaaatttggtaaataaaggttgaccaaagtgaattttactctttaccagattattgtcgttgattatctacttgattataaggattacttaaatattttgagaaatagcttagaacaaaacaatccgtggtaataatccggtgaataagctcatgttcatgctatgttgagctacatgtatcaattggatggtgaagaagcgatgcaaaagatcgatggtatccctgaataacacttttttttctctaaataagttaagtactgcttccatgttcttcctagaagtaaattgcatgaaccctaaaaccatttgcaattacagcttgtgcaaaccagtttgccaactgcccaactaggtctgcttccaacttataactagaggagcaaataggcattgtgatgaaagaacaaccttctgttgcaaacccctt

SEQ ID NO: 61349 - DNA, 1025 bp, Oryza sativa
tttttaattttaaaaaggttctaaactatgcatgtctaacgcaaccaaaatttgataacacccaagcgtgccaacaaattgaattccaaaatgttggtaagggtgattttaacaataaaagaaataatacctttggtatatatagtgtagttcagggctgcacgacctaaaaaaaagttaaatcctgtcaaacaaaattcccaaacacgtacgggtgtattttcgtatgaatttaaaaagcttttttgtaccgttggcttgagcttatgttaaaaatgtgtcacacttgcgtgtggtttgcgtgcgcaccttttgtataatacgtaaacaaattaggaggaaacaatggaaaacttaatacatgttccacattactttccatcccaatcgaagtataacttattatatgactcgcggtgctcataaatcgcaaaataagcaacttatccaaagcaacctcttaaattgccgtcgacatctcattgacaccgactgcaatcccatttctgaagatgaaaacaacacctttaaataaggatagcacgttttacatgtgtagacataggaaagttctagaaccatgcaaacaaaaaacttagactcattcagatttgaacttttctctatctatatatatttttaaccgggtccaatctattttttttttgcgaaaaatctaagaaagtgtgaactgctctctagcctagatctaatagaatgatggaaaaccttacatttttttttttcgaaagaagtaggtgcggattgtatccaacattttgcatgagcatgacttacaaaatgaaatctagaggcacgattggaaccaaagaatttactttgttttaaccattttggagctttatccagcatagaaatgaaaacttacagcttgctgtccatttcatttctcctgattattttcttcgtttcttttctgctataggaggcataatactcgactacccatcagaactgttcttgggtatcgaaagatgtttgcagaacctgttttgtactaaaaa

SEQ ID NO: 61350 - DNA, 2419 bp, Oryza sativa
tgtagctgttttggcctattttttctagcttggatccgtgacaggccatatctatgaggtcgggctcatctagcatagcaacatcattctttagatagctaatatccactggatatctaaagctcaaatgcaagtatgatatttattatcactcctaaaacctatatgcaaatatgtcacatcaatccattaaacacataaaaacatgcaagcatatagtaattatatctacaatttatttcattttagaactaacatatacatgataaatcatcattcttaagtcattttcataatattttaatccaaattatttcattatttctcctatatctaacatatatcctgtaacaaagcacggtgcatcatctagttctttagataagaacaagcttgacttagctgataatggcctgcgacatatccacgtcgaaagaaatgagccgaatcaactactggtgggtagggttttgcaacaaaataagagtgatggtttatgtaattatgtcttttaagaaaaattgcatggtgacccgcgcatattgcacggctagcatcgttatattttttatacatatatatttacattttattataaaaatatgttaaaacggtaacataattctaaattttgtactatcttgatcaaactgaccaatgtgtaattgtatatacgtgagagttattaattatttttaattctaaattttagttatttctaaattgtattctgatatggaatttttttacaaaatgtatggcatgagtattaaaaaagtattgtgtgataatgatcagaggaattgtgtgattggttgagaagagtatatgaaggagaatagttgtgtcccaaaatataagtgagaatgatcgaagaaagtgtgtgatcgattgagaagataaagtatctgaaggaaaatagttatgtcccaaaatgtaagattttttaggttagcacgagtattatgaaagttcgatgatgcattatacccggttttgtagttcgggggtgtattttggacaagcataagagttcgagggtgtaaaatggacttctccctttttttttccttccacggccaaaataggcctcgttttacgggtccaaattccagcccatgtatatctctttttttaaggaataagttcatctgtggtcccttaacttgttgatgaatccgattttcatccttcaaccgcaaaaccagatatagtgggtccctcaactgtcaaaaccagtgcagaagaggtccattagcggtttggacagcggttttgtctgacgtggcgcctgcatggctaatttgacttggttttcagctgatgtggcaatgacgtttcgcttatgtggcaatttgttccagaaaaataataaacctcatgggacccacaggccagtgccacacacaaattaataaaaaaaattggtggggccatgtgggccccacaagccattttccctctcttcaattctctctcccttctcatctactgcgacggtggcacgggtgaggaggggcggtggcggggcggagcaaaggggctccgggcggagccctcacgacggccacgccctctccggcggggcgtcggcggtggcggcctcctccggcgagggtaaattcccggctccgacgtctgaccccgcatccgccgatcagcgcaccaccaagctctcctcccccttcgccgaaagccacggccacctcaggcccacccctccctcctccccgccgcgtcgcatccccgtctcaccgccactcgacgatgttcgccgcagcctctacctcttccgcaacccccagccctcatccggcgcgacctccgccaccgcctcctggaaccccagcccctccttcgtcgacatcttccacgccaggccggcccctccgaccggccgcgctgcgaccaaagatctgaagacgaacaactgtaatgatacatctgattttgctgttcttgtttcttgtttagtcgacattggtgaatgcctgatgaaactaatggataacctttggttactgatgatgccgtggttgcatttggtttgctagtggctgcagcacagagtgtgtcggttttgatggcctttggctctcaggccataacgacgtacttgctgggaaaaccgcaacagcagttggtggagagggtgagctgggagtgttgtacatttgatgcattttgttgtttagatgaaatcgcagtgaacagcagattggttggctcgcggggcccttcgccgtcgccgtcgacctcctcgcgccgctattcaccgctgcggcatagacctgccaacgccgtggtgttcgacggcgtcctcccgtgggctgccaccgcggcggctgggctccgcatcccgcggtacgcgttcacggggatggggtgcttcgcgctctcggtgcagcgagcactgctg

SEQ ID NO: 61351 - DNA, 3996 bp, Oryza sativa
gatccccatttgttgataattacttcatacttcgtattggggatttaggacttgcaaaatacttgaacaacattacgttctctcagttgacatcactttgtagttcgtcatatataggagtatgcctatgtaatgttatagtttatgtaaagtatagcaagatttgtcttggttcacacacactaaacaaacttcatgtcagcctcttgtacgactttgttctaagctatccgttaagtttatttttttaaaaaaatatttaatttattcatataataaagttgaaaatccatgtcaataatctatttcaatatgaccattcttcacaaaacaaaaatcacaactgcaatcagtgcaattctagcaattactttgttcatcagacaaggagaacaagcaatacatactatcattgcctgaactcttttaaggcaatacatgtttttttgacacggattaaggcaatacaccgtgtcaaaaaagagcagtttagtacttgttaacacagatacaaaagagcagtttttgagtattatacaactttctgcatggaggacacctcaagaaatccgcaggaacacaggaagtgctacaatggaatgtgcatgtatgcttaattacacagaccaaaatttgccataggtgtaatatttcagttcccagatccctgttttgggatgcatgactgggtccatttacatagtgatattgaggatggccagcttaaattataatgatctatttacaaatctctggcaatttgttgtttacgtctatgaaagaacaacgattatcttccaacagttacatacttcctgaaaataagtggcgtgaaatagacattgttagtccatcagaacatgaaatgccgccttaacagagaaatcagaattcgggagtaaaacaacctgcttgtttaagagacaaaaatagactgaagcctgtgacaagcattcaagaatggttgcggttaagcatattctggaaagaaatgtacaaatctttatgttctgttccaaaaatctcttctgcctttgagagagtgtcctgcgcaaattcatcaagtacaacaagaaaatcatgtttacatattttcgcagaaaataaccaactgaaaagtcaacaattataaacgggcaatatgctacctctcgtgattgtttctgagcattgaactccttgatgttagctaaaaatgccccaaattgctcatacgaaagtcgtgtcctgggatttgtgtccagaagtgttaggatggaatcgaaatattaattttcacataaggtgaacagcataataaccaaccgtgcttgccggaaaaattcctttccgtctatacggggccgccctggaaacataaaagattttgtattatcagcatatgcatgttcaacaaatctccccaaatgaaaataagattcaacaactcccaaacctgcgaacgaacgatgctgaggaggggaggtgggtgctgaatactgatggcttgacgatccatgccatgatgaaaatgttgagtggacttctgacagagattttgtaggtgatgttggaccagataagaacttaggtgttgaaccaggagttaatttaggagctgtgtatggtgtgactgagaactgatgttctgtaaatgtttcatagcaagtatatgctgatataagatgtgataagttgataatattcaggtgttcgataagagtaagttattataaccaccttgggctgattcagtcattgtggatctgctggaactatctgcagaagtgcgactacttgaaacttcatctgccaagtaaaaaatagtgaaaccaaggaagatgcatgcaattctggctattacttgaagaaaagacaatattataggatttccgatgaggttgaacaatacctttccaagagggaactcgagcagtcaaattgttgtttgcatcaaaatcacggtcatcacctatttctgacaattgctgcaagattatgcaaataaaattatttacgcacatgagcaacttcagaaaagcacagcatgaaatattcaacatatagaagcattttcataagtaatactcactaataaattgtcttcactcagtgacttcatcaactgcttcttaaatgcttccaactgcatagaaagagtgatcttcaacaagcagccaactaacatacaaattttttaatgctgataaaaaaaaacttgacaaacttcatgtcgattagcattctgacaaaatcataccaacaaatatgaccatttagggcaagaattcgagaataatttgaaagccacaaagggtgggtaaacttagcagttatagcttccacaccacagtgagtcagtgacaacaaagcattagttagtcgttgatcctgttcttgtttcttttgaagtataatatctggcaaaaaagggtgaccttctagaaacttcttttttcataattgtggactctttaacaccaagtcattctgctattccattgtaatgcacaccaaagattatacatttgaacaaaattcctgactcactattaatctacaactaacaattaaaagatattccatctgatcccataaaacttcggtacacggttgaccaacctatgcaaactgcctactactatgattctaggaacacctgcaagaaaatcacatatctagcaagctagcaaactaacactgaaagtacatgggttgagacatgattccagcaagttttgcacgaaataaacaggcgagctatcaatcagagcacggataaaaacccactagctccctagtataagcagcaattgaaacttgaaaccgaacaccatgttgagaaatcacagaattctcactaaaattgggataattgagtcaccttcgccaagttcctcgccatcttcttggccgtggaggcgagcgagtccctctccttcgccagcttcgcctgcacaccacgaatcgaacacaaaccaaactgagtacgcatcccaattctgctgccgaaagcatcccagcgacgcgaggtcccaggggctcacgttctcgtcgagggcggcgaggaggcgggcgtcggagtccgcgaggcgggcgcggaggtcggcctcggcgcggtcccggtcggcgaggtcgcggcggaggcgcgccgcgtcggcctcgaggcgggagacgcgggaggcgatggccatggaggtgatcttccgcgccacgtccagctgctcgtacgggtcggtggggatcacagccaggatctcgtcgggcaggtggaagtccaccaccccggccgccgcctcgtgcctcgccatcgccgccacgcgcgccccacgagacggagcagctcggccggtcagttcctggacggcggcggcggcggcggaggttgctgcggtggtcgccggcggcggcgcagagcaagactggaaattaaagttttttttttctgatttttaattctttttggggatttgatggggataggatggctgtatatacctgtatactgcggggtcgttgagttgggacttccaagtcattttctcacacatatatgctcttcatttcctcttattaattctccattttctaattttatttttttttgttcatcaatgtgatagttgagggttggtacttggtaggagtgacctgtataaaaaaaatatagagagagagtatatgctttgatggctcttgtctggaattgtgttaaattaaaggtgtactagtaagagatactcttataaaatagttatatctttttaaaaaatgaaatgcacatgagaataccagaatattttgtcttttcatacatgatatggtagtataccttttttttttttttggcgagaggtagatacaggcatactaacctgactgaaaagaaaaatagaaagaaagagagaagaatgggctacatcatttctcgttgcaaaccacatttctgggctagggcccagtatggttggtgggcctaacacattcggcccggtgcgtcagagtgaatgcccaggt

SEQ ID NO: 61352 - DNA, 2161 bp, Oryza sativa
aatatttgccggttatatggcaaggcccaattttcccgatcttcatacaacttagttaaccattcctctcctttgaggctgtacttcttgattatcacattccatatctcatcaaactcctggtcatcctcgatatcaaacatgcagtggtgaaaatcatgtgtgaattcctcaagagtattaaaaacatgttctaaggacttaaaagcattctggtatatttgccacacacaagaacggtgaattgtaccaggccaggtgagactcagggcttccttcaaagcagcagatcgatctgtcaatatcgtctttggctgtttcccacacatggcactcttaaaggtctcgagaagccacttgaaagattcaacagtttcatcatacagaaaagcagagccaaatatgattgtttgcctatgatggttcatacccaaaaacaaagctaagggttttctgcagtcatttgatctgtgtgttgtgtcaaagcagatcacatcacagaaataatgatagtctactattgatcttgcatcagcccagaagacatttgttgctttatcattttcatccacctgaatggcatagtaaaaagagggattatcactcttcattcttcgaaaataatccattagagctccaaggtcctctgaattcatgtgtgttgaagacttggcccgaatgtaattcttgcatcctggaggaatgttactagcatttcggtttcctggttgaaccttggtcaacactctctctgacttcagcatatctatatcaaatggtgcagcaagctggtgattgtgatcttccacaaattctgctacccggtacttgccattggataccaattttatagctatccgtgcaggacaacctgtcctagtctctgggcgaggtcttttggcctcattctttgagcgaaatccctccctagagcatacaaagacccttgacctagcaacatttttcaccgttttatcccacaatccttttcgaacactgaatcctacatttccagcataactagcataatactcatatgctttctcttcattctcgaaaaccattccaactatgggcactcctccagcgttagcaataacttctggcggcacctctggatcttcttctggtttatctacagtctgggaggaaacgataacgtaagtgcagacaaatacacaatgtcatacatctaccacagcatcaaagtgcttcttggtcatttgtaccaagaatgtttttccctaccggtattctgtaaaaatcctaaaatcagactccatttgacatgattgtgcaccaatgctactaactccaagacatgctgaactcaatgcgcatctacattagcctacttgacacttgcaatatccaaccatgaaagccgggttttcagaagccgttggtgttggtgtagaagccgggttatataaattcccattatctaaaaaacaaccatgaaatgcgccacatggaacacacgaaatctctcaaacaattctctgagaaatcaatcagaaaccatggatccccggtctatataccttggcgccctccttgccgaggaactgccctctcgcaccccgccgcctccgctccgcgagagcctgcctcgatggggcctgcagccaacaatggcgccatcaaaaaataatactaataatgatcaaatttctatccatctttaacctaaactcaaacgcgaattcttccttcttggcgatgatatggatcgaggagctcaccttggcggtggcgcgcttgacgcccttttggccgctccgcttctgcatgtagcggaggacgatgtcgcggcgctcctcgtgcgtgtagcgggagacccggacgccgagctcgcggaggagccgcgtggtcgtgggctgcgccgccgacgatggggtcgccgccgccttcccgccgccgtccttcccgtctccggcatcgggggcgccttggccggcggcggcggcggcgggcttggggtggctcttgggagcggcgcggcgcttcttggggttggaggagaggtcgaggtaggtgcgcacgatgtgggatatgcgggacgccggctgccgtggctgcgcggatgctgaggacgacggcgtgggctcgccggcggcggcggtggggtcgccggaggtggaggcggtggccatggtgg

SEQ ID NO: 61353 - DNA, 1545 bp, Oryza sativa
ctgggcaaagtaaagtcgaccaatgcaagttagaacatatccgtcaatagcacagtaacatagaacagtcaggtgatagatcacttacaatgtgccagcaacttttatgcctgcacgtgagttttcttgttatcatagagcttggcaagcccaaaatctgaaatcttagggttgagaccggcatctagcaagacattactggcctttatgtccctgtgcacgatgcggacggtagaatcctcgtgaagataagctatacctcttgctaggcctaagcatatctcaaatcttgttggccaatccaggttcaagcttccctttcctgaagataaagtttgatgttttaaaattttggcatttaagtaaaattccaagtcatgtaaaaccaaataaacttataccaaacagtgcttggtcaaggcttccattctccagatactcataaaccaacagcggcgtattgctctcaaggcagcaaccatacaatgtcacgaggttacagtgttgtactcgagatatagtttcgatttctgtagcaaattgctttttcccctgattagatgactgagagagctgcttcactgccaccgcccttccatcacttaatctaccctgcaagaaagttgcacttgtcaactatgcagggcatttcataattcagggagttaaacaagttatgccgatgaatgcacttgaaaaggcactagtttacaataaaaggcatatctcttgagttttgactttcctgtgtactaatatttaaattaccacgaacttgctttcggcaaccaaattcaaacatgggatgcaaatccagaaatttactacacaaacagaccttgtgaaccaatccatatcctccttcaccaagtaggttactagaactaaaattttccgtagctgaccttagctcattataactgaagacatttggtcttccaactatgttgtacagctctggagattaaatcacaacaaaacttgttagcataacctccacgtcaagttgaagcacacaacgtgacactggtatatgaaataccttctagctccaataatatctttctcttcttctgtctccatataaagtgtccagcaagtgcagccaatgcaaaaactgcaacaccaaccataactacaatgatcacagcaattttgctcctgctcttgttgtctgcagggctacggaccgttgggatgaagtctggagaaagctaactaagtcagagcatgaaaaggttcaaataaaacttaaaaaaaataatatgtacaactacaaaacattgatcatgtgtgttttgatatttatatgcgtttgaaacatattcattcaacttaattcatccataaatttaagagggatatttatatattggtcttatagccaaatattttgctggcacagactgctaacttcattacagaggcttttgatcattcactttagaattgcatattcagttaaatctttaaaacatgatggaagtacctctagcaccaaacatggtggatcattgcccaaagtttttttttagaaaatatcaa

SEQ ID NO: 61354 - DNA, 752 bp, Oryza sativa
gctaccacagttcacagcaaaggaggaagctgtaaacaagttagatcaattagtattagtatttgactaagtgaatccgcggttgcagatttagtatttctcaactaaatacattcatggtgttgcaaagggtgaaaggctcacactgtggagaaccaagaaagaaggatgtatttctctgaaggcatgccagccctgaaggtaagatactgcaggtgcagagcatcaacaatttgaatcaaattagaagctgagagaacctattaattatgcttgagttcttgttgagaaatcagaaatatgggcgcacctgttattggaactatcaatcacaaaattgtttgccaccaaattcctaagtagaatgaactctattagagcttgtttggtctagcttgaaaaaacttaagctataaaaaagtattcgtttttgttctatgttgtaagggaagtctcatttccatgaagactcttaatcataagtggcctatagatgatagatccaaaaatttgttaagacatataaactagatgcaccaaatacagctttcagatttaccaaatgagctagctcattacatctgtatgctatacgcataaatgctggatgacaagccttacataggttaaacacgccgttatattttagggaataaaacatggctttactttggctggagctaagtaatcaatgtttcagaacttggtacttacaattgtaaatttttatcactagcccagggtaccgagct

SEQ ID NO: 61355 - DNA, 4491 bp, Oryza sativa
agcaaactaaatatagccatttttttagcaacattaccaaaatttagtaaggttaaccctggcatcaaagtgaacagaccctaagtttcactttgaactactcctaactcaaagttttcacataaaactaggtatgtttacctcttttgcactttgtaccaccctctctatctctttctgctcccgccccagccacccccatttttaccactacctgaagcttgatcgataaggcaccgctgagttccttttctcccacgctggtgagcttctcccagtccggtttctctctcgtgtccacgtgccttagccacatatgccgctggaccagaatgaagcaggggcaacaaggcagcgaacaatttcaccatcgggtcagaatttaatgaagcaggggcactccagcgattctgatgacaactgaaggtggagatggtggtgggagctagagatggataagacaaagatactcccttcgtactctaatataatagattttggttaaatatatcatatcctagtataattattcttcttaacagaaccgctataggatacggggttaaataaaaatgaccatatacagtctttgatatgcacatgctctacccttagagagtcactctagccaaaactccctaagttattagcatcctgacctttagttcttattgagctgtagaaaattattttgaggtgtagatgtcacatatgagagtgacacgtactgtatagccgtaccaaaataatcatctgataccgcggaatttaacagcaccttatccctaacgagttatgctgtaagcctgtaatcaacggagttatcaaaatcaatattcttttgtcctaaaatcatcttagcacacacaccaaggacaactaattctacttatcatccatttaaacaagtgattcattactccctccattccaaattgatctacatatttcataggtacaccaagaccaagaaaaactaataactctctcatactatatttactctagcaacaaactcgatacatgcaccatccccaacattttctagccaatagcaaatcaagatattacatatgtgctataaatacttgtgtgcatggatacatgcatcaatatccatttactccaatgcacaaataacgaatagacttaataaataaacacaaatatgtagatcatttaggaataaccccagaaaaactagatgtagatcaatttagaatggagggagtactatttacatttctcgatgctcatggagccaaacttgtgtgaaagaatgaagagtcacgcattaaattccataaagtcattaagatgatatgttgttggattgaaatatacctatcaaagatagatttttcagatttggaaatatgactatcaaaaatagatgaagagagtaagatctattccatcatagtggagcaaatttcgagattaattcataatacttcctctatttcatattataagattagacatagatccattaacatctatataaatattgataatgctaaaaagtgaaagtaggatttttctttctggagaacctgtccaccacaactccacaagttacaagctactacacaagaccatttcccattcagcaatcaagtgtcaaaagctacttacccccatccatgaccatgaacacgcacgcgcccgcgcacgagcttatcttttgccaacgcttgactctttccccagtttcccctcctcttcaacagccgcaacccgcatcctcatgtggacagagagacccctgacccatcatccccgttccaaacaaaacccaaaatacggattaatcattagtttaatattgcaacaaccgcgcacatgtttagtttagccacttctcgttggccgtgcgttgcatctgggacaagctggggcttcttgcttcttgctcgctcgctgctgttttacactattcacgtttaacatttgaccgtttatcttatttgaagattagtatttttattgctattagatgataaaatatgaatagtacttaatgtttgactaaatatttttaatttttttataaattttttaaataagacggatggtcaaacgttagacacggatatccacggctgcacttaatttgagagggagggaggcagtagaatctctcttttttttttatacagttgacagcagcgtcgccgtttgatgagcagtacaacaattttggtcaattcagaatagctgactgtgtattgtgtgctgcgtgcgtatatattgtctccagtattcgtcgcagcgcgcgtccctttctacgcccgacgatatcatccatctcacccgtcgtcaccgcctcggctcacagcttctcttctcccagaaacggagaagagggggaggaggcgagcagaaggctcaaggagggagacgatgagggtgatgagccatctcctcctccatggcggtgtgctcctgctgcttcttgcagcggcggctgttcaggctcagcgggtagcaaccaagactgatccgactgaaggtgagcacgcgtgcccgcctgcttcgattctgatttctgaatgaaacgagagttcttttttttgggtttgtttgagaagcggttcgtcctgatggagctagttatgagaatctgtgactgtaaggattccgccttcaaattcgactggaaaaatccgccttttcgggagttcttgccttgagattcttgtttttttttgggataatcacttgatgataatccatctctgctttgctccgttttggcttgtgctgaagattttccgttgttgagcttggattgaagcttgccatgagaacacctgcatcctaattttgaagcctgcaactccgcaagcatgatgatcctgttcttgagttgtccttccaaaaaatttcagttcacgacgccgtcgtcactcgtcacccaccgatcgacatgaactttttttaattattggccgttgaccttcgttttttaagtctgaaaccatggcatgtttgttcaagctcgagccatttcggcgtcttgaccgattgctggccgtccgatcgtcgcgacccaggccatcggacggtggagaagttccaaggatatgctcatagttatagcgtggttggttggtgttttgcatttgcagcggcggcgctgaacgcggtgttcgcgaagctcgggcagcaggcgtcgttgtcgacggcgacatggaacatcagcggcgacccctgcaccggcgccgccacggacggcacccctatcgacgacaaccccaacttcaacccggccatcaagtgcgactgcaccttccagaacaacaccgtctgccggatcaccaagctgtaggtgtcgccgtccctctcttggcgcgcgcgcgccaggtgttcgacgaattgcctgcctgagctccgaggcgcccgatgcgctaaatgggatttttttttttgctgtgatgcaggaaaatatatgccttagatgtgcctggcacgataccacaagagctgcggaacctcacgcgcttgacccatctgtacgaatgaactctctctctcaacttccttatgttggattgtctatggtccagaaactattgcatttgaagcacaccatacggctgattgatagatgcaatggcaaagttttccatttgccgtcccgcaatgccattcaccttccagtatttctgttgtcatcacagtacctcttttgcattcctatagaatttggtcggtcacttatcattatctaacatagtggctactatttcttataagctgcattgtagtagtaagttaaaacttaaaagggtacttctattatttacttttctgaaagaaaaaaaggctaccttctcttatttcagctatgaaatgatgaatataactggaaataaatctattttagtatttcacaatattaatgttgctgatatctggtgtggtcttatttcaggaatttagggcaaaatacattaacagggcctttgccatcattcattggggagttgactaatatgcagaacatgtgagatttagaactcacaaacatcattttagtaaatgttttgctttgcattgaatctcaccttttctctcttgaacacacaaggacatttcgcatcaattcattatctggacctattccaaaggagctcggtaaccttacgaatcttgtatcactgtaagaactatattccatgatttcgtgacccttattcttcatacaactctaccatacttatgaccgtgagaaataatagatatatttatgctttgaactcgcaccttgaattgatcatctgcataaaaatcatgagatgaagcacactttaaattgagaacatatggcaacatcctcagaattgcactattcaatgatgaaggactccaaattgtgatgaatgcacaaatagcatcttcatttgttgtggtattcttgtgtactactaagacttggatttaaactcaattgaaggcaaacttttccgttgatagtgttcgttg

SEQ ID NO: 61356 - DNA, 7045 bp, Oryza sativa
tttttctgcagcgtgaacgtcaggagaagatctttgacatcagtaaggcagcaggcgataaatcttacactgttgttaagaagtcatataaagttcctgtgaccaaaaacttccctaacattcatctcttctggcctggcaagggcacttcctgcattcctggtcaaggctactatgggcccactatctcggctttgagtgtaacccctgcaggtactcaccttaactatagataatggttccaatatgaaaatgatgtattttctagggtcagttgtaccattctgcctaagatcacattttttttctaacaagtgaacttcttgtcagatttcacccccacggtgggtatcgtggcagaacaaaacaagagtactagtaaaacaggtgttattgttggcgttgtggttggtgtggcagttttaggtttggtagcacttgttggaatttttatgtggagacagaaaaggagaaaactgacactggagcaacaaggtacatggcacactatgctcacattgtatccttgaccaggcaaacaagaagttaataaattgatgttcctttttatgttcgcagagctatacagtattgttggaagacctaatgtattcagttatagtgaactaaggtctgcaactgaaaattttagttccagcaaccgtcttggtgaaggaggatatggggcagtttataaggttagtcatctgtaaccttttcctgtgaattaacttgttaaaatctagataagtagtgattatataatttgttgttcgttatggataattaattggttacactctttgtgctttctagcttttgtacaaatgatgcatatgaataaaccagaaaaaaatatatgccaatgtatccattacagaagatgtccggcattgcaatacttgaatcttgcattttggtgaattccactttgcagggtaagttaaatgatggaagggtagtggcagtgaagcagctatctcaaacatctcatcaaggaaaaaagcaatttgcaacggaaatagaaactatatcccgagtgcaacaccgtaatcttgtgaagttatatggttgctgccttgaaggcaataatccactgctggtttatgagtacatggaaaatggaagccttgataaagcactctttggtacaagctatttcagtttgatgcaattgggattttataatttaggtttatcatagtctgtaacctaaaatctaaaccctccatttgcaggaattgagaaattgaacatagattggccagcacgttttgacatatgcttaggcattgcaagaggtctggcttatcttcatgaagagtccagcatccgtgtcgtgcacagggacatcaaggccagcaatgtcttacttgacgccaatctcaatcctaagatctcagattttgggctagccaaactttatgatgacaagaagacgcatgtcagcacgaaagttgctggtacattgtaagtacattccatctgttccacctttatgtttacaatcatatttatgttaatggtatttttgggtatcctttgtccagcggttatcttgcacctgagtatgccatgagaggtcatatgactgagaaagttgatgtctttgcatttggcgtggtcttattggagactttagctggacggccgaactacgatgatacacttgaagaagataagatttacattttcgaatgggtaagctcagtagctcagtgatgaactcttaacccaaggaaattcaaattataatttagtcgtgttattggcagaatatacccgaaagttctactttaacattgataacattaacacacatgccatcatatgatttacagttagaccctctaatttaccccttttaaatcaaaatcaaaacaagcataatttatctgattttgcccctatggtctgaatgcttccatatcaaattctcaataccttcaggcctgggagctgtacgagaacaacaaccctctgggcattgtagacccaaatctcagagaattcaacagggcggaggtgctccgggccatccacgtcgccctcctctgcacccagggctcacctcaccagcggccgcccatgtcgagggtcgtgtcaatgctcaccggcgacaccgaggtcaccgatgtgttgatgaagccgagctacatcaccgagtggcagatcaagggcggcaacaccagcttcgccaacagcgccgtccgcgggcagtcgagctcggcgccaggatcgacgtcgcagcaagcctcgtcggtgttcttgaactccatcatccaggaaggccggtgattttcacgccggtgcttgatcggatcaacttttcctcaagtggcagatgataatctcgtcttgtggagctgtgattgtgaatacacgttgcgaagggcaaatggtgtcaagactgtcagttttgcagtgcaggtcgtcgtctcgtttttcttttttttttctttacagtttgccggttgcgtttttaaaaattatgttcagtttgtttcatacctgtacagtgtaagtttgagtatatatatttttgatcgaatagcttatgtgctttgccctatttgaatgtgaataagattttgggccttttactgtggttcatttagtttggtcctgaaatcatgccgaaagagtccgtcctctcgcatccctccaattcattttttaaaattttgaaatcattcacactaaatttatatgaaggatgcttccaaaggtatatacagtggatagatatgaaatcatccctccaattcctggatgctgttttatacctacctaccttaagcccctcgactttgtgcacggttcgtgagtcaaaacgcatgtggttcagacgtgttgctcaattgactcttaactcattggtcagagctaaatctcaacacgtaagcacagtgattcaaagctgctgacgtctgtcattgaaattattcctctgttcccccccccccccacccccttttccatatatacaagtcgtccatggaaaaaaatattactgctcctaaagaaaaggatatttcaccatagagtcatgactaaatcttggaaagatttgatcaagacattgatatacattgtgaagtacttaggaggctgtttagattgtagccaaaataagccttaccaaatgttgataatgccaaaatcatcttggaaagatttgatcaagacattgatatacattgtgaagtacttaggaggctgtttagattgtagccaaaataagccttaccaaatgttgacaatgccaaaattttggtaagttgacaatattatcgagttttgtaggattccttatatatttatcaaagtttggttaaaaaaaaactaaatgtatgcacatttttagcaaatttaccaaaaaaaaatgactggtttgaaacatcaatctaaacaaccccttaattattctatccatccctaaggaatgtcttatcagcttcaagatttatcatataaaaacgatttttcagagtggagtccattaaatctgttaatactaatttatcattttcttcaattttaaaatagtacccctccttatttactcactacattaatgaaggacatattagtcttttaatcttttacttaatttgtctttgactaggcagaacaattgctttttaaggaacagaggaagtagctagtaattcattttctgttttatgtatagttcaattctcacaaaaaaaaaacacgataagcaaaccactttcacaactttggctgcacattctgaagaaaaaaaaagtctgaggctgttagttatgtgtagtgacgtttaattatttttttagggtacacgaccttatgcttgaacaagcatcttggcatatgtgaaatgtgctgaaaatgcaactgccagggacgatttttcatttcgttcatggcatttgggcaagatgttggacagatgttgcatcggcttaataaaactacctttgtttattttcttttccaactcccactaatgcgtggagaattagttattcccttgtcctaattaataatgggacaagttagggcaagccccagcatctccttgtgctagttattttgcagttaggatatcttttttgaataaaaataatatcaaaaccaaagtgtaatcctatgcatataatctcattgacgtgccaagattttactttgatatttatgtggctaatgacgtttgctttctctttctctgtcttgattcttggaggtaaatgtccgtcgcaaaaccaaattaaccaaccaaaccacccatatgacgacgttgaagtccaagttggcacactccaacagtacaaccaagaggggacaacgtcatcaaaccatacatcatgtagtactatcagttaagagacctccttaataaatatctaatccaagacactactaagtacaaatgtacacctcatgaaatgtatactagatcacatatgtagaaatctagcacaacaatttagaaattactacaagttcaaagagaaatgtgaaaaaagaaaaaaaaaagaacagtttcattaatcattgggtgtatttagatcccaaaattttttggctaaaaatgtcacatcaaatgtttggacacatgcatgtagcattaaatgtgaaaaaaaaaaccaattacacagtttgcatgtaaattgcgagacgaatcttttgagcctaattacgtcatgatttaacaatataatgctatagtaaacatttgctattgacggattaattaggcttaataaattcgtctcgtagtttacaggcgaaatttataatttattttgttattagtccacgtttaatactacaaatgtctgtccatatacttaaaaaaattttagccaaagaactaaacacggccaggccattgattagaaaatctctttcacgaaaacactggacgaagaaaagtcttctggcttcatcagagcacagtataaaatgtcattccaagctagccatctgctgaatcatatgtactatgtgatggcaacaacacgacgcatgcatgtttagctgctttaacacacactccatcggctacattagttggtcatcagaacagttgttgctagcagctttgggatgccactttgggaattttttttgaaaataatattattttaatggaaaatcgcaaaattataggtcggctagacgaaatcgcaagtttagcgccctgtcgaactgggacagttcgataggtacccctgtcgaactggggcagttcgacagggttctgtcgaacccctgtcgaactgccctagttcgacaggctagttgtagagtcgaaaaaaaataaaaaagtacttgctacagtgcccgatagggacgtatcgaacagggggagttcgatagggcgcgtggcatggacgtatcgaacagcgggagttcgataggcagtgtcgctacagtgtttttccttttttatgttattttattacctgtcgaactggggcagttcgacgggcagttcgacaggtaccctatcgaactggggaagttcgacaggtaccctttcgaactgcctccgttcgacagggtgctaaacttgcgatttcgtctaactgacctataattttgcgattttccattaaaataatattatttccaaaaaaactcccactttggtatagcataaacaaaaacagaagtggtactactagtacgtgctgcgatgcagcatcaccatgcatgattgcatctttgtttccatttgcctaggcactatttgattcagcttagtattattataatctgaattattagaagtaagctgaaacaaacaagtagattattatgctagattattataatctataagccagattattataatccaataatctcctttagaggagctttttccagattattgagtggctaaaaaacaactacccttagatgtctctaataatctagagaaacaaacaactcgtagcttattttatattagtttattataatccagtttagagtaatctgatttaataatctaaattacaataatcttaaactgaaacaaacactacgtaatactctcattactctccctcatctgattgcatccttgtgtgcattcgcctagctaattaatgctccacatcatctgtcagccactctgatccatcatcttcttcggagcaaaatccaagaagaaggggagagagagagagatggatcctaggttgagctactgttgctacctccatggctgtctctgcgagcttgtgctgctgctgtgttcttggacagcaacagatgctcaggctcagcaaccaccacctcacactgatccaaccgaaggtacacaaccacgcaatctaatggcgtttgattagcgaggagatcgaggtgaggtgaggctgatctgtcagttagtttaatttcttgtgttggttttgggtggcggcggcgtgcgtgagtgcagcggcggcgctgaacgcgatgatggcgaggctggggctgagcgcgccgccgtcgtggaacatcagcagcgacccgtgcagcggcgccgcgacggacgacacgccgctggacgacaacccggccttcaacccggccatcaagtgcgactgctccgatcacaacaacacgctctgccacatcaccagactgtatgtatgaaactgatgaaatttcttcttcttccttactctctccgtcctaaaaaagacctaacttaaataggatggtttaccatatagaacaacaaatctaatctagatgtacagatttcgttgttctaagtggtgtcccattttcatctagattagtttttcgtgggatggagagagtattgaggaattttcatatgttcatcgtgttcgtctcgttgatttgtttgatggatcaggaaaatcaacacgctggatgtggtcggcccgatcccagaagagctcaggaacctcactcacctcatcaagctgtaagccgcctgtaacctaattatttcagcttgagcaacaattgcaattttttttatttttgcgcattttctcggctcagcttgatcattgtgcataatgtggtcttg

SEQ ID NO: 61357 - DNA, 570 bp, Oryza sativa
tccctgatgaaaattactcaaaccaatccaaatctcatggcacgtttgaagatggacaacacgatcataatcagaacgaagaatcccactcaaaagaatattgcgagctttgcaattttgttcaactcaatttttgcagcatcagtattaataactttaggaatcacataaggatgagaaacttttctccaaatatcataattctcacccataatgtaagattgcatcctactacaccaaaaaaaaaaatccgttccatcaaaaacatgaggcttagttgaaaacctaacagaagtagccatggcaaaaactttagatcgataaaaatccaaagaagaaaacgaggctctgataccacttgtaggatcgaacacaagcaaccaagcctaccagaggggggtgaatggtagggaaaaccaaaaacccaaaaacttttagcagaaataaaagttaccctcaaatcgatggaaatctcgacgtagtcctgtcgccgccggtcggaccgctcgcacgccgccggttagaccgccggtatgtcgtcggttagaccgccgaacccgatgaaacaca

SEQ ID NO: 61358 - DNA, 503 bp, Oryza sativa
aaagttgacatgcagattcacgtcttacaaacatataaaagtcttacataaatgcagcacaaaataaaagcgagcttattctagagcttgacatgaacagcgggcgacaccattccacaagcatccttgacggcacggatgaagcctactccttcgagtaacataacctccatctgaagcatactccaactctggggtgggagacagaccaagactgagtactacccactatactcagcaagtcataccggaagagaggtatgatgtagtgtatatataccaagggagctgagggtttatttgcataattctagcatttaaaagtaggtgttgaaagcagtaaaatcgttttaatgaattaagcaatattaatcatcactgcgcaacactacaccacgttgcaacaggcccaaccaaccacttgaactacacaagttccattaggtcaaattattatagatgagactaatcacggtgaatttgattggccacccataacaccc

SEQ ID NO: 61359 - DNA, 1814 bp, Oryza sativa
  unsure (1)..(1814): unsure at all n locations
gtttccttcctctcccggccgccctctcccccatccaacactatttaaaccctccntgcgcctccctcgcccttttccgccccttgccgcaccgtctcctcgccggaatcgagctcgcgccgtcgccctctctctcctccgtcgccgacgacctccggccggccttctccgctcgccgggactgtctcccgccctagcgtcacctcctccggcttcgccgcaccgccgtcgaccccgtccaccccctcgccgagctcgccgaccgccggaacgccgtcgaccccgtcgacctgagccgcgccgccgccttcctccgctccggccgccttcttcgtcgtcgctgttgacctagggtgagccgtggaccgccacctcttttcccccttcccttcccctctctcggccaccgctccgccgtgccgatggccgccgccggcgaccataggggcgcgggtgccgcctcccgccggctgcgccgtcgtggccgcctttgggcgcgccgagtggccgccgcgtggggcccggccgtcagccgcccgcgccctcgggtgtggctgacgcgtggggcccacggcgccggccggtgcaagcccgggtgcgcccggtccaccgtggaccatgaggctgccgcgtgggccccactcccgtggacccggtccggcgccccctcccctcggctgacgcaataaacacttttttttaaattaaaatttaaatgaagaaatgtcacgcccagaaattcccgaatagaatttcaagcagaatgtgcattaaaatccccgtccaggaccagccggggtacacaaacgacaatgttgacattcagatccacgtcttacaaacatcataaaagtcttacataaatgcagcggaaaaacgaaagacaacaggtgctaagccttgactagaactgcagtgggaacaccactccacaggcatcctcgacggcacggacgaagcctactcctcagagacacctccatctgacacatactcgaactctggggttgggaaaaatagagcaagactgagtactacctactgtactcagcaagtcataccggaataggggtgtgatgcagggaatcatcaaagaagagctgaagtggttcatttgcataaacagaagttgaaagatttaaacagttgtaataattaaacaatatcaactatccactgtccaacgctaacccacgttgcgacaggcccaaccatccacctaaactatccaaattcaaaagattacactagggtgagcctaatcacggtgaatctggttgaccgcccataaccgcgggcacggctattcgaatagtttttactctgatcagaggtgtacaactgtacccacaagacacagcccctcgacacgtttccgtgcgccgacatgccaccacgacacaccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgacctgctaaaccatgcacccacagcccaccatgtggtttattttaattaaccaacaccaaagcggtgtcactaatccaacaaagccattagaaccaatgggctgcaggaa

SEQ ID NO: 61360 - DNA, 12587 bp, Oryza sativa
ctcaccgataacggtcgacgacggtgggcgacggaggacgatggtgacggcgggacgagctccggaacctccagcgcacgacggggatggggctccggcggcgaatctctatggaggaggggtggacgaggtggacctcggccgcgcgaacccaacggcggtgacggcgcggtgcggcggcgggtgtagcggcggctagaggcgaccggagtagcggaaacggcggcggcggatgggcgcacggcgcgggagcgatggggagctcgggagagggaggcgaaatgggaaaaaagcgagagggagcgacgggggagcttaaatagggagagagagggccggacgtggccgggagaggcgggaatcgccggccgacgtgggggagtgggggaggcgagagaggcgggattcgaaaatcgaatcccggccatctcgggcgcgggcgcgagcgggagagagaggggagtgggcgcggggaacgcggcgcacgcgcgggcgtggtcgacgtggcccggaggaggcggaggcgtggacgcggcggcggtttcgggcgcggcggttgctggcgcggcgtcggccggaggtgggggaaggacccgacaggtgggccccacctgtcggcgaccccgggagaggagggcggcgggcggcctggctgggcctcggcctgcagccggcccagcagggagggggggaaaggaagggaaaaaatgggctgacggcccatttgaaaaaaaagaggaaaaagagaggaaaaagaaaaagaaaaaggaaaaaggattttccttggaattaaaatattgcttgctcaattttaattggttaaaattatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacaaacctaccccccttaaacggaatctcggccccgagattcggaggagctggtgaagaggtgcggatgggcggctttcaactcatcttccctttcccaggttgcttcctcttctgaatgatgactccactgaactcggcaaaacctggtgatcttgtttctggttcttctttcgctggtatcaagtatacgaaccggcttctccacgtatgttaggtcctcctggatatcaatgtgttccgaatcagcctgttcttcaggtacccttatgcacttctttaattgggacacgtggaacacgtcatggatgccgatcatattggatggaagttctagctgataagcaacttccccccttcgttccaggattttgtatggccccacgaagcgtggtgccaacttgcctttcgtctgaaagcggtgtactccccggagcggagtgacacgaagatacacgtaatcccctgcctcaaaagtgagctcccttcgacggttatccgcgtagctcttctgtcgagactgggcaatcctcaacctttccctgatgattctgactttctcttccgcttccgctaatacctctgtcccgaacaattgacgctcgcctgtctgatcccagaagagaggtgtgcggcacttccggccgtataaagcttcaaacggtgccatctgtagactggcctggtagctgttgttgtacgagaattccgcatatggtaagcttttgtcccaagctccaccaaaatcaagagcgcaagctctcaacatatcttccaagatttgattgactcgctcggtctgaccatcagtttgcgggtgataggccgtgctgaaatttaaacgggtccccaattcttcctgcagcttctgccagaattttgaggtgaactgactcccttggtcagatacaatctttttgggtactccatgtaggcacatgattctcgaaaggtaaagctccgccaaccttttgcccgtatatgtggtatgtactggtatgaagtgagaaaccttagtgagtcgatccacgactacctagattgaatcgtgacccgatgatgtccggggcagtcctgttataaagtccattccaatctcttcccatttccattccgggatttgaagaggttggagtaaacctgctggtctttggtgctctgccttcactcgctggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcaactctgctatttcagaatcgtttacttgagctgctctgacttgatccacgagcgtaggccgtgcctccagagcggccacaaacccgtgttcaacaattcccacgttgagatgctcaaactcctgccgcaattcctcacacatgccctcgatgcacagggcagtgcagtaacttttccggcttaaagcgtctgccaccacattggctttacccgggtggtagtgaatacccatgtcatagtctttgattagttccaaccatcttcattgtcggaggtttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgtaactgtcgcgaggcatacgcaaccactctgccctcttgcattaggacacatccaagtccgtgacgggatgcatcgcaatagacttggaagtctttcatctggtcaggcagaatcaaaactggtgcggatactaatttctttttgagctcctcaaaactcttatcgcactcagctgtccatttgaacttctcatctttcttaagtaactgagtcatgggtcgagcgattctggagaagttttcgatgaattggtggtaataacctgcaagtccaagaaaacttcgaatctgcgacacggtcttcggcggggtctatttggtaaccgactccacgttcgatggatcaactgccacaccctgagctgtaatgacatggcccagaaatttgacttccgtcgaccagaagtcacacttgctgaacttggcgtatagctggtgctccttcaacttctcgagtactagacggagatgttgttcatgttcttcttcggactttgaatagataagaatgtcatcgatgaacaccacaacaaacttgtccaaaaattccatgaacactttgttcatcagattcatgaagaatgcgggtgcgttggtaagtccgaacgacataaccgtgcactcatatagcccgtaccgagtggtgaaggccgtcttcggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcgataatcaacgcacatcctcttcgtcttatcctttttctccacaaaaatgaccggagcaccccaaggtgaagtacttggtcgaatgtaccctttctgtagctgctcatcaacctgcttcttgacctcggctaattcgttggccgccattctgtacggtctcttgtaaattggagcggttcccggtgccaagtcaatccggaattcaatctctctcttgggtggcatggtagtgaggtcttcggggaacacttccggatactcgcagactatgggtatatcttcccatttcctcaagttcttctccacggtgtccactgggatttccgtctcaatctgattcaaaaagacccctcgctttgatgagtctagtgatttgtacaccacggtttctcccttctcgttggtcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccttggggtatgaacccgcattggtgtgctaagttcctctcttattaacccatgcatcccaacaaatttctttgaaatgaaagaatgcgttgcaccagaatcaaaaagtactgttgcagggattgagttaacagggaacgtacccagtacgacctctggtgctgcttgtgcctcctccgcagatgcgtggttgacacgagcccggataaaccttggcccggcacgcctaggcttcgagcatttgtcagcgaagtggccaagctcgccacagttgaagcaggaccctggttttgctccagtctccttcttggcttgcgcgggcgggcctgactgtgccggtgccattggtgggcgtggagctgcaccgcggttggactgacctctatggtgggtctgactgccaccggcgccatggggaaagttgctagggttgaacgggcggtactggcggacgatcatggtggtaggtccaccctgttgcccgggagcgaagcgcggcctttggtgacttccctgaggtgccctgaactgtgcggccttcctcttcctgtccatcttgttgcgttgatcctcctgacggattgccttgtcaaccagcctctcgaaatcggcgtaatctccagatatcaactggttggttagctcgtcatccagacctgccatgaacttttcctgcttctcggcgtcggtacggacatcctctggtgcatatcgcgcgaggcgattgaactcatggaggtactccatcacagtcctgttgccctgatggagtgcccgaaattccctcttcttttgtgccacgaccccatctggcacctgtgccttcctgaaactacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaactgctggtgctgctgttcggcgtgctgcagcatcctctggtgcatctgctggtgctgctgctgcatctgctgcatcatggctgccatcatctgtgtctgatgtgccatcacttgggctagcgtcggattctcgggaagtggtggcggaccattgccggagttgctgttgggatgcacaccctcagtgcgctcttcgccgttgctgccctcgcctgttgcgcggctaccattcctggtgtagaccatctggagggaaaagcagacgggggaaaagaagaaaaacagatgctcaggaactaagctttattacataggaatttaaactgcaattgttctgatctgaattaaaacacttaaagagcaagcaaaaatccttattaagacagccatatcataggcacatgatatcgaccgtcgactaaccccaaacaagcaacctaaacacacaaactaacaagcagaagctagacagtctgtaaactaatggaaaacgagcctaatgctcggaacggctcctgcggtcggtggagtcgaaggcgtcctcctgctcgtcaccaggtccctctgagcgacttccggaccctggcagataagtctcgccgctgcccgactctgagccactggagctgctgctgctgagatcgtggctgccactgggagtagcagacaaccaacctccgttgcctctggctgggcccctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgcagtcatcgtcttgcggggcgtggtgcggatccggactcctcctggcgcgggaagaccctttaactgagcgttctccctcttcaggcgcgctatctcgtccttcagagcgacgatcctcatgagcttcccatcattcaaggccttggtcgccttgtccaggtccgagtgcatcctatccaatcccctcatcacagcacacatgtgaccaaaggtggtgtcgttctcgccggctgtcggacggaaagtactgacatcatcactgctggctcgccgagggtgaaaccggtacaccgtgtcgtggaatatgtagttgtggcgctcccgtagtctagccatcatcaggtatgctgcctcctgacaggcgtgatctgctgggcctccagatgcctccaccaccatgttagctaggcaggtacccacgtagccgtggacctccaggcgaacacggtgaggaagctcctcgacacgtttccgtgcgccgacatgccaccacgacacaccggaaagaggccgtgacaggacccttcgcataaccccctctagccaagcacaccacacctcaggtttcacccccgtccccagcgggcaacgggcagtcccctctcgtgcctaggtgaatccgaaagcgacagaggccgtcgctgggcccgccccgctccatcacgcccacccttgcctggatgcgtcgactagaggaaagctacactacaagcctagccgttgcccacgctggcttgtgataagtacgataagttcttccagggcatcccgcgaactggtccttaactgccataggtgcgacctgctaaaccatgcacccacagcccaccatgtggtttattttaattaaccaacaccaaagcggtgtcactaatccaacaaagccattagaaccaacagtctaaacattaatgtgattttccccattgtgaactagttgaactaagcatggctaagcaattcctagtccaaagtctattcatgttataacccaagctaacaaaggagcatggtatcaaaatagcatggctgtaacaataggtaaacatcccatagtaacattataaaacaatgcaatatttgaaagaaaacaatagagcatttgcaatataggatcaacatgttcaagtgacaagcatgacttgccttgctctgctgctggagaaacctcagcgactatttcgaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactatacaagaaaaaccttaaatcatttattgcacaatatattccagggctgacgtcatcaaggcggggcgcggcgccgacatgcgggccccaccggtcagcggctcgggagagggaggaaggtgcgccggcaagcgggccccaccggtcagcggctcggggagggcggtccacggcggatcgggtccacggaccggggaggagcggcgcgccacgcggcggccgaaccgatggccctccccgagacgtggccgggagaggcgggcaacgccggccgacgtgggggagtgggggaggcgagagaggcgggattcgaaaatcgaatcccggccatctcgggcgcgggcgcgagctggagagagaggggagtgggcgcggggaacgcggcgcacgcgcgggcgtggtcgacgtggcccggaggaggcggaggcgtggacgcggcggcggtttcgggcgcgtcggttgctggcgcagcgtcggccggaggtgggggaaggacccgacaggtgggccccacctgtcggcgaccccgggagaggagggcggcgggcggcctggctgggcttcggcctgcagccggcccagcagggagggggggaaaggaagggaaaaaatgggccgacggcccatttgaaaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacaagaaattcgcaaatattcacttaaaagagcatataaacttcaaatggccataacttggccatttgaactcggaattggaccattcaagtctctaatttttccttaagaagtcaagaacctatttttgtgctttgttcctgcttgttatatggagtttattagagtaaaagcttttttccttttcattggtcgtgtagacgctgcagcttcggaagatccgctctacgtggaggttgaagctgacgtttgggaaagcgagcaaggcaagtcatatcatccttgaacatattgagtcccagtttataaaattattttgatttaaattattgcattatcgctttatttaaattcctgcgttatcactgttttatttagccatgcctatttacctttgttatgaccttattattattgctattgttattattaccttgttcaccctaggaaaataaaaccccaactagtgggtactctatttatggttccactagtatgaacttaggtagatgcttcgctggttaattaggcaacattaggtggttttacaactctagactttgggaatattcatatcacctggacactatggaatggttggattattgtggaatcggattcacacctccccctctattcaaaatcctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcggggttgatggacatctctagggcaaatgaaggctacatgagctgcggcccggtagtcgagatgtcatggcacagggctggtgtcctgctgctaggggctcagacctgcctacctgtcccggaggttccggccgtaggtggggttgggtcggtattcttgtctatggctaggatgggttggaaactatgtcacgtcttccgtccgtataccgtggtgatatgtggcacgtggttacacgtgacgaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtccaaatcatcgtaggccttgggttaaggcaggttcgtgtgggttcacggccttgattaataatattgtatagctctaggatcgtatttacaaaatagctttgagcaactaagtgtcttttggtgctgtttactgcaaaccctaaccccttacattataactcccttgtactcccttgcatttattctgcactggtgggtgtgtcttgttgagtacgttggttgtactcaatcttgctcaatttttcccaaacccagaagaggagatcctggatgatgaaggctttggtgtctagctcgtgcctgccgtcaagcgcctgtgacacgtggcgccgacacggtgccaacgcgacagagccactggcggtcacggtgggcaccacgcggacaacccagatcggccgagcggcgcggccacgtgggtgggcacaggacagccagccggcagggagtggcagcgatgcctggggccaagaggccaccaacggcgagtggcgacggcgggaaaagcggcggagggtagtgggaaaggagagggggagctcaccgagcagcaccgacgagtggcaactgccggaagggcttgttggcggaacccggagagagctcggtggcagcgctcgtctggacggaggcggaacggtgctccgacagcggtccacgggagggaggcggtggacggagacggcaatgtcctacggaaagagcggacggggtgaggagagcgcgaggggacagggaacggcgaggaattgaggccggtgatggagggtgagaagggagtgctcatcggtgcacgggaaaacggggttcgggtggcgatttgcagaggagaagtggtggccgtgcttgccttcgagacagtgaagccggtggaggttgtcgtgtggcgcgccgacggctaggacggcggcgaggtgcggctggaggtggtacaggcagcggtggctcggccttggaggtgggaatggtgctgcagggtggaagggaaggacggagtaggggccggggtgcggcgtggagcgacagagccgatggtagcagcggcgcagcgcgggtgtagctagagcagtggtggcgggcggctggagggcggcgatggcgggagcggcgacagtggctggtggaagagagccgacgagtagcggagctcgggctcgcggcgtggggcggctagagagcgtgacagctggtggaaaatgggggaaacggaagagggtcgcatggggagggtttttgtgggcgcgagaaggcggaaccgcgatcgggagtagcggagttgtcggccggagtagggtggggacgtggaggtattgatagctagtttttgcgaggaggattgggggagaagtgcgggaacgtggggcgacgcggtctcacgggcgagagcgaacgcgtggggctgaggaggtgggcggggtggcgcggaatcggcgacgacgtgggcagctcgggtggccatggcggtggttggaggcgggctagaggttggggatgacctcgacaggtaggccccacctgtcggcggctcgggagagaggaggccggattagggagacgaaatagactttgtgtgggagaaggaaaatgggccaacagcccaagagaggagtggggaggccggattgagagtaggagggggcgcgcgggccgcgagagggtagaaagcttatgccggaaacggcccaaggacaaggaaggaaatttaattggtttcctttttattttaattgattaaatgaactttgtgcttgtaaaattattccttgagctttgaaaattcgtgggaaatttcagagagttcattagggcacaatggatattacaaaataccctcggccatgatttttaagggaaaattttaactctcccattatttcacttgattaaattgctttaaattttaatataatttctagaaatgatatattaattaatttttaatcgcgaacgaaaatcggggcgttacagcagccaaggctggactgcccttctggtagatcttaccacctcaaggctttggatgcccggcaggatgcacatcatgtgcattaccggttctgggcgcggctttgcatcgagggcatcccaatgcatgcgcgcactgaggtcacgacagtcaagttgatcgggcccagatgtgccatctacttcattgaagagtactcgcgccgccacaactacaaccgcaccttcgacctctggatttggacaaacgaccccgacgccatcccaaaaatggcttggctggggttggtaaatccggacgatgagccggtccccattgatacccctgtgcctgacattgaccccatgcacaacccccatctttcggggcccaaagatgggtggtcatccccggtcattatccacttggataccatagaagatcatcaacctcggccaatgttgtataagcagtatgagtggtcctatggggcctatgatgatgtttctcattcccgctcgcgccctctgcctattccatgcaggcaggagaccagtgcggtgcagggactagatgaggacccagatggcaacggcggtcgcccacacccgcgttaccggagccgctctaggtccctctagggccgtatcacggggagatcccgcagcagcgagcgcaggggtgacgggcaagtctactacaacgaagacacgtgggggcgctagcgcaacagagatgcctacaccaccagaagccgcaaccatcgttctagggacagtgcgaaggtcacggctccaatttcactatacccctcttgtcggttacgaaagaaacctcaacttgctg

SEQ ID NO: 61361 - DNA, 5337 bp, Oryza sativa
ccgtgatttgtttacgttgcgttgagatcgatttccagaacgtgacacgacgcccaccggcccacgtaatcccccgagtttccgtctggaagtatccatggatgggcctcgttgccacccgccaccactgggctgtgtctccactctccagttttattaatttccaaagtataagcactctgctagtgtataataatatgttatagatatcaatatgctagtatggcttgtttctttatttaaatacatagtatttctcatttatttgaatcaattaaatattagactattacatactatcataaaatattgaagaatagtttatagaaaatattaaaagggagaacaccctattcacgactagtttttatagtgtggatatttcgtccgaatgtgtatgtacacaaacagcatcagcaataagaaatttcacatcacgcagcctcaagtaaaaaaatcttgcaacggctacagttcatgccaaaaacagtaggaaaaatccattaacatttctggtaacagcgtaattgcaaagaacacatctcggatgatgtcccatgtgggatgcacctcacaattgcgtcaagggtttgaccttgtgctggtttctgatgtagtttcaaagttccgccctaagcacaacattgtctgagacagagtttctactccctgtgcattttcaattttgtctaaattcagaatatgtttcctcctaagttttagttttgaatccttccaatgctatttagtttagttaaactaaaatagatcacctgttacccacgagtcgacccgcgccaatctttgtcgatagctgtgctcctctattgtgcaagcttgtaagaaaaatatattatctattataatcatactataaagataactcagaaattaaccaccacgtttgcttgaaacactataaattcttgtattaagacccccccgtgagtttggccggaggagatggcgcgatgatcaagagcgtacttccgcttaagatctaactactggatcgctcaccagtttgtgtggaagacaatggattatataggtttggactaggaagcgtaacaccctactcctgtgtgtgggattatgatgagttcttacaagaagtcttgagctcctagggaaacctagctgttcttcctctagagctcaagctatcgagagtcgtccctttttcttggtgggcgatatcctccttttatagttcaatgggataccacatgcaccgtctatacctacccctccatgggagggggacccaccctgcctcgattagaccaccattcgtgccttcaaccggaagcaaagtggtcgctcgtcctcgggtggggccagtgccgtcccccgcctgacacgggggacacccctgtcattcatttccctttaaatgtatggagactttggtggctcaccacgggcggagggcgtccctggcagtgcatcgaccgcctaacacagggcgggacatgggggacactgccgcccgtccaatcacctgtgaccacccgattgacgtgggtcaatcgagcggcgccgcacgtccacccacaccgtattaaatgcggtgagggacagggcgccgcgcatttaaggcgttgagcggcgccttccgccccacccactctccccgccaccactctccccgccacgtggtggtcgggcgagggcctcgggggagcacgccccaagagcccgaggggtgtgacgtggcaccccgaggccctctggccacttcagcgctatccaaggggcgagggaaggcgaggctgcgtggccacgtgactagacgggaagggtactttcctttactgtgcgtacccccgggccatatcaccgacagtagcagatctaaattatagtgtagattgatcgatatatttgtatttacatataactatatatataatacaattttacatttaaatctaattctaattttcatatatactctttactggtcataactgaaacagatagtaagagttctttatgaaatccaaatctatttttagttccagataaaaatcttaattgtatttggagacaaaagataagagctacatatcaaatccaatttcacttttatgtagctcagcaaaaaattatgctgtgaaatccgcttgttaagataacagcgacaaatgacgaaccatccaggaacacgacctcaatttgcaatgtgctttgaagtaagaactcacaattcctcggtgaaatatttcaccatcaaaaagtctattctaaacacgaatatttattctgaaatgctctgacatgaggcatggccgatatatatccattcttctagccacagctgctcaaagtagttaatttacataggcaagatgaggttccttggtatcctgagcctggtcttggatttgcacacttttttgtatgaactattaaatttcaaaattttgcacaaatgtaatggccttctctgatcacaaatcaaatctaacatcccatttttccatccatgtaagcattaaaggtccaattgtttttcctgagctggaaataaggcatctgcaatcgaatacttttttatcaaaaattattaccagacatgataaaatgtagtgtaaaaatgacataggtatgcaccaaaaaacagctcatgagattatatatgcaccaaaagtgccccgttgtagatatgctggtgatacaattttagatttaatacataaaatttagtttagagaacaggttttgggtctctcttggagatgctctaaggataccaagaagagggtaactgatgcatctcttgtcttcaataacagcaaaatcctctaaataataaactatgcttgtattaccctagcacaatccacacacgtctggattgaaatacaaaattaagcataattggttaagttggtcattggcaactgttacattcacggacctagcatagttactagtgaaagtaaacaccacgacaccgaaaatttaccctagtgaatcaaacattggtacataaagtctgagcgtaggattttcatgagctgatcaaaaagtccttgagcatatatcaagtagcatatatcaagtgtaacaacagtaaacaaaaatcaagaagggaaatggggagaaagtgaaataaaaactcaaccatgtataatacttatttccttacaatcagtacagatcatggtaaaatatatcatagcaaagtgttgagagacaagaaagaatataagggagttttacctagcgccacttatctcaactgcgtaggggagcagaggaggcctgaagcatctgcaccaaccacagcaagctcacatatggtacaaagctgcccttcgatggaaggaacaaaccgggatccacagtacgggcaggaaacatccttctggccacggtaaattggaacatatgtggcaccacagacgacaaatggatttctgtagtcatagttcagctcacagctatccttctttccactgcactgttgctgcacctgtcgggccctctttgcttggctctcattagggttgttctccagcagcatccttgcaaagtgctctgcagtagcaaagttcttttgcttgtagcacaaacccatagcacttccaagcacaagcctcatatgaactctctgaagcttgcagttagtgaagtaagctgccaattcttgttggcggttgacatcatctctcaattccttcctcttaagttccatcctcaggccaaggacatactccctcacaatctcgatcaactctttcacttcatccacttccctcctcgagtctaccacgataagagggatggtatgcaagatgttaaggaactgcctcagggcttctgggaacttaccttctgtggtggccttgtaggcagccttgagtctgtcttccatttgtgagaaggtgaaaacaagtgcaggagggcctctcacattaggacttgcagactcactccaacctttctcaacagcaaccggaataatgggggcagttgcaagtgcacgaagatatgagtggctgcccatgtgcagatcgagaaataggggcttgagaggagcaaagtttttgatgcccaattgacggctaagcaatctcattgcagtgtcaaagtttcctgctgctgcgtgctccccagcaagagaagatttctgagtccaaatctggctgacaggcatgcctggaggaggagcaacaaagaccactgagagtgcattaccggcgtttttaggggtctctgcttcaggcggaagttccaggtcttctaggtcccagccaccttcctcaccatcctcctcatttgcttcaccctcctcagcatcaaaaccatcaccaccattcgccatcgcttcgcttgcatcaaccatatccaggtcctcatcaccccagtcagcaccagcagcttcatcgtcttcctcaagttcagccttcccagtagcatccagtccaccctcaaagataccacgcatcaccctaagcaatggccaatcaccactggctgtgagaggtgcaggggggatcaaaagagagcgagtttttccttcaggtagagaaggaatattttcacccaattcagcagcaagcctatcagcaatttctgtgagtccatgggtggcagcagtaatataagcaagaggtagctgtccagcattctctaggatctcaactctcttcatagcatcaccaagatacagagcattgtggaattgacccatcaggttattgttctgtccagcaattttgcacatgaaccccaccttgtccatgtaaccagtaataagatataggaaagcaagcctctcaaaattctttgtacgttggtacgcatattccacaataccaacgtttccctgcctcagggcctcgattcccaaccggtaccagtgatctttgtcatcaatctctttggcagaagcaactgcaatttggatgttaccactctcaagagctaggttaaatcttgtcttctcatctttcacaaagtggagggcaacttctggaaagcctttctgttgcaaataagaaatcacagcctgcccacacagctgggaattcttaatcatactcatcacatgatcgtatcgtttccgtagaagggccagcttgaaaatgtattcagaagcatcaactgtgatcagcttgttctttccatcacgatctaggcagaaaatattattcccaatagcccttgttatgtaaataggaacgtcaagggttttaatgatcccactatctccattgggaagacaatacttgatatggttcaaagtagtgtaaataaacacaccattctcatcccaggcaccacttttcacacggatggtttcatggagcgtacaacgatgga

SEQ ID NO: 61362 - DNA, 1657 bp, Oryza sativa
aaattttaatttcctccataattccacttgattaaattggtttaacttttatttaatttctagaaaatgcattattaaatgattttttttaatcccgaacgaaaatcggggcgttacagaaactgacaagctgtgatgccatattgtgctaactaggcaatgttctgtgctttttgtgtattttggcagactctaagccaactatgcctatctgtgaactttatataatttggcagactctaagccaactttgcctatttgtttagtttctgtaatttggcagactgcttgccaactatgctgtgatgtgtgcttgttctggcagactgtaagccagctaagctatgtggattgttatcatctaaattgagtaactttgctcaaatggtgtgtcataacctaatctgatatgagatggcatttactgagctgatctgatgttatgaactgactcttatcaatttgttatgctaaaattatgtgcaaagttaccaatactcagtcactgttcagccaaccactgcaaagtcagctcaaatatatgcaatgtcagtgtcattactgaatatcaatcacaattcagccaaccacaaatccattcacttaacttagatagtcaaagagcacagctcagtttcttggaaaaatacagcaaaatgcttttagctaccagcattttgacacatagattaacacattgcacctcacatctgaactgaaatcacatcaaacaacacaaacatgcatcccaacaacatcagtacaagccaaactctctgtttctctagcctactgttacttgctctcatagcagccatgttagcttcattctcagctgccacaagcctcaattgtgccacttcattcattgctacccctaattctaggcaccgctcttctacctttggcctcagttcttcaacacaacgttgcagctcattcttctcccttcttagcgataacacggcttcacgaagatcgttcaacagctccctcaaaaaactgcttgttgcgggctcataccagtcaaaaaaatcgcagccggcgccctgaaaacattacatcccaaatcacccaaccatactgccagctcaaacaaaaaaacaagcaagcaaacgaaatctgaatcactcacccgattgcggcatcggtagtaccgtcgaccagggttgtccacgctctaggaaatccaccgcaccgccttcgcaccacaccggcacatcaccgccagctgataatcatagggcccaactcgcgccgggatgggagcacgactgctgggatgcgacgaccccgacgaccggtcactgcaataactcgccatcacctagcctcacctcctcttgtcgcccccgccgccaccgccgcttccgccgccctaagctagggtttcagctcgagaagaggaaaatgtcgcgccaacgcctggaaacggcgaggacagagcctttaaccccgtctattaactccccaacggcggactgaccagtgggtcccacagcgcgacacgtcagcaaaaccgggcaaaaactgagtcaatactgccggtattctagtttagtgaccttaaaaaatctcggtgtcaatttgagggacctccggtgaacttattccgttcggtcggtcccaccaaaccgcctcacagtcacaacgtcta

SEQ ID NO: 61363 - DNA, 4843 bp, Oryza sativa
ctgaatttatcctcaatggaaggactcaaggagtacacagagagtgaaatggatacagcatttgtcaggctgttgtacaagatgacttaagcacaaagttgaagtaatgtagaaaattaatatggaacggattgatgatatatttctttgtgcacaagagaattattagtacgatgtgagagccatgaaagctgctggagatttcgtatgtggaagaaaaagaagggggtttcttcctcatcatcagctgcaatgcatgttcggcagcaagggattttgagagagtttgtttcgttttccacgtacacgctttccgaattactaaacgatgtgttttttttataaaaaatttatatacgaaagttgctttaaaaaatcatattaattcatttttaaagtttaaaatagttcatacttaattaattatgcgctaatagctcacctcgttttacatatcttatcaatcttctcttttccattttacaaatagagccctttacttgtatggatataccattttcaccacggaatccgaaacaaaccgccggccatggccatgggcgccgccgccgcatcgattcgcgacggagaacttccgcccggcgatcgtccacgccggcgagtcgatccacgagaaccttactcctcaaggcatccgaggcgatctcgtttccgtcccctcgcttcgcttggcggttaggtcttctgttcttcagatggtggaaaatcggaaggcaccacatccaccatgttgattccattccgcgatgtgcaattcgtgtgtattctctgatcacttctctgatttattttttaaaaaattgcaccggatattcactcggctaagtgctatcctactctgcagtgatcacgcgatgcctcgaaaataattctgaactttctgaattcgcaggaacatctcctatctgcaattaggcgtacacccaggaggagcagctgagcctgacagggtttacgattccgagatggccttccgtttcaggctctctggcagaatgacagttttcgcgaaatccggtggaaagccagtagattccgaacaaatttcataaaccaaaatttaaatacaaattccttgagtttaccaataagctcgcgaaaatcggccggctttgacgaaattctgagcgaaatcatcgaaatttcaatcagtaactagaaaaagagataaactgaaattgttttcctttttttaattcgttattcttttctttcctacttcaaatttcagtaaatacacggaatacatcaatttttttgaaaatttatatcccaatagattctatgaatatcatactatttataagattttatttgtttttttcctttttttatcaattcaaatttgaatttggatgaaactcatcgaaatcttagacaacttctactttcgagccccgtcgaaacatcaaaatttcacggaattcaaccgattttcgttggaatcgtaaaccctgagcctgagatctccactttttctgattgaatttgcagttgcctcagatcattgagatcaccatggatcgctcgctgcacgaaggcccatgacacggcgagccttccttgggctctgggcagcaaggcctgctcatctggtactgctcctatacatccttgtctctctctcttagctgcttgcatgtttagggcatgtttagatccctattaagttttttctccctatcacatcgaacatttgaacacatacatgaagtattaaatataggctacaaaaataactaattacacagatcacaactaatttgagatacgaaacttttaagtctaattgctccatgatttgataatgtgatgctacagtaaacatttactaatgatggattaattaggcttaataaattcgtctcgcaatttacagacggattctgtaatttattttgttattagaatacgtttaatacttcaaatatgtgtccatatatccgatgtgacacggcaaaaaattttacccctaaatctaaacaccgccttagtatagttcatcaccaagtcaccggaacatggaactatgccacgttccttggtcctaggaacgccgttcccgtttcgagaacgtgggaacaatctcgttcccccaccccacgttaaaacataaaaaatgtagcgtcccgcgttcctcgatctcgttccttgtcccatcgatacgggaacttttgtgacgtaggtacattgtcatttcaaatattttctacaccattgcaattgcattccacttgcagaaggtaatcgaactgatagtcttttataaccttatttttacaagaaaagtctcattaccaacttttttttggggggtaagattttgtgtatgagagcaatgagaagttgattgtcctacatgggtcagcagatctacttttgtaccgaacggtcggttttgttatagatcctcttctttttacccatccacatcgaatgcatccattttttttgatcggtttctgcggtccatggctctagaatagttgaattgattgatcgaaatttggcatctgttaatagaataccgatgcaataagaatcattaacctaggaaaataccagtgcagattgctgccttttttgtctttcaaaaaggtttgaatttcgtgtgatccacaacttccaatgattttgtgtgctgctattaatttatcagcattgacgcgaaaaaaagtcgctcgataaattatgccatattttattcagtaggtcttcagtttcgattgagccatagtataatgcaatacaccaaatgcaaattcaacagatattttgcccccaaaatccctcttggcgcctctctgattaatttaagaggttcaatgatttatatgctttcccaagtccacaagcaaactgcacacggccccatacaaaactaacggtacccggagaatgaatgagctgcagaagaagaatgcatcaaagaatcactggaacatgtcaggctaattgccgggttaatgctggcttttgttttgggttctttcctgttctctcacgctaaccccagctggtaacagtcccggattgctgcgtcctaatcatgcaggtcacgtccttgattttggtttattttacgaggacgtgacaccatggcggtgcctgccaaaaaagcctccacttcgctgcactgctgctgttgactagcactagaaaaacaattttgctgtctgaaaactgcagaggagttgagcatgcgcatgttctgtacagtcatcatgtcgtaagagcttctagtaatctcatcgctctctttctaggagttcttggagtattgttttcttaggaggttttttttgttcttattatgctaaccatttctgcaagttagtctttcgctctttcagagatactatgcatttgcattatgcctctgcttctaacagtcgccatcaggttgatagctgaatttttgcttatgctactggggcctcccacctgaaatggtacgtttcaggcaatgagatttgatatgtacattagtatgagctaactctgattaaaatattaaactaacactgtttgaagaatcaaggcactttgaaacgagatgaagcattggattcggatggtagagggttcaagcatggtaggaagtagtataggatgtactaagattaaagagtgggtgttgtgttaggtctggggtctatacatggccacataggtagcgtgccctccttttccatgtttgttcaacatgagcatatttgcaattactagtagacagctgacaaatggacctgaaaaaactgagaaacttagctggttattctctcacttgtgtgactaaatggcttttatattgatcaattatactatgatatggacaacctgttgtactaattgaaatatatatttctaccaaagtgttggttatatagtcaaatttaacaacccttcctgatgtcagagctttgtcaagactggtcataacattggttcaaatgtatttggttttcccaatatgtttcttttgcattggtgatttgtgaagccttaagataggtgcattgtctggaacctaatcccagttcgtacaaaaaagtgattagccatttctagattaatagtgcgcttttgacatcaccgaccgaaaacgaggttagttaatagatgacagatttctgcaacagtagattgcttggtcctacagcagttgctgttcccttgttaattaacttatcaggactgttaactgtgtactaactgcatgcttcaggcgccatttgccatctccttgtgtgttgacaactccaaatctgacagctcctgaggttgatgtaagctgatcttttatcaacgcaattcaggagcatggatttcaatagcttggttcttacgagttgttcatgtgagcatatcactgtgtcagtgcttagtccccttccaggcacgtacaaatgtcaggggagaaaagttgcataatcatttatccgcagtaggaataactctcctctgcatttctgaaaaatgttatcagtactcgctgacatgtctgttatcatgagttgttcctccctttctttttattctttcaggagaaaagcctgagctgaagcagttctcatcatagttttcagcttggagtactcatcttcctttttgacctccgaggagaatgaaattatgcacaataactcaattttcagcttatccatctccatttaaacatgtctctctctttgccttgccagaagcattaaaatcatattactgttctttaacatttcagggcattgttcatgaacaatcatatggtcgtgcatacagtattggctacagttttacagctcagtttctcgacaatgtcagg

SEQ ID NO: 61364 - DNA, 69556 bp, Oryza sativa
  unsure (1)..(69556): unsure at all n locations
tcagaatttatattttttttcaaaatttaattaataccgtatattgttctttcaattttttttttgaatttcagttgtttcaaaatctacttgtgctctcttttaatttttctaaatttggatattattatattattttattctaaattttaattaatatcgtattgggttcttatatggattcttctttcaatattgcttatttttaattccgaattttagttgattttaaattgtattcctacttgaactcttattttatttttgctaattttggattttatttttatttttattccgaatattaactaatctcgtattgggttcttatatggacgcttctgtcaatattccttatttttaattctgaatttcaattatttttaaattatattcctacttggactctccttttattttctaatttcggattttattttatttttattcataattttgattaatctcgtattggattcttatatgaactcttctttcaatatttcttatttttaattctaaatttcagctatttttaaattgtatttctacttggactctccttttctttttctccgattaatgtgagaatttctagcccccacggtgaacgtggtgcctccttttaaagctgttttaataatataatagattccctaattataattgcggaaatgatgcctaccgggcgcctggcgggggtgaagcagatcgggcgctccccctgttggcggatgttaaatgaccgattctatactgccaacatatgcataaagtttagataataaaacatccaacatagtgataggtgcttaatctcacatattccacaagtgttggtgtatagttgtatgcagatgataaaccctgaagttgggaggcaaatcggactaaagtgaggaaaattatgtatccatacaaggaggggttgtgaacttcatcgaaacatccgtaattcaacccaaaactccgagaaatggatggaggaaggtctagggagtctaccgaccgaaggccaggccagatgggcctggttcggccgaaccaccacttccaccgttggatgtggggtttggcgtggacgtcccagatgcatccctgatgacggttggagggcacttcggacatttccccttcgccaaccatcatacctacctctatataaaggcttcacttcctcatttcatacacacacttccaagcttgagctgaattataagaggctttattgtactatattgtatactagaataggaagagagtagaatagaaggagtcggaagaattccggagttgtcggtaatcttctcctatttcttttattctgtttattactctgaattcaatataatattcttcttgagtaatttagatttatcttgtgagaattatctcttggttagttcctaaatagcatacagaattattgttcgctataatcaactaaaatatagtgattgctttggtgagttataaacactaaattaaatattaattgcttaaacgtggtgattaggtaattattatccagtaattgctacgtatcccacagtacgtttgaggtgggtgtagaggtggtgacagccctcgagatcacttaagtcctccctgtccggatatgtagtagagcaacatctgagaacagcgggttgccagtgcctgaagtattgtgttaggattaaagttaagctttccctagacactgtttcttacttgtaaatcctctctatcctggtctatcctttgcttggtgtccttggatgaatcggaggaagatctgatcacacacgttcccttggattcgatacccttgaaatactccgtaggggaagtgctacatcggtatatccgtacgcttgcggattttatttgtgaccgtattaaataccaaccccctccccccgcgcgcccggccaccacgagcgtgatgcaggtgcctggccccaccacgttctctgcccccacctaccatgtgtctccatcacatactccattgcaacaaataacccatattttttgaaaaccctctattaaggaaattcgtttcattttttgtttcactaaaaatatttcacctagtatactcataatgtttcactatatatagatctatatatagatctaatgtagtagtgaatgatccttttaaaacaaatccctagtagaaaaagccggacaggtcatcgaaccatctggacgtctgggtcacaggtcgagcggttggaccaccgggtcaaccagttcaagtgcaagtgaaaaaccattatttactccatgtattcctttcaaatactatatatgtgttgctctattggctagcaaagtgtgcgatctccccagagacccacgttcgaatcccgggccacaaattactggtttgaaacattgttttatataaggtgaaacaacactcgattggtgtttaaacgattgaacattgttttatataaggtgtttaaacgattgaacattgtttgattgaacattgttttatataaggtgtttaaacgattgaacattgttttatataaggtgaaacaacacccgatttaaacgattgaaacattacgattgaaacattttcgatctacttactgaaacaattccgatatacttggtggagcatcgtgcaacatttttaaaaaaatcaataataagctaaaagaaattttcgtaatgtttcgatctacttagtgaaacaattccgatataattggtggagcatcatgcaacattttaaaaaaaaatcaataataagctaaaagaaattttcgtcccgatttaaacgattgaaacattacgattaaaacattttcgatctacttaatgaaacaattccgatatacttggtggagtatagtgcaacatttttaaaaaaatcaataataagctaaaagaaattttcgtcggaatatatccatgtgtggtcctttttttaagatttaattgcaacgaatttaatggtataatcggatcataatttggataaataatttaagagaaaaattagtttaaagtagttttgcacatatacatggcgctaacatcatgtcccagaggcccagaacctggcgaatcttaaaacgaagaaatattaaagtgtgtgatagtgtagcagccgacggcgatggttcctcctgcgagaccaatctcggtattgatccttctcgaacatgttttctttaaaagacatttaaggacatgtttgtagcagcttgtgattgtaggagtagtagtatcttcatcatttagggaaagtgtttttcatcctatcgagcaaataccccctcgttttttacatgttatctaattcttcataattttcttataaaactaaacaagatagattaatattaaatatatcactacacaaatatgcaaattcaaatttaacttcaacaggttataacaaaaataacacatataattgtaaatatatgttaattattttcatttttatttgttttttttaacttgtagaggtgaaatttaggtttgcatgtttgtggagtaatatactttaaagtaaatttcacaatactacatatatcacaaaactacatatttacgaaagtgtatcacaaaactagagatttaaaattatattttccacaaaaactacatatttaaaatatgatatcagaaaactacatatttaacatcaatttcatcacaaaactacaacttttataacctcaatatggcaatgaatggcaatgaatataatatttgataacttcgttactaaatctgtagttttgtgatatatatttttaaatctatagttttgtgatagtttggtcagagtatatgtagttttgtgaaatttactctatattttatattaatctatgttgtcaatattttcctaaaaaaattatgactatttaggtggtatgcaagaatgagagaatgtctccttgagggatggaaagccatctccctgtcatatatgattctcaccatctatttcatatatgcaggtaattttcagggcaacgcactggctccggttttgggcacagttacaaaggtgtgaggatgatggggagtcctaaaggttgcatgccgcaagttggagtcgatggttatgcaactatttgccaattatagatggaggttcacaaatagacttcaataaatgtgttctccttattttggcttggtttcttctgtttttgtttggtgtatcctatttagctaaactacgctcttttctggattgctacaatgtaataattggctgtagctctttttgagcaaaggctgggatgataaattccattatctaaaaaaaatatatgattctcaggaatttaactttgtgtcactaaaaagaggtgattttctgaggagaatttaacttttttttcgaggggaaaggaaggagccctgccaattgcaattaaggaaaatttatctatcttttgattaattttgagcatcatctctgcagatgaacaagataggattttaatggtgttgtcgagggcttggtatctccggcatgatatagtgcagtgccgcggtggagagggatctggtggagaagggggcggcggcggaggggtggcggtggagcttgaagcgcctggcacagcagtggtctgcgtggggcggcggagggaacaacagcgctcggcggagacaggtggtggcggtggcacagagacggtcgaggagagatcgggggcgacgcggaggaggactagagggagttgcgaggaatggtggcgcatagttggtcatcgaggcggagatcgtgggcggctgtcggtcatcgaggcagagatcgtgggtggcgcggacggcatggaggagggcgaggggagcggcgaaagatgggaggggatcaacgaggcgggcgtcggtgtcctggggacgtggttcgatgggggagtcacctccctggcggtggcggcagctgagagggtagaggagaacggcggcggtggagaatcgggtgtggagcggaagggtcgggagcggtggaggatgaggtgaggactgaggagggaggagcagcgcggtggggaggggcgatccaatcttgtgtcaggttggagtcaccgtcattgattggagagggcggcggcgatcatgggtctggagaggaggccggcgggcgtggctggtgaggaggcaacgcggcggcggggtgaggaggcgacgcagggaggagagcgaaagacgcggtgtggaggaaggaggagtgggcgttgggaggagatctatccgtgacgtgatggttgagattacgcgtgtttgtcagatgcgtctgctgtgtcaggaatcaagatcaccactacggattttttaagcactagagatataaaacggtattaggagtctagtagtagctacgatcatgaaccagcaacgcgtccatcatttcgtatacttcctccgtttctaaatatttgacgcctcttgcttttttaaatatgttggaccgttcgtcttattaaaaaaagtaattattaattcttttttatcattgttaaatatacttatatgtatacatatagttttacatatttcacaaaaatgtttttaataagatgaacggtcaaacatgtgctaaaaagtcaacgatgttaataaatatttaaaaatggagggagtacaatttttcacgtgcctaccgacaaccatatatatagcgcgtgcgcacagactgcacgtactagacaatcaagcaaccatatatatgcaacaagtaattatacggtgcagcacctaagaggcattggccggagaggaggaagacgtacgacatcagcaaagatcaagaggaagatgcactactacaaagaagagccaaatcggttttcctatgcggttggccagcccgtatgggaggaaaggtctgcgaaaatcgctattttcccatgtggctagagcacccgccatgcgaaaatgtgatttttgcatgcggttccctgagccaaccgcatgcaaagatatttttggcaaaaaaaaaataaaaatccaaaaaaaggcgaaaccctagccggtcgccggccgccgcccacgctggatccgcgccaccgcggccggccgccggacgagccagatccacgccattgcagggcccgacaccagatccgccgccgccaccgctttgccgctcccgagccagccatcgccgctctcgccgtcgctcgcctcggctggatccacaagtcccggcctctcccgagcgagccgccaccgctctcgccgttgccgtcgccgtcgacgtcggcgtggtcaaccgcggtggcgagggaggaggcgtggacgcccgcggcagcgagggcagaggagagttcgcccgcagcgtcgtctgcggcggcgaggtcgttccggcagttagggaggatgtgtggacgcccgcgacagcgtccgctcccgctcccggaggccgtggcggtggcgggcgcccgctcccagcgcctcgtcatcagccgtgcctcccgctgcccggcgctgcctgcatgcgcgagagaaagagagagggagaggttgaggagagaatgagagagagatagagttgaaggaagagaggggaaaatattcgtggtgggagagaagagaggagaagattgaaaaattttaaggtggcgagtagggaaaaaaccactaaatgaatttcgaataaaattttatgatagtaaatgaactcatatgaaaaagttaccaaaaacaaagttgtagaactcgttgagatctaccaattttattttggtcatttctccatccgagtttgattgaactatataaaatttgagatttaaaaatataagcaattcaaataattttttgggtagtaaatgatttcaaatggaaaagttgtcaacaacaaagttgtataacttatcaagatctataacttttgttgtttttatttttctatatgactttgtttgaacaatctgaattataatttcaaattatgacaacttcaaacaatatttttaaatactaaatgatttcaactgaaaaagtcatcaataacaaagttgtataactcatcaatatatataacttctattttggtcatttcttcatcccacaaagtgatttgtaaaattgttcacaaaatgtacatatctntaatatagttttataaactgtaaattttgtgaaaatgttactatcactttgttggatgaagaaatgaccaaaatagaagttataaatcttgatgagttatactttttcagctgaaatcatttactgcttcataatattatttgaagttttaaaattcaaatttttaattgataaaacaaagtcacaacaagaaatggccaaaataataacagtaaaaacacaataatgtgatagagcatgattttagaaacatttatgaaaaaagaatcatccaatttagagttcatatgagtaagatacactagttttaaatttttccaaattttattttcgtatacagctccttaagacgcccgtatgtaaaaatcgatttttccatgcgggtgcttaagtgagccgcatgcaaaaatgaggtcatttttacatgcggacctcttaagagtcccgtatgagaaaatcgatttttccgtacgggcgcattaaggagccgtctgtgaaaataccgctcgatttttacagacgtcactagtcatggtccgtttataaaaattatagggtctcgtatagaaaaatcacttttgtagtagtgatggcagttcagctaagaagcacgatgatatacaatggagtttctagaattatagtggattcactttgtttgcatcgttcacatactatgctctattgactattatcatacacaaaggagaaatagagaatgtcaacccacgttacaaattgggtagtatattagtaatttactatgctttacatataaaacagcactagtagtagctacgatcgatcgagaaccagcaacgcgcccatcgttttgtatagtctgatgcacaaattttcacgtggccagcaacgaccatatatatagcgcgtgggcacagactgcatgtacgaggcactcaagcgaccatatgcgatcgaagatcgaggaaagaggcattgaccggagaggaggaagacgagagcaataaagatcaagaggaagacgatggcagtagcatccttgccaccttcctccaatggaagaatggtagagccggccgggacgatggtgcagtggtgggaagaatggcagctgcgcgtgctcgttctcaccagcctcttcctccagtgcttcctcttcttctcggccaccttccgcaagcaccggatcccggcgatcctcagggcatccatctggctggcctacctcggcagcgacgccgtggcgatctacggcctcgccgccatcttcagccgacacgggaagaacgccggcgacgacggcggccgcggggaatcttccatgctggaggtgctgtgggcgcccgtcttcctgatccacctcgccggggcgcaggacagcataaccgcgtacgacgccgccgaggacaacgcgctgtgggcgcggcgcgcggtggccatgtcgtcccaggccgcggtggccgtctacgtgttctgcaggtcatggtccggcgggaaggtgccggcgcgctgcccggtggcgctgttcgtcaccgggttcctcaagatgggtctcatgctctgggctctgcggcgagccagcgctacgaggatagcaaccgtcggccggaaggcggcggcggtagaggccaactggtcgttagagagatacctgcagtgggcgagtaaatccgccatcgaagccaccaggaacattcagacgaacgacgacggcgacggcggcggcggcgagaatcgttcggcggctcgccgccatcgtagcgccaccagtgagctgcagctggacctcatagatctcgagtatcagaacgacctcatggagctcttcattgatttcccaaatacctacactagccggcttagctacctctcgttgttcttgaagctcgaaccctacgatgcatactgccggctttgcgacctcgtggattatgcgttccagatcttctacaccagcagaaacgccgcctaccccttcgccatctggttcgtattcctgcggttcatctttttcatgctggcctccacggccatcggaggctttgacgggcttgacagcaacatagacgggctcgacgccaacgatgtcaaggtaacctacatccttctatactctgaattcgtagtggaattcagtaacatgatttcgctgcgctaccataagtggccggtgtgcaagctagaaccacaaataaagcacactatcgcgcagttcagcctcatcggctgcgcttcccacagccgatggccaagggaaatggattctaatctctcgagaagatatcctctcattcatacgtgtcaaacagtgttgagtagagtagccatgtttttgagatgcaacaaccagcactactggtatcatgttgagcatagttcgtcgactgaaaaagccgtagatctcatccgcgaggacctgagatctgggtgggtggaggatgatctgcgcagcgccgccgcctaccggagattcaatgaccggcgaggccagtggactctccggcgggagcagtgctacggagagatgggatggagcgtggccaagctaccgttcgacgaggctgtcctcatctggcacatcgccacggacatatgcctccattgcacggaagacatcgacatctcatcgtcaccggctgccagcgccgacgaggtcaccgccgtgatggagatatccaactacatgatgtacctgctggcgtaccagccagacatgctgatgctcggcaccagacaaagcctgttcatggcggcccaccatgagatcgtgcacgccttgagacaccaggggcggcatcagcaacagcccagcgagagagaccttgcgcgatgcctcgccggcggcgacgacgacgagtactccaccccggccacggaggagcaagccggagctggcagcaggcttctcgagaggagaggaggaggaggccgccatctagcgcacgcacggcggctcgccggcgcgatgatgaagctggatgccggcaagaggctgagggtgatcggcggggtgtgggtggagatgatatgctactccgcgagcagatgcagcgggtctctacacttgaagagcttgggtgtcagcggccaggagttcctcaccgtcgtttggctcctgcttcaccggatgggcatggaggtgttggccgacaagctccacagaccagagctcgccggagacgatccggatgctgttggtgtgtaacctaccgtacctgttcttggccatgttcttaatcatttgcaggaacagcttttctcagtacggatgatgcaacaattgctgacactatcaaaacaagaaacttagatttggagccaggccattggagtgtgaagcctacatggagccaaatttgcacaagagttccagaaagtcttttgcaggtcaattggatatttggattccgagaggagataaataaattagcagacagactagcagaagaagcaaaatctaatcgaccctcttccactgtttatgtctgtcaaagcatttctcacctggcttatcccaatacaggatgtcatgcaaataacattagagacaatttcaacctcacgaactttgtaattcagcatgttctatgcttttgagtggtaataaagtgtttaagttcaaaaaaaaaaaaaacgtacctgggccccgtgggtatacacccgggagatgggttctaatctcctgttgttacgtccacccgtttctctcgtatactaactaaactagctgggtggcccgcacaattgcgtggctagcaaccaaacaatatttttcagtatgattttacttaaaatttattaaatagttatctcattgtattaagactttgaaagaccaaacattatcatccccgtatttctaattatataatttttaaaagtcacaccagctgctaccccttacttcaatcatatccttttttacttgcttactcgatctaccactatttttattcattctctttgaaacctttaaaaattggatcttagtttttagaggttattgtctcactgggtttcgtttttataatttctaaagtcccgccaaacgctgtcattatacttctctacggcctgtccactgtcttttctctttattattattgggattttaaaaatcgaacataactatcatttgagttcattttttattttctaaaagtcccaccaaactttcagcggctttgccattgtactcctttatggctcgcctgttgtctcccttttttattgtcattgagattttaaaattgaacatgattatcattagttttttttttactttttagaagttctgaaccttaattggaccttgtagtttttagagtttattgtcttgttaggttttaacttttagaagtcccgtcaaacgatgccagtatactcctctatggcccatccgctacctactctttattgtcattgggattccacaaatcgaacataactatagttggaattcatttttttattttctagaggtcccgctaaccatcggctgctctgcaactatactcttatacatcccgcccgctgcttctcctttttattgttattgagattttaaaaaccgaataagattataatggggtttatttttttactttctagaagtcccggcaatcgccttgctcgtttacttcacggcctgcctgtcgtccctccttttaatcgtcattaggattctatttggtgttttattaacaatttttatatgtagtatcaaccgctaccactctatttctttataggcatgttacttaatttatctcgttatgtgttttagatggtcttttctttcaatagtctttattttttatcaccaattttagttatttataaatttattcctaattaaaatattttttctttttataatttcagaatttatttttaaaaaatcttttttcttttaatatttttatatttttatttttgaatttcaggtgtttcaaaattatattcctactttgaactctcttttagttttctaattttggatattattttattttttattctgaattttaattaatcttgtattgggttcttatatggattcttctttcaatatttcttatttttaattccgaatttcagttaattttaaactgtttcctacttgaactcttcttttcttttttgctgatttcagattttatttttatttttattccgaatattaattaatctcgtattgggtttttatacggattcttctctcaatattctttatttttaatttcgaatttcagttgttttaaattgtattcctagttggactctcctattcttttctaatttcagattttattttatttttattctagattttgattaatctcgtattaggttcttatacggactcttctttccatattgcttatttttaatttcgaatttcagctatttttaaactgtatttctatttggactctccttttctttttctccgattaatgtgggaatttctagcccccacagcgaacgtggtgcctcctttcaaagctgttttaataatataatagataattatgaaaaaaattaaaaaaataacaagatagattaatatgtaatatatcactctacaaatatacaaattcaaattcgacatctacaggttgtaacaaaataacatattaaactctagctatatatatatatatatatatatatatatatatatatatatatatatatatatatatatatatatatatataactactatatggcgctacaggcaccacgtattagatggcgcctgacacaatcaacccccctccccacgcccacacattcaatttaaatagaccacgtagttaatttttaactcaacgacccaccaccccgccacccccacacgaactcgatctggtgcaagctacacagttaactgttaactcaaccacccaccccacacgcaagttaaattttaactctgcgacccacaacccaacccgtcccccacgcgcactcgatctggtgcataccacacagttaaattttaactcagctacccaccccacgcgcactcgatctgatgcataccacactgttaaattttaactcgacatactgactctatctggtgtgtgtgtgtgtgtatatatatatatattacggattcccatcatagaaaccgtccacccactctttctcttcctctccacattttacggatcagcgatgacttgtgattccttgtgcagagaggaggaacggcgacggcgattaggggatgaggagtggcagcgaggtggttccggtgatggcttggtgacgaggaggagcagcggtggtggttgggggatgagaggagtgacgaggaggaggagcggcggatccagtggtgccggggtgcgaggacgggcgcgatgttggcatgtgcggcgtcgacgggtgactgtgggcgggaggcgatgcggcggcggatttggccaccactctgcgccccatgcgcgcggatccggctacggcggcacggatccggcgcggttgtgggctgcgcgtccacagatccagcgcccccttcctcccgtgtggacctgcaagggtgaagactatgggcaagaggcgagacggcagcgaccattgcggcggtgagcttgtcctccggcatccatggagcagtggcgggcatccatggagacggaggcaccgagcatgcctctctccgagttttccattttcatcttcttcaccggtggaagaagcggccaccgcccgttgtttccgttctcaatatggaaaccaccaagagccacctttttcattcgacggatccagaaggagaagaaagctgccaggatcaacaacaccatcaatcaattatttttcctgattttagttggacgttgtcctgttatttgatctctccgatgtgttattgcattatttgtgtgtaattagtttctaatacatgtgattcctatatgattagatgcatccggacatcttgcaaaaaataaaaatgcaatctccatatcagtatattgacaattaaaaaattactatatgtaatgtttggagtaaaatatttactatatgtaatttgtcggtaaaagtaactaaatgatgtacgagaattgaatctgaccatacctaaaagaaacagaaattccattccctgtggagagaaaactaaatttaggtgtacaagcattattttcggatctaggactctgttcattatccacaacaacaggatgtatcgcatgaaaaaaaatccgcttattccggggcctcctctaaaagcttatcaaattaacgccaaatcaatgcacgctaggatttcgtagtttctggaccggcggatccggcgacatggagttgatttctatccggtgaattaattatcagttaatttccatcgacgtaattttctggggagatgtgcatcaaaacaataaaattctaataataaagtttgtattacgtcacacatcgccaccaccgcctaatgtctcaaagtttttcatctactcataccagtttacgataaattaaaatttaactcgcattccttgtcatgagaaacaacacacatccataaaaaaaagaatctacaaaatagttatttttcatcagcgatcatcgtctaccagtaaatttttaatttttaactacataaccaccaacccgtaatttaagttaatggcgactcattcatatagctgaaacataggtaaaattttaactcgacaacgaaatcactgcagcgcatcactcaacatagtattagttaaaatttaacttcgcattcagctttgtttggtccggtgggcgagggttcgttgcttcacgttgcgcaacgtttttcacaagttatttttttaactccacagtctgttggtttggtttggtgggcagtcttttctcgttgtgagtggcgtcatatatttccatggcacgcagcgcttgtgtgtggcgctacgtagcaatatatatatatatatatatatatatatatatatatatatatatatatatataggtaaattaactggtgctacatggaggggctccaataaaatccaccgtatacgtgctttgagatccgtgctactcaaatcagagtattatagacatactaacgggttaaacccgattagacctcttcatgcatggcgtgattgcctttccataatactctggccgtgtttccatataagatctttgcatgcatgcactaatttcctttccatataagcaaacatgtatgcaataatttccttttgattgcatggtaatttatttctatatgactgagtactttccttttagcacctgctcacaccgtttctctatcatgttgaattgatttatttctatgtatatggttttcactttccatttttctatgtatataagaccagctgatggtttgttgccggcctcgtgcttcattgttacctacgccgttatgccgctggtcgtcgactcgtccgcgaggttcgtcgccgttcatccgtgaggctcgtcgtctccaagttgtgtcggttcgatcgacagcacctattgcaggtatatatatatccagcggccaatcacagtgacgagtagcctgcattgcatgcatgttttagagcactaggtagatctggattagtatatgagaaaatatgttattatagcaggcaataatagtacatgtattttcactttgcaggatgctggggctccataatataatgcgtgtgtgcatggagaattggagaattgcagatgaatgaccatgatcgataatcacgatgatgctcttccatctatcaattttatttttttgtgtgtatatactcaatatgtgtactgtgtatatactcaatgtgagtatatactcactctgtataaatcatgatgttttcttgtactcaatatgcatgtgtgtgtgagtatactcaacgtgagcatatactcactcaaagtgtctgtatacatcgaatgttttactcaatatgcatgtgtatatactcatgcatgtgtgtgtatttagcatgcttgtgtatatactcattacatctgtataattaatatgcgtgtttatatactcaatatgtgtgtatgtcatctaattacatctggtcagctacctagctagagtagaaaaaaattaatataaggcctagctagtttcaaattcagttcaagaaaaaaaagtaagcttcttgaaatcaattattttcacggcatttaggtaggtatgtacccaacgagaagtaggtatttttccaagatatgcattttaaatgggtatatatatacacatcgtaatagtatgtgtgtttaaaacggtatatacccaaatatcttgtatatacagactttttttttacaataaataatagatttgtcaagtgtccagcatatattcaatcaatcgattaggcattatgtacatctatacctaagtttatatcactaactgaatacataatatatgacatatttgttcatgtcgatcttagacttccttcctttcatactcacagaaatggtatattggttcatgggatttttttccctttcatacccaatttttgagtatatgtcaagctgtgtatcttaaacatggaaagtgatccgcagtgcatattttgttactcaaatagctaaattaatggcgtcatgaatggaatgatttcgtacagctacattaccatataaatgtgctgcgatatatagtatccatgtttccaaatatatttccaattaattagcttccatgtttccaaatacttagtttccatttttcaccactatattaccatttattcaaacctcaccgtgcaatcatgtaagtttccatatttacaagatattatttccaatttcgcaggcatttaatgtttccatttttgaaatatacacgcaattatggaaattctctcatccacactgcatgcatgcatataaatgcattaattcctttttcaatctattcaaatatatgaaatccattcgctattaaatcctacactctaaacgggtctatacccattaagttcatacactcaaatgatcaaaccgatcagcaaaatatatatatatatatatatatatatatatatatatatatatatatatatatatatatatatatatatatatatatataatataaatattcgtatttttccggtcaacacatataatgtgcgtgagatttacacacatacaaaatgcgagtgggctagcaatagcgataaaaaaagtgcaaaaaaaaaaaaaagtggggggccgccgacgccaccagggagggagcctccgctaccggatccgtcaggggtggcggcgaccgcaggcggatccgacagcggcggctctacccgcggacgccgtcgatgccgccgctccccgccatcgccaccgcacctcgccgtcgcccgcgccgtgccggtgagacgggagggagagggggagagggagcagtccgccgtcaccgccgcacccgtcgtcgccgtcgacgctgccgtaaggacggccgtcgccgagggagcgtggacgccgatgatgccaccgcaccccgccgtcacccgcgtcgtgccagtgagacgggagggagagggggagagggagcagtccgccgtcgccgccgtcacccgtgccgtgccggtgagacggaagggagagggggagagggagcggcgccgccggaggggagaggagtggaagcggcgccggtggggagagggggaggggaagaggcgacgtagggagcgggggaggcggccgccggaggggagcgggaaaggcggcgtcgggggcgggggaggcggccggctcggctgtgggggaggggaagcggcggctgtggggtgaggggcagggggagaggcggctttaggggcgggggaggcggccggctcggctgggtggaggaggagggggagggggagggttagggttttcatcactttggaactaatctgagccgtccatcaaaacgaacggctcagatcgatcgagcgttgggccgccccacttgggccgaaagcggctcggcagtccaggaagattgaggaagagtatagggatccaaattagactttggtcgcggacgatggctgaagaagaaagtgggctgaaataggcctatagagataaaattatttttatttaaataaattctaaaatgatgtttgtattatcagaattagcaattaagctacgtaaattccaagaaaatttcaatgaatgtaattaataatatagaaaatttaataaaaaattaaatctaaccataacattttatttctcacacttactttacttataaattaatttaattatatatctaactacttaaaaaatacccaaatatttccaaccataacattttatttctcacacttactttacttataaattaatttaattatatacctacctacttaaaaaatacccaaatatttcaaaaaatttgtatttcatttaattagaatttaatatgttttaattcaattttatcttttttttctttccgttgcaacgctcgaccacttttgctataatttcaaagagtgtaattaatattgcagaaaatttatatttcattaaattagaatttaatatgttttaattcaattttcttgttttttctttcgtgatgcgagctaagcaggaatatttttatccatcttgattatcattagcgcaatgaataatttacctatcttagaacattattttatacatgttaatggtgtactttattgaatttaaccgttcctttacccgtagcgaagcacgggcattttgcgtgtgtgtgtatatatatgtatgtgtgtgtgtatatatatatatatatatatatatatatacacgcaaattaactggtgctatatggagtatgggctccaagattcaaattgagtatatactcaatttgaatgagtatgaaaattttttaaatgtttagatatgaacattaacttctttactaacaagttcaaacttgtttgaactgagtttaaactttttttttgttagattttggttctaggtatataatatccaaacatataatttattaggtatgtaataatgaattgtgaaataaagttgagtttaagttgttttgttgttaggtatttgtatgaatcaaattcatatacctaggtatatactcacaatttgaaaatttttaaaaatttgagagaatttgtgtgttttataccttagagcccgggcaccatgtgtgtgtatatatatatacatacatacatacatatacatatgtatgtattacacacacaatcaaaattgttatttttgttataaattttagaagttgaatttaaacttatatgtttgtggagtgatttattatatattaatctatcttatcaattttttgaattttttttataacaatttagttcacatgcaaaaaaacaggtggacgtccacccgactacttaaaagagtttcccaagaaacaaaaaggagaggcagcggatgggtcatacaggagtacaatggcaagccgccgatggttggtgggacttctagaaagtaaaaaatgaattccaacgatatttatgtttggtttttagaatcccaatgataataagggtaggcggcgggcgggtcgtagaatagtataatggtagcgtttgacgggatttctaaaaattataaaaaatgaaatcaaacgagatagtaaattataaaaactataaggtccaattttaagaggttagggcttctaaaaagtaaaaaaaaacaatgataaacatgtttgattttaaaatcttaatgacaataaaaaagggaagcagcgggcaaaccgtattggagtagagtgacttttgtcgctgacgttttggctgaacttctagaaagtaaaaaaaataaacttaaacgataattatgttcgatttttaaaatatcaatgacaataaagagaagagtcagtggatggaccgtagaggagtacaatggcagcatttgacgggacttctagaaaattataaaaacaaaacgtcaaaacccaatgggacaataaactctaaaaactataagacccaattttaaaaggtttcaaagaaaatgaataaaaagagtgatagatcgagcaagctaataaagaaggatatcacagaagtaacgggtagcaactggtgtaacttttaaaaattataaaattagaaacacgggaatgataaggtttggtctttcaaagtcttaatacaacgagataattatttattaaattttaagtaaaatcatacaaaaatatataattttgtataggtgctagccgcgcaattgcgcaggccatacaactagttatatattaatctatcttatcaattttttgattttttttctataacaaattagttcacatgaaaaaaacaggtggacgtccacctgactgcttaaaagagtttcctaggaaacgggtgttgtgtcaatatcctttctgatttaaatccaatgatgctgccactgcagttgaaccggatcatgcttgcgccaccaacagaatagatttgggaaactctattcatcccttaaaatggatgtcccctcattttttatgtcgcttaaaaaagtcactaaaaattttcataagatagatcaatatgtgatatattactttacaagcatgcatatttaaattcaacttatataagtaaaaacaaaaataaaaaatttggctatgaatagaacgtgtaatatatcatatattaatttatcttgattttttttaaaaaaatataactatttttaaaaatatcatgcattaaacgagaggatgtctgccgaacagtataacaatcggtcccaacccacattacctgtctgccaaacagcgaaataattgggatctaactactgggaaactattggagactagtaaccgtgcacgtgcaaggcacgtctttatttcccacattcactactcagaagtctaaacactgttatttgggaatatcaatttttaatgcaattttatataaaaaaaacttgttacacctaagaacttgaactgaatttaagcaaaataaagaggtttaatatggtaatttatgggaaaaaaataatgttcagtacttgaaacttttgtttaatttttcggaaacatttaaatgcaagcatcatcatacctcagttgcaaatgcattgccataatgcagatggtagctcaccaaaggatcaaggaaagtcgatatggtgagacaaatcaatcacaatatagggctcagaggcaccactatggaacacatgaaacaaaaataacaacgaccgtagtgattatatatgagcttgcacacataaaatgcatcatacctacaagaaacagagcttcataagatattttgcatggaactgcaagattcagaaatgcaagggtcatctatagaaaaatatcaaaaaagaattccttacaaactcaaatatgtacattcccttgcaatatcacattttcatgcgatcttcaaaaaattctcaattgactggaatagtactacctggatcaacagaagccgttgctgccgttcggtaaaggagaatcaaattgatttttcaggagagattagagggtgaggacccaactacaatctgagtcattagatcaaataatggaagcaacgttcaatattcagtgcaaccagactgaatatatcaaaaatgttactccggaatgaatatgatctgtgagaataaaagaaattatgaggtactttgaaggtttgatgattctcatcaaccttttagaggatccatcaatttataatgaaggtttaccgcccaaaacatggaatatttcatagtctagaatctaattcaacaaaatatgaactatgtataaatttaattaccgagcagtggcatcataacaggtaattgcaacaactaaacataataattccattaaaatgatgaatatggcacgtaagtgcaacaactaaacataactactattctacaaagggtctataacaatgcatgctaacctctactgattaaacaaaagaatttaaccacaagcacccccattatttgcaacagagaatactggaataagtaggtgtgcatttgtacctcagattaagagcattgctgatctgctgatcttcactaaaatgaatttgtcacaaatcatattctttaaatacctctcaattgctgtcaacaacttaacatcagaattcagaagtaggttgtcttgaatacatatctgcacatattcatgatggaacagactggagttgcaaaataaaaaaatagagttttcattagaattggctatctaatagaaacgtaagataaaaacaatcatgcaatgcttgactttatattgttcagatatatctaggatgctttatatataccacattgcattcaagaaaaatggaagaagagatggtccatgaaaatgttacacttacacatatgatgtattgttcagtaactctctgtacggagcaaatgaaatgatccctgtttgtggaattattaaaaagttgaaatcgactactacctgaagaaacaatgcactggagtaaataaactgagttactttgatcttctaataagtacacggtgggtcacattgcagaatcagggttatgaaacacttacataaacttggaaacaaccttagtacgataaacatgaagaagatatcagtataatgaaaaacatatagaaatttggcatcataattcataaagatatgttgatggacataagcagctataacaaaattatatatgcttgctctccaaatccttgctggctgaaatatatttaggttgcatataattagccatcacgatgaatgtctggcctatcaagaatatattttgtgttgcatataatgggtgttcctaccaaaatatgcacaaggattaaaataacagatggaacaaattgtttgaaggcattttcacaaacacatggtaagcatgtcctggaactgatgctcacaagtacatgttctttgacgaagctgctgatgtggagcacgatctgcattgttatccatcacataaggaaaatcaggttgcagtggaggagcatgaaaacaggcggtagagacagagtgatgggtaatgggtacggcgaggcatgactgcacgctgggcagccacgcagcagcagtgctctaatcggccctccacgctcggagcgatgcccaaatcgaaccacccgatgagacatggcaagggaggcaaccaaggccctgcaagagaagcagaactatccatcattgtccgacaacggtggctctagtggcggcggaatcgcagatcagaagagttacctcacgatcggatacagtaggtgacgcgaccagggcaccgccgcagagagggtgaatcgattcggccgctactcgtgtccattgaagtcagtcgaggcagcggggaggaggaggaggagcgagcgaggaagacggccgcggcggtggggaagaagcaggacccggtggcggccccggcgaggacatggaggagcggcggcagcggggaggagctcctgcgaggatgcggggaggaggagcgagcaagcgaggagaagcgcagtcttcgcggccacgggtggaggagtagcgaaatcttcgcgcgtggaatcctcggctgtgaaatcgtgcggtggagaaaacttgcgcgcggatggactgttcagattaatccggatgatttggcctgtagcattggagggggcaactcctcctttttatattaagtatagattaaaaggatattggcgcctgatttttggaatgaggagattgatgggataatttatagtgtagagatgcttatattcctaaacaaaatttaaatgcttcaaatacttatattgttggacggagtagataggaatcttccatgatgattatgatttagtttacaatccacttcatcttctcatccatgtttacaacagagtggtaataaccatgttaggatgtaaatgctatgggacaattttgttttttccctcactttcatgttcaatattgattttacccctatcttttaggcttttcgtttttccccactttttttagccgaaaaatcttgttgcccatgttttggatggaggagttaacggtgttaactacctgtcaaaagaacatttatactttctctcatctctatttattaattgtgtttttgcccctaatttatgcatgactttggaaatttctttttgattttaaatttgatggaattttgatgaaatttcagcaacattttgacaggaattgaacaaaattttgataaaatttcaacaaaattttacacaagggaaaattggttccatgccatcgaaagttcttaagttttgtttaataccatcgaaagtttgtactgtactttaataccatccaaaatttactacgttacttagcccatgtttgtttcagtttaagattattataatctagattattaaatcagattactctaagctgaattataataagctaacataaaataagctacgagttgtttctttctctagattattagaggcatttaagggtagtgggtctttagccactcaataatctggaaaaagctcttctagaggaaattattgaattatagtaatctggcttatagattataataaataatttagcataataatctacttgtttgtttcagcttactcctaataatccagactataataattctaagctgaatcaaaccgggccttattttaccatcaccgtgaacttgagtggatctgtcgttaaacacgacattacttgcccttgtctcgggtccccgacgcattgccgcccagctccatcacatcctcctgccaccgcacctgtcggagccgccacagccatccactgcgcgaggaagggggttggcgcgggagagcacgacgttgaccgacgctgcgattcctggagggggccgggccggctgccggtcacctgccactaaagttgggcaaaacgccgacgacgacctgacggcgctcttggaggggggctgctacagggaagagcttgagctcgatatgatgtttcatttgacaaggaggagctctaacttgagagacaaattgggccaccggcggcgagattacgcggattgatgggatgaatggtgcttgagatcgagttgaaaatggtgggaactagctcaccgtccctgtcggccgtgctgctcccccgcgcgcgctcgtaacccactcgcggtgctctggtgctcgtgcagtcctctcctcacaatgtttctccggcctgtgttgccgctgctcttgttgctcccaatccccattgatgaagcgatatgcctatgtcggccaaagaagaaaaaattgggcgagatttagatgagtaaaggaagggcaatacagtcataatctgtttgttttccagccaaatattgaaaagaaaaaacaaactaacggaaataaacagttgtggtatagaaaggtaatggagaaaactttggatggtattaaagtgcaccacaaactttcgatggtatatatatataaactttcgatgcgtggaaccaattttcccaaaaaaaagaaaatagtgaggggcctagcaaatatatagagcccttttaaatcgtaggaatgaaaaaaacggaggaataagaaaaacatagggttctgataggaatgaagtgtaaaacagaggattgaaaaacacatgaaaaatatagaaataatcgtttgattggaccacaggaaaaaacacaggaatcggataggagagatagactcaaaggacttttaccaagaggttagacctcttgctaagtttcctccaaaacctatatgcaatatgccattccataggaattttgtaggatttggaaaacttcaatcctttgaatcaaagagatacataggaaaatttcctataggatttcaattctatgaaattcatttataattcctttgattcaaagggggccctaaggctatttttgtaggctttttttttcataagacccaaatataaaagttactagttatcgtgtacgtgcaaggcacgttttgatattatatacacaaaagtagaataataaatgcgagccttttttatgtagcactccatacaaattcttcacgtaaaaattgagttccatagaccatagtgggatgataatttgaatgatctctgaaaaacttgcaccgtctattcctagagtgacaatataacatgcaatgcaccatccacctttattaatagaaattccaaaaaagctccatatgagtgcccccgaggaacaaaaggatatctacacagattttatttcattggtaaaaaaaaagaaacaactctgaagtagaatcactatgctcactgtttctgtgagattgctagcatctccagctggtaaaaaaatgccaataggtagcatctcatttctcatttgtagaattgcatattagagagtaatattatagtccatggttagcaatcccatggcggtagatctcaaacagatcaaaaataatcggggaactttaatgactcacatgaggtagtcggtggtttatctatgaagagcatttttgggaatatatcacagataatgtatataatatctattgtaatacacataatgacaccaattattagtccatttgagtcagtaattaaaaaaaaggcataccttatcaattgtagccaacaattcacttcctgctctctcaacgcccctcctcttactattgagccacagagctgttgccaccagatcctcgacaagataaaataaaaggataatcccccaattcaaattcaataaattatccatgcaaggattagataaaaaatatataccatatactgctctgtatttggtatcagttggcatgaattttacaaattacacagtggcttgagacatctgtgcattaatagatagcaaacaaagcagaatactgaaagcattaaccctatacctcttatataccagggcaccacaccatagaaaagctcacattttagatctagctaaccaaccttctattatttaagataaaaatgaacgtatacgttcacatatatattctgggtacaggcgtacagggagcatcagtatcatgctaatcctaataaggatatggactcatactaagtaactgatgagtagctcaggccaccctaagttccccaagaagtaaggcttccattcttgttaaagccactgctgcatttcataaacaacttgtggctaattcaattgcataaggagatgaactccactatctatacaatggttttcctacagccacaaggacttcatatgtgttcttctcacattgcaatcgaaataacatttatatgatcacaggaggaaaaatacctgggaatgaaacttcagagagttctcgtcgacgaacaaaagaccatgcagatcgattactttactttagatctttgaataatcacgcacctttttgcgccactggacattttatatacataaacaaccttatttatgataaaccagttcaattatgaactaaattaatttttcaactccagtagacagtgagttacctcaaaaacatatgcttgtcttgagggctattatagcagaataagtaccataagtatgaactaaattaaaattttcaactttagtagacaatgagttacctcagaatatatgcttgtcttgagggctattatagttgaataagtaccatgaactgcaaaaaatactaaaactttgttcaaaaccaacaagtgcagccattgcaccatggagcccattctccaacgaaaggagagacaacagtgaataactaacctacagtggccataaaagatcatcaagtacaacctttgccaagatgtagaaatggtatactaatttattttatggaaaaaagaaacccaacatgtcttcaacatgtcttcctaggcactctgacattttgtctaaactgtgcatgtttctccatagctagctgtgggaggtccatatcttctctcataattcatgaaagtgcatatctgaagacatttgtttctttaatgctcaagcacatgtattcataggaacaactcacaacaattgagatatcagcttcattaacaattttttttatacaacacttgcctaaattgagacacaaagaagtacctgcaatacacaacattagctcaggaggcccttgtcctgattggctccctcttaattcctgaagcccatttgtggatgtcatgctatattcaaatttccagcacccatggaacttgctagatatttcactcaagaatccgcatggccacatcaagccccaaatgcattttcagatacaaaatatatgtcagtccatagggacagaactatagaggaaaaaataatttgtaaatttgcaaagtagaacctgatgccatgaagattccatcaacaatgtaattaacctacttataggaaatcaacctccaacatggatacaggaacatgtatccagcagcatcgcctttagtccagaggcattgcgagggatggtatgatgttgccattgcaccttgctatgagatcgccttctcctgcctaaaacctgagaccactgactagtggagcaagagaggatggatctaaaaaactaaatattgtttccattagcagactaacgaacggaagcttatcttcggcgaaaggggggaaccacctcggcggcggcggcttgcggcagcggtggagtgcggcggcggctggggatgacctcggctcaagcggggcagtggcggctggtgacgaccttgactccgacgggggaagcagcggctggtgatggcctcgactccggcgggggcagcggtgtagtgcggctgcggcggggacacgcgtggaggcgtggagcgaggaggagcgagtaagtggtccacggaatcatctcgcgggacggagtaaacacgcggtggagggagtgcaggcagaaatcgcggtggagggaggggaatcggtgggcggtagcaggtagtgacggttgtgatgcgtgcgacgtggatggacggtagggattgatagatgtgatttggcctgtaggattgaagggatacaactcttcctttttatattagtatagatatagataactaatttgatgtttataagtatagtagggttgaagcataaataatcaagggctgaaatataaaagccacttgagtgttgcctgcattttggcaggaagaggctcctctgatgtacttccctctgacatcgatcgcagatatatgagcccatgagctatggggcccacctgtcatcaaattcagatgccagtaagctagaggctctatttctattgtggaggtagtattgtcatatgggtgcatttgggagtactctttctaactcctactatattgttttctgcgaatacgctttccaaactgttaaatagtactccctccgtcccccaatataaggggttttaacatttttcttgcattgtttgaccgttcgtctcactaaaatttttttcgaattattatttattttattgtgacttactttattatcaaaagtactttaagcacatcttttcgttttttatatttgcataaatttttttgaataagataagtggtcaaacagtaccagcaaaatatcaaatcccttgtattagggaacggagtgagtatattttttgcaaaaaaaaagttctatagaaaagtttctttaaaatcatgttgatctatttttatttttttaatacttaattaattttgtgctaatgaggtacctgttgatgtgaaaacacgagacctgggagatctgcctaactccagtgcaggtccaaaactcgccttcgggtatgctagcgtgccagttgatttgatcctgcaatcaacaagaacaaagacaaagaaaccgcggttaaatccataaacgatagccgatcggctaggtgctgataacatatcatttatctttgagccgatgtcatatatgcatcgatcggcaggcattaataaataaaacagaactaaatctactcgatcggctatagatattaatgatatataatccttatatcgatatatacttaatcaagtgattgcgatagatcgtcgccatgccgagacagtataaatcacttcaatcgaaatatatattaacaatgagattatttatattcgtagcatagccgatcagatagatctagcatgtatcggctaatactccgatacagctctatactaagatatcaaagcaaatagaatatatcaaacaaaagcctaatatacttaaatgcaacaagatcttaacataaagaacagattcaacatatcaacgaagcataaaggacaaaaagtagttaaatcaggtaagatcggctgaaaccccgatactaccctaatcggcaaccaagaagcaggctagagattgagattctaatcacgactcataagatcaaactcaactgatgcaactataagtatgaaaagaagagcaatatctagacaatcaagccgttggaagtttcatagagtggtggatatcgtatataatctaagccaacgttgctatctaacctaatcgactgccttctactgacagatgttagccgattataggttaaatgtcaatattgttagagattatataagatatatgataactcgacgaattatataaacaagattagagtatcataatgatggaagcactaatcccgagaacgcaagccgccataataagttttacctcttgttgaagatcgaaaccgatgcagctcaacccgaaagcaagaactcgtcgaaacaaaacgaaagcaaaaagtgtggcgatgcaccgagattgtattgaacgtgtgttagtttgattacatggggctcggggtctatttatacccaagaattacaaaacatgtccatatcggacacggacacgattcttatctctaacaaactctaagataccataagtctttgcggcagacttttgcccaaatatatctataagaaaattacataaaatattctaattaatagatacaattgtcttctcatgactctatccatgcatggcaatcatcttaaagcatatcaactcaacccgatgacgtataccgagttgtattgtcggaatcggctatatcaactcacccagtccgactcggactcagccgatcttggtcgtagccaatttggactccagccgattcttactctgtttccgaaacgatcttcgtctttgattctgctccgatctaatcttcatcttcgatactgatattaccaaatttagtcgttaacagtactttatgtacttagagattagttttcaacacaagatgccaaacacagcatatggttcatccaatgtggtatttactttttttttcttgtggacacattctctaattaggactcttttgacgtgcctcatcacagcagaaaaagaagatgacaattagatcgaacgtaacttctctaaagcaaggtcagagaaacatgtgttccttataagtgagatccactgttatgtatttaagcgtcagtgacccacgtccctctcatgtctcacccaagacatgagccaacagctatacaggtaaaatagtggattatgggagacaacagtactaactagctatgtctgctttaagtatatactttctccgtttcacaatgtaaaactttttagcattgctaatattcatttagatgttaataaatttagacatatatatgtatagattcattaatatctatatgaacgtgggtaacgctagaaaatcttacattgtgaaacggaggaagtaattttttcgatgtagttagtgcaactcgagaatatttatgtaagaatagaattatgagttgtatgctaacaccttgtttagtaccaaacttttttaaaaaacttccacttttccatcacatcaaaactttcctacatacataaactttcaacttttccatcacatcgttctaatttcaaccaaactttcaattttggtgtgaactagacacagcctaaatctaatttacttctactctttgaaacggaaaagaaaaaaaaagagctataggagtaataataaagagagaaattaaaaaaaaacagagagaaaaagagagaaaggaagataagagaagaaaaaaaaaagagaaggggcaagtcttccccaagtcacaccatccccgtcccggatccggcgaccaccgattcctcgccgccgccgacgacgatgccggcgttcaaggcgccggcgccgggcttctccgtgcgcttcagcccgttccacgagcagcgcctcctcgcggccgcctcccagcacttcggattagtcggcaacggccacctcctcgtcctcgacctctccgccgccgccgccccggggggcgcgccggcgcccccgccggtgttcgccttcccgacctccgacgcgctgttcgactgcgcgtggtcggagtcccacgagtccctctgcgccgccgcctccggggacgggtccgtgcgcctgttcgacgtcgcgctgccgcccgcgcagaaccccgtccgcctcctccgggagcacgcgcgggaggtgcacggcctcgactggaaccccgtccgccgcgacgccttcctctccgcgtcctgggacgacacgctcaagctctggtccccggaccgcccggcctccgtgcgcaccttccgcggccacgagtactgcgtctacgccgccgcgtggtcggcgcgccacccggacgtcttcgcctccgcgtccggcgaccgcaccgcccgcgtctgggacgtgcgcgagccggcgcccacgctggtcatcccggcgcacgaccacgaggtgctctcgctcgactgggacaagtacgatccgtccatcctcgccaccggctccgtcgacaagtcgatccgcgtctgggacgtccgcgcgccgcgggcgccgctggcgcagctcgccgggcacgggtacgccgtcaagcgcgtcaagttctcgccgcaccggcagggcatgctcatgtcctgctcctacgacatgacggtgtgcatgtgggattaccgcaaggaggacgcgctgctcgcgaggtatggccaccacactgaattcgttgccgggatcgacatgagcgtgctcgtggaagggttgctcgcgagcaccgggtgggacgagatgatctatgtgtggccatttggctctgatcctagagcaatgtaaacaaaatgcctttggagaacacatatttcgtacgtcgagggatatggattatttctgttgcgttttgcattggtcatagtaatacatgtggattaactcctttgagttgaagaaattgcaataaagatcctattgctatctaaatcacctagttgttaagttcttcacttagactcaaagtgcataatgtattgctagtatataatgttggttgtagggcaaattagtgggggttctacaaccccgatagtgcataggactatgtagtgtaatctagggcatagggagatatgtgaagcacattaaaatctataatgtatacaattctgtttgcagctggtataaatcctcttagacttcttattgccctgcattaatagccttgtatgccttcttgagatagtggcaaaatctagtcgtatgtcaatcttccatcttgctattacagtttaaatagtgcgtgccattgtcaacatataaatggagttcatttactccttctgtaccacagtgtttgtccattttgttgggatgtacgtttgtaacgtttaacaatgttttgtctgctaataataaaaccaacactctagctatcacaacatatccactctggaacctaatttaatgcagtacaagagattagtaattgtgctgtgtggtttaatagaatgtatggtcaacaaatatataaccctattaaataactgtagtaaaagagattgaataattgtatgggtatacagtataaaagggttgaataattctcaaaagtttgacttgagacatgtccaacacaagatgtttttgttactagagggtgtaacatgagttgaataattgaacattgtgtatgtagaactatgcctggtatttgaacaatcaatgagatggttcagttagagtagatttgtcatgattgggatgtaaccatgtaaaatgttcgggtgctttgtatatactttaagcatgcatgtggtgacatgggtgtgtgagttgttgaacataatagtacaagatttgccagcttatctcaacataaatattgttggaataaaggaaagtacatttagcatagcacacaatgtctgtagcataagttgcttgatttagcattcttggccgagccagtttgttcctgctacatgactgttaagtaatacaaacattattgcgctgaatcctcttctgcaaatttctgacctcaatagatgatctcaactgtactgagtaatggtttgaattcgaaaggttaaattttacattatgtgtgttcatttttctacattatatgattgttcagctacttgtacgtggtaaattttataaatgttggtcaaaacattgaatttccaagaggtatcatctatgtggaaaattcttaccatctactccctccatctcatattataagtcgtttggcttttttcttagacaaagttctttaggtttgacgaagtttatagaaaaaatcagcaacatctataacaccaaattagtttcattaaatctaacattgaatatattttgatacaataattgttttgcattggaaatgtcactatatttttcaaacttgatcaaacttaaaaaagtctgattaagaaaaaagtcaaacgatttataatatgaaacaaaggagtatctagtatatgttcaataatcaatactcccttcgtcccataatagaagggactatgtcatttttggtataaattaaggaagtaataaaaaatacatttcatagtacaaaagtatcgatgggaggataaaatagtaaaaaaggtgatagatgggaggataaatagtagaagagttgataggtggggaataaagcagtgctgcctccgtcccaaaatatagggactttgggtagatgtgatacatcatagtacaatgaatctggacaggaagcctatccaggttcattgtattgtgatgtgtcacatccacttatattttggaacggagggagtacaagaatagataggtgggagaataaactagtacaagagttgataaatgggaaataaagtgttgtcttaggatcacaaaaatcccttatattgtgtgacaaactatagggcctaaatctcttgtattattggacggaggaagcactaggcatgtgatgtctcaactctattgtttgttctatttctcttctgatgatctcacaagtaatgagtgacaccactattttccttgacacaatagtaaaaaactctcagttattatcggccaaacaaattactactatttacttcataagatcaaaacagtgtagcatcaattctacaattgacaaacctgttgaagtcagaatatattatcttgtttcagttgctacgttttgagcatgatgcattcaaacctttttgctgtcattatacatattgaagtatttgctatgcgatgaaaaaaaagtgagtttaatataattttaagataccaattggtacttcgtacaaactaatgtcaaccagttaaaatgtttgctatagtttgcttggtatatgcattgttcagaggaatatgctgaatttggtttggtcaaactgaaggcatgggttgcagggatatcttggtaaaacaacatgcgttgttagcaaaaacatactacagtagggtaggttcacccagatttcgtttccttttattattgatatcaagataagctatctactggctgtgtatttgcaggactgatatcaatataaggataaagtaattgacctgttctaccagattttccttctgagcctactatgcctagatcgctcacgcagcaacttacccctttttttttccagtggaaattggactggcatgatagatacacataagaccagaacaacatcactaagaaatgacagaagaaattccaaattggcactgcatctatctgtttgtgttgcaattgtgcactcctatctatcgtgttgcaattgtatactcctatactcctatctatctcctggtctgcttgcgtccattctgatgttcgatatgtagatatgtatggagtagtggattgcaccacaggatgttattgttcaggattgctgcccagttattattgtttgttgatcagttattgcacaggtatgtatgcctgattgataagaactttatcagttattgcacaggaatgtatgcctgattgatggtaaaaactctagcttacatatatgccccttcaaatgaaattcctgtacttgataaaagaatctgctgagttctggcatctggagtagtggagcgtgctgacaagagatacctctctcgttgcaaacttgcaatcacggcaagaaggttaagatcatacatgaaacacgcaatttcagaattacatgaaacacgatggtggtgataaggtttcatgggaacgttctcaggctatacagacatgtgctagcaagaattatcagcacacacaagtcttacggctatgaagataccatcgaacgttgcatgtctgctaatgtaaaatgacaagtatgatcttcgcagtgccattattttacaggtgaagaccagaacatatacatcatcattacgcattacacattacacttgttttatccatcccactattcactcatacatgctgattcatcagcacaagagaccatcagacagatccataaatcaaccacctccttggtgctctcaccagttaccacatcgtcaaaacagaccagcaaatacttccatgaatcccaataacagaaacagaaggacaagatacagctcacgacaggctgggctgcagttgtaacaagaggagaaaactgcacttgttaaagaaaacaagatgcaacctggatcagtttagaaaacaagaagcaacagccacaatattcaagaggcaaaatatatttagatgatgacattcaatataacagatatagaatgctattagcgcttgagccttcctatgtaatataaagataattatcgatttccacattgtgttgtaaagataatatacatggcaacgttccatgtatacaccaaaattccgtcgcacagtgtttcctagcaacataccatgtcagtattttagaaccattgcctcctactgccttaacccgcagagcacctaaagaactaactaaagataaggtgaccggctacatcattggatcacagaatcctcctgtcacttttggggctgaaaacagcatctaaaaaaacacacacatgtcaaataacggatgtgtcggaaaaaattcaaaaattaacaagaaaactcactcctggcctcctgggctcctggccagagactactaggcaaaaatttgacctacagttgcatcagaccatcagtgatgttcaaaagagagaaatcatggtcaagtatgatgccttcatgccttactgtgctattcaaacatttgaacaaaaaaataccagaaatatacagaaaaacagctggtgagactatcaaaacttctctaaaagataatggtacaccatataaactggtctgttgtacacaaaaagaaattacaacctccccttcataatagtctaatgcacagaacatgtttcaatttgaatggagaaaaagtacagattcgccaacaatactttcaagtcctgtaagttcaatgctaatgttcgaaacaatatgtatttgtgggattagagtatgcaagctatgtggccctgtcgaatttatgaaagcatgaacaaagcagcgcaagcatcactcaaaactcttatttttctgaataataataatatatataatacatatagctctccatacaagaaaacaaaagcatatagaataacttgggttttcatgtcatgttctgcatccgcaacactcagaaccgcaaatgaaaaagaaaagctaaatagaaatagcatggaatggtacagtaccacttaacaaaaaacttaaatatgtgcaggtgaggaaacaaaaagcatagggtaacaccataactggaatgtcaacaccttgagaaaatacaaagtaactgacaaaatttggttagcatacaacattctgttctgcaagtcctcgtctaaaacttaaggcattagaccaatgaaggtagagaaaatacataattaagccttcaactaaaagcttttcctatttcataaaatattccagcagcagcgatctaatggataaccatgctattctgtcaaaggaagaattttaacatcaggagcatcatcaacaagtcaatatacttcctctgtttcataagtaagactttctagcattgcccacatttatatagatactaatgaatctagacatatatgtgtgcctagattcattagcatatatatgaatgtgggcaatgctagaaagtctcacttcatgaaaccggaggagtaactaacaatgtcagaggtatatatacaataaaacaatcatcatcttgaccagacctttataataagctcttgaagaccttcacccatgcagtacagaaaaatctacaataacatgcaagcattcaaatagtgaacatcttgtaagatgacaagtaggcagtgaactttcaagacaagcacatttcacaacagcgaaacagcagaagctaaaacatatattttaagtaacagatggccataaagagatatgtatgtctgacattcaaatagtgcaaataacagtgtttcaccacgtttaaacataacatgagaatacagaaattaataggcagcaaccaacaaaaatattctcctttatagctgcaagttcagttgcaagcaataacctgccagtgcactgagatacaagaaagctcatttctttctcccaccacgctccctcagtgttaaattgatcaccactccagggccaatgttgtagtaagcaagagtgagattgtctttgaggaaactagtccgcacgctcaacttctgcttattagcagnnnnnnnnnnnnnnnnnnnnnnnnnctcctttagactgccaactgtgtctgagagtgattggacaccgatctccaacacttggcctcgcaggtttccttcatcaaggttgggtacagacactgagatgtgagcagggccctgcagggaagagaagaaattagcacatggaaattcttaaaattcaatatacgcatacaaaaagaacaagactaacaagaatgtttagtagaaaacaggaaagtggagaagaaatatatcaagaagtattaccgggtgctgagcaaggaactgttctgctggtataagagaagcgtcatctgttctcagccttttaggttctggttcatcaggttgaggtggctgctcctcagcaggtggttgtggaggcaaaggtggtggaggctgaggaatcccaatggggttgaccatggttgccatggttggcatgtgtggcggtggaggcatggagtatggacgcggcgggccaggcatgtagggattttggcctggtggaggcggaggtatattggttggcataggacccattgaacctggcatcctaatcacctgcggctgacctggtattggcggtggtggaggcggatgcatggtaggcatcatatgtggaactccttgcatgagatgaggttgttggtgtgggggatatggcattgcactaggttgaaagcgtggaacattaaccagtggaagtggctgaggaggtctaagcaatggcatgggagggcggggaagtggagctggaccaggaacattcgaagcatcaacctgttcctcgccgcccatagacagagcctgtgtggcagtacgacctatgctaccagaatggccatcccaaataacctgctttggctgttcatcctttttcttctcaatttctgccttgacagcattagagacctcttcctctgttgttccaaagatgtctggcctggtacgggcaagacccacaatgttcctggagatttcatcatcaggagcaagtgttgtctccttaatttttgccaacatccgctctttctgctccttatattttggatcaataagcgagatgcgcatgtgctcctccatctcactaattggaatgagctccccagttattggtgagacaacgaatttcgttgggtccctctccgcagggattctctcctcaggcctcttgtagttcttgacaatcctcataggcggctcctcatcaccagcaagcttaacttgaactcctccttcattttcctcgagccttgctgcacgcattccttcctcaacaagttgaatctcctcctcgtccatctccatctcaacatccttcgctggctcggccaattccatggctgcctcctcctctcccaggtcctcaatcctcttccgacgcttcaactcctccagcgtaagtggcacagggagtccctcgcactcatcatctgcaaactcgatcgtctcgacaacaacaaaatcatgccaatcgatcatctgcatctgcatcctctcctgttcgatttcatcctcagcctgctgcctcgcttgctcctgcgaccggtcccactccaggcggttcaggcaccgctccaacacggtggtcaggtccttcgccccgtcttgtaggtccttcagtagggcaggcatgccttcgaccgggttcagcaccctcgaataggtgtcggtgagcttcgtgaagaaggtgaacatgctgtgcgtggggcggatgaagtggaactgcgggttggtgctctcgcgctgcgccaggctcgtcaggaagctcttcccgttgcgcgccacgaactgcgcggtcagcttgatgatgtccagctcctccccggtgatcccctcgggcagatgcaccgtgtagagctccgccttgggtggcaccagcaccttggtgggcggcggcacgcggaatggggcggagtggtccgccttcgccgcctcgccatcgacggtgggcgcggcagcggagtcggccggcggcggcgcggcgccggattcgtcgggctcgggggccgcgtcggcggcggaggcggcggcggaggggggagcggcagcgagctcggagacgcggtgctggtagtaggcgtggtaggggtcggagggctggaggaagttgaacttggcgttgccggcgttgtgggagatgatgcggcgctcgaactccgggccgttcttggagacgaaggtggccgtcttctcgatgatgacgcggatgtcggggggcgggtggatgatcccgagggggcgggtgtgggtggccaccgtcggcggcggctcgggcttcgcgcctccgccgggaggagggggaggcggctgttgcggatgggagtcgccgtcgccgtccggcgccgggagcggcaggatggcggcccccatggcggcggaggcgagggggattagggtttcgtcggcgtggggtggggtgggtttaggtttagatcggggaggatttgcgcgacggaatcgtgagctgctgtgacgcacgcgtctcgtctcgtctcagcgagaggcggtgagagactgaagagagaggaggagacaggtcggttctaagggccaaacgggccgcccggcctgttaaggcacggtaggcctttgccggcacgggcccgattgggggtcgtgggcctggtggcggcccgtcggcacgacgtggcccgccaaattttgagaaggaaaaatggaaggaatgaaagggaaattagagaaaaatgttgtggagtgcggcatgactagggctggatgaaaagctcgtgcctcgttagattgctcgactcgcgccaagctcggctcggctcgttttattttcctaacgagccgagctggccttttagctagggctttcaacgagccgagctcatctgcctaggctcgagctcgatacaagctcgatacaagctcgagccgagcctataaaatgttcgagctttttgacaggctcggctcgagctcgaccaagctcgagctcgactaccgagctagatttttaagtaaaataatatatatttcaaaaataatcttttaaaaataattaaaaaataattaatttctagttcatcatattaaaagaagaggaaaaaagaataaaataaatatatgatgtcaatataaggcatacaaataacatatttgatctcctaatttattaaataacaataaaaatcatatattattatgctcgttggaagctcgagctcggctcgacaaagctcgcgagcttagggagaggctcgggctcggctcgtttggagctcgagccgagctcgaatcgagtctaggacgagccaagctcgagcagctcgcgagcctcgagcttttttgacagccctacttttagctcgttagagataacgaactagctcaagctggctcgcgagccttaacgagctgaggtagctagcccatgccgttgtggacttgtgggccatatgtgcttgaaggcccatatatgcatcaaaactctagctctattccccatccccaatcccacacgagccgccgcaagccctcaacgcccggtcgctcgcgcggctctcccccaggtcccaacgcctaacgccaccgcatacgccgccgcccacaccgctgcgtcgcgccgctcttccccatcgccggcgcggccgtggacgccgccgcccgcgccgctattcccggtcgccgacgcggccgctcttccccaacgtcgccgtaaccatggacatcaccgcccgcgccgctcttccctggcgccgaagtgaccgtggacgccgccgtccgcgccgctcttcctcggcgcctctcctctccttgttcgctgcccaaagctcacgagctaaacgagctggctcgagcttgcaaacgagccgagccgagcttggtttctagctcgttaggataatgagccgagccgagctagctcgttatcctaataagcgagaccaagccgagccgagccagcttgacatccacccttaagcatgactgcgtgagcatggaactttattgaccatggctacctaggtttgctaattcacggatatccacgcgtccccccccccccgcggcgtagccacgtggcgcgtgcgaaggaggggtggtggcaggagcacgagggagggtcatatgcgtgagttttctctatttttttttctttcagttttattttttttgggttttttttggttttttcttgatttcttccccgtttttgatatgtatatataaaaagtttgtatatgtgaatatacatatagaaagtttgtatacatacttttgtatatgtacgtatataaactttgtatacgtggtgtttcttttttgttttttcccttggttttttgggtttttaaatatgtatgtacgataaagttttatacgtgtatacaatttttttatacatcaaagtgtatgcgtataaaattatatatgtatatatatctatacgtataactttgtatcgtgtaatacaaaattatatgtatgcatatagaggatatacatatacttatactgcagaggagagaggactggagggcacggaactgaccacgcaggtgcggccctgcgcggctgattgcggatcagccagcccctcatcctcatgactacctagcttaaaccatactccctccgtcctaaaaaaaaaaataaaccatgggtttccgtgtccaactttgactgtccgtcttatatgaaatttttttataattcgtattttcattgttgttagatgataaaacataattaatattttatgcgtgacttgtctttttaatttttttcatattttttttcaaataagacggacggtcaaatgttggacacgaaaaccaggatttgtcttttttaggacggagggagtaataacgagaaagtagcagagagccagagactacatacgaaatactccttccgtttcatcatattatgagtcgttttgacttttttatgagtttgtagagaaattagcaacatctacaatacctaataaatttcattcaaactaatatttcatattttttttataatccgttgatgtgaaaaacacacactggcctgagagatttgctttaatctagtgcaggtccaaaaaaacttgccttcgggttctgagcgtgccaattagtttaatcctgcaaccaacaagaaacaaaaaagaacaaagttaaatctataaacgatagccgatcggctagattgccgttgacgtatcaatatcagaccgatatggtaaagatcatatcggcaatggaagtatgtagcacaagaatacataggcccgcctgatcggctgtagatattaataaacatataatcggcccctcagaatacatttaaactaagtgatttggatagatcggacagtacgccaagacagtataaatcacttatgtctaaaagtactctgaaatacattcataccatagccgatgaagcaaacctagggcgtatcagctagtactccgataccactctatatcaagatatcgcagtagatgaaacatattgaacgagaaccgatctaacattaggatggcctaacagattgatagcaagataaatatatttcaaacaaacgatatcttagtatagagggtagacttagcatatcaagcaaacgcgagagcgacaagataactaagccagataagattggctgaaacctcgatgctatctctattagcagctatagacgggctagatattgcaattctaaacattactcaacagatcaaactcaactaatccagtattaagtcatgaagagaagtacaagatctaaacaagtcgacagaagcttttctgagatggtagatacgctatataacctaattcaacgtcggtaactaaccttgccggctgttttcgatgatagaggatagccaatggggttggataacgatattgatctaggttatatagcatatgtgataacttggcgattgacataggcaggattaaagtgtcatgatgatgtaagcactaatcccgagaacacaaaccgccataaccagccttacctcttcgtcggagatcgaaaccgatgcagcccaactcgaaagcaagaactcgtcaaaaacaatgaaagtggaaaaagggtggcgatgcaccgaaagtattattgaactagtgttgttttttctacaaggcctcgggctatatttataccgaaatacataatatgtccttgttggacacgactctatctctattacaatttaaaacacgaacaagtcccttgggtggactcttaccaaaaatatctctaaggaaattaataaaacatcctaattaatagatacaatcgccttttctagaccctaatccttgtgtggcaatgcccatgtagtgccttgattgatcccgacaataattgtagaaccatctgttcgagattggctgcatcggcttgtctttgtctgattcagtatcagccgatacatacagcagccgatgtcgtccgtagccgatgcgcactcttctttccaaaaccaaaattcctccaaatccgcttatgctctagctttgaatccaatctatgatttcaccaaatttggttgttaacaataatatgttcgttttgtgttaccagcggcatgtgaactcaactatatgtatcaccctttttttgatggcgtgcttctttatctaagatatatatttactttcctttttggtataactaacatatggaattcccctttttaactggactagctatcaaacaaaacaaccaatcatgtacatgatgattttaaagcatcaagagagatcttgagtttaaggaaatagcttattgaggcgagatatttactttattgattgttatattagatattcaatttctcattgttattgtacttttaggttttctttcctaattcccgtgagaatttacctgtatcatatgaaatccatacattttaaactctacttggagaagttaagcacaattatgattggattcttccaactgtagtacccacttgtcgatgcttagctattggttgtgcattttgctattaaacttttgtaacatttgttcaagaactaatcttgcaatacatatataggggtatggtagataaacattctatttatatatgaatgtagtgtcatagtgttgattttgtagttgttgacattcattgtaaaatgcattggcaatggatgaatgggagtgtaatgtttaagaccatgtcaagttaaatccccacaacgttcatatacaatagtggtatcacatttcattttggctgctacttttgatattccactgaagaaatagtatgaaaaaatatatgtcggccattcggcctcatagaaagttcaaatctgcaaaagaaaaaaaagtgcaaagaaaatagtgatggacgcggtacaacatgggggttacacaacatattgaaaccgctagctccctagtacagttcctactttgcgtgctcttttgttattttattttttgagcatacgtaaaaggtttgcacatcagtctttgatagataaccttttttctcaatatctaaaatggaaatcgtctttttcccttttagcttgtgctttgcttccaagttgcatcttgattgctgctctgtactgtagtccctcgtgtccagatttgtactacaagtgtgtcacatttgtccctcatctgtttcaaaatagatcaatctagaaatagatataatattatctattcatattcattatattaaaatatatcatattcaatcgtatatttgtttttttttaattttgacagagggaacactctggtgtcaggtgctgaatctgatcccatgtgatgcctgattttctgtcagagtagtgggcttgtcatcagcactacttgtctagggtgtgtttaggcagcggtcgttttggaggacattgaggcagaaagcacctcgtttttcacaagcacgttttctaaactactaaacggtgtgttttttgcaaaaattttctataagaaaattgctttaaaaaatcatattaatctatttttaaaatttaaaataattaatactcaattaatcatgagctaatggctcacctcgtattttctcaatctcctcaatccccttcttcttaaacacacccttagtctacgccaaaattgaaagtttgattgaaattggaactatgtgatggaaaagttggaattttatgtgtgtagaaaagttttgatgtaataaaaaagttagaagtttgaagaaaaagtttagaactaaactcggccctactttagttgaacaacttataaattttggagctggcacacaaagatgttcgatctgttccttttcagcgtaacttttcatgtggttagttctatgatacctttctgaaggcctttttgcacttttacaattcttactagtttcatgctagtgctaactaatgaaggcttaggcatgatctaagagtctaattagcatgctatggcaagagaataagtagtacatggtgtggtgttagatcaaaatataatcatcttatgaacaccctttgctgtcctgccttaatggccatacactgaaactgtaaaggagccaatgagagctaaggggcacaaagatggtgggagaggaatattcttcgacaattgagcaatgagcagctttcttaggacaaattggaggggcagaagaaaatgaaatgcagaagcttacaagtagagtttcagtttgccttttattcctaactgccagttcgtttatcatgagatgcagaagaagacatgaatatgtccctttctcctaggcaaggcctggtagtgtttaccctagaaaataaggtccctttcttctcttgcattttgcacatccaaacaagatagttgaaaatgacatttgcatatcccttttcattctccagtattttacggaactaaatccaaaaactcttcttcttcccccaaaccagtcggaatatttttgcatgcagtggcagtacaccgtttaaaatagcccccatttaattcaaaggaaattcataggaattttagaggattttattcctataggattttttcctacaaagccctttgaatcaaaggaatgaaccctatggaatcctataaaattcctatggaatgcctcttctcatacaagttttggaggaattttaacaagagttagaacctcatggaagaaatcctttgaggccccctatgaatcaaagtatttatgtaggaattttataggattcaaatcctgtaggaaatttttcctatttggccctttgattcaaaggattgaagctttccaaatcctatgaaattcctatgaaatggcacattgcatgtggattttggaggaaatttagcaagagctccaacctcttggaaaatttccttgagtctatctctctcatccgattcctgcgtttttcctgcgctctaatcaaacgaccattcctgtgtttttcctatgttttgcaatcctctgttttacacttcaattcctgtcagaatcctgtatttttcctattcctccattttttctaccctgcgattcaaaggggccctgagtctttatctctcctcaaattcctatgtttttcctgtggtccaatcaaacggctattcctatgtttttcctgtgttttgcaatcctctgttttacacttacattcctgtcagaatcctatgttttttctattcctccgttttttcattcccgtgattcaaaggggccctaaaattggccaattggaaatcttccaagccgatgggactaagatttcaaaatccggtaattttgtaaaagtttgggacacgggtgtgcagcctgttattggctaacaaccagttaaattccagccaatgaaatattaaaccagggtttaatatttctattacatttattactaactactccatccattccatccatttcatattataagtcgctttaacttttttttcttagtcaaaacttatttaagtttgatcaaatttatagaaaaatttagcaacatcaacaacaccaaactagttttattaaaactaaaatttaatatattttcataatttgtttgttttgtgttgaaaatattgttattctttttttataaaatcggttaaacttaaaaaaattaaactaaaataaaaaataatcaaaatgacttataatatgaaacggagggagtatatattactgctttgaccactaaccatcagaacattatgaaattttggtaaaaacaattaaattaaaagaaaaaaataattaaaatgacttataatatgaaacggagagagtatatattactgcttttaccactaaccatcagaacattatgaaattttggtgtaaccaatgcatttttagacgattctactgatgtggagtatttttttgcgtaaccaatcaaaatattttataggccttctattccttttgcaggagggagtagcacaagataaataaaatccatctcccaatacatttttgcttggtgattgatgacaccgatgtaagtttggtcaatgttgtcatcaatgcccagtggaagaaagcaacatcgcgataatatacaaaaatggacgatgtggcactgccatgagatgtacgaataggaaataaatccgcaggaaaactagtgggggactaaaacaaaactaaattacccaaagttgcagtcctacatgtgattaccaattttcttttgaaggatcgcatgtgattttcaattaaaatcacacgcactgaggactttctttttgaggggaggtgataccttttctttgagacagtgatatgggttgtgaactcttaatttttggggtgggatacttttgtatcataattctccatccggtcacatatattttacatttaagataatatttaattaaacttttaatattgaaccatcaagtttgtattagaataagtttagacaatataatgagcttgtgttgttatgatagtaatttaagataaatatacacctaacatttattttaactaagtcgtgagaaattattaaccattaaagtttatcaaattttatccatcaaatatttatgataagaggacattcttaagtactactccgaagaaatctactgatacttattaagcaagttcaacgattaaggctgtgttctgttggaggggttgggaaccctcctcctccgcacgtaaaacgagcgataaattaatgtatgatcaattaattatctataacaaacttaaaaaatggattaatatgacttttcaaaacatttaaaaaacgtgcgctcgaataacgagggagatgagttgggaactcgttagaaaggacttctacagatatgttgtacggtaaattattgtaaggacatactagtacaaaattagggtggatcttccatatctcgcggtcgtctaaaacattttagaccgtcgaattctcatcctatacggctcaattatcgccttatatttttttagataatggaattatcaccctatataaaaatttataaacaacggacaccgcgtatagttctttttatgtgttctaatggttttcactatttgatatggctttggtgagaatatttataccttacatccaaacaatcctatcaaataatacttaattaggcgtttaggattacagtaaagccttgtcattataacaccatggtccattgggtacaccagagaggaccctgccattgatgccactctctgttttgtactactagtactactcaatttgaccagcagtttgtcacgctttgacatgtggagcgccgaggcatttcgttgagagatccaatcaagattccccctcaaatcctgtgctgcttcttcttcctccttcctccaggcaagcccattggaacgtctcgctggaagatcaacaccagccattatgcagagaggccctcgtagaccatacaaagtgtggattctttcttttattattattgtaagctttaatagtactcctaagttcatctttaattagcagaggcaaagacagaagaggtgtatggtgtgcccacaatatagctaggagcccttactaattatgtatctcagcccttaccaccaccttcacactagtgatggatctaagaatttttagaaaagaacaaaatccaccgcgctagagtcgtctgcattgcctggtaccaacaaatgaggtatttctctacatcttgagtcttgacatgcaccggcattatcagataccaataacaatgtatttctacctcttgccatatgccggtaagtttgggcaactactcgggggtagtcatggtactgtcgcgctagatctgccaatggatctcatgttgttcacgacgctagagcaagatgacatgcaattttactggcaaaagatagacaaatgtttttttttgttatatcaggtggaatttcactttcaatcatagaaatttttaacgtacagataaagtagtttatcggtgataatggcttttgagtacagaatgccaaatgaacaagtcttccctcacaaaaaaagcttgaacattttattaaagtagcttagctagtggtggttgagttggagtatgactctgaaatttgtctcaagtgcaatttagaaagtctctgtgatatcaccttcatcgtcaattggctcggcttgacaatgcatggatgtcatcttgactgtatatggtccactagaggcggagattagaggccgtgcaagagaaaattaaggggaaaagaattgatcaagccaaaccatgtaatgtgttgatgccggctccaattgaaaacataatactttcatgttttctgcaataacaatatatgccggctaaaagaaataattctgcttaattacgtcaatggggttcaagtgaaaattactcgttatatgcagcggagtagcaaactcataagaaaatttgaccaaactcatgctaactttaagaatttctcaatcacgggaatacttcatctgtcccaaaataaaataaaaagaattaaatgtgatatgacctactaaaatgaatctggatataaacaaatgtagagctagatgagacataacctaatataaatctggacatgtttctgtctagattcgttgtactatgttatatctcatctaattctgcatatttgtttgttttgggacgggggtatatatttaaagaggttttatgtaaatttaagaaaaaaactttatcatatcacatatgcaagatatgtagaaagtgaactcaaagtttgagatctgcttttgacattttcatggacgaatgaaagcaataaaaatttggattcagatgttgcttcaaaaagaaaaaaaaagtttcagatatagtacaatatactgaacagtgatagttttgtttgataactccttttcttcttcttcttcttcttcttcttcttcttcttcttcttcttcttcttcttcttcttcttcttctaaacatcatgttcgatcttcttgttagcaggatcatacctaaaaatttggggccaaggaataagaattgcaccctaaaagaaaaatccattccaaattagtggaaccagagaaaaggagagcttttttttaaaaaaaaatagagttggatatctcaaaatatgttactcccccggtttcagattataagactttatagcattgctcatattcatatagatgttaatgaatctagacacacatttattaacatatatataaatgtgggcaatgctagaaagtcttataatataaaacagagaaggtagaacacattgcctttatttgaaatatggaagtcctctaatttttgggagccttgtgccaaatatgcacgccactcccaatcgacgggcatgcttgtcatcctcattattcaggcaatttggttgagctatatttgaaatgcatgttgagatttttggatatctctacgactctacctgatgataattatttagattatctgcacgaacctaaaaagttataacctaaacaaggtaaattaccatgtttaggtttgtgatgatgttctccaagagcatttcaattctcctagttgccccaaaagacgccaaattgacgatattaatagaaacagagaagacatcgaacaaaacaatagggcaagtggactgctcagcacaaacagcacatgcaacctaatgatgtaattaggtgcgcactcaacactaattatcatgtccgtagctacacaacagagttaaagtaacactattgctccactcttgcaccagagaccgtgacaatgtccaaaacttagtataaaaggtaacttggagatgactataagagcaagtttaatagtatactggttccaaattatatatagctaatctaatagcctattcatacaatagttaactatagaaatatactacactattaatacccggtcccacttttcatacacacataacgtcttgaagtccgtgttgcagccggctacaaatctgtagtctgctttcttctctctcttatctttttttctcgatatgtgattatagctgatttatagcttgctattgtacctgctctaagaaatgaactctttcgatgatgtagatttttgggccaaattctggtggtgtacatgaaaaatgcataattagatatagtgcacaaattgaaaatactctacgcgttcacaaataacagttggttttgactttgagttatcctatttgaccgaccattattttctaataatgtaactatttaatactaccagagttgtatcattaaatctgtaatcgttatctaatgtattacattcaagtctattcgctttaacgtctcggtaaacgattgattttgccaacatatacgtagagtacatcagtaatccaccttggttgtagctctttaactaaagcctaggattatattccattatataaaataacatcggtagtgcaccttaggccatgctcttttcagctttttctctagattctcgtcacggattagttgctccacgcttctaacattacgatttctaaaaataaaattactttcaccgtattatttagatcactttgttacagattttgggaagtttatttcttattaaatattgtgctaaccaagtaaacaatccaacgaaaaagaatatgttccaaacaacccgtccaaataaagtgtttcataggtacctagccgcgaaaaaggccgctcttcacgagattcccaaacatcgtcaatttcttcaaaccgatccacccccgatgatatcgcctttcaccgtcgcatacaaatagagacgcacccccccccccccaccacctcacccacacacccacactctctacccccaaacttgccctccaatctatctccgccgccgccgccgcctccgccgcgagagggcgtcgccgagctgcgcgggaggctcgcctcccgcagcatctggccggattcgtcgtagtcgaggcagctgtaagcgagagagagggagatggccgcggccgccgggaaggcggcgatggagcggcaccagtcgatcgacgcgcagctgcggctgctcgcgccggggaaggtatccgaggacgacaagctcgtcgagtacgacgccctcctcgtcgaccgcttcctcgacatcctccaggacctgcacggccctcacctccgcgaattcgtaacttacttgcttcccagatcctgttgctcgtgcccgccacctgttcgatcgattgcccacacggttggttggctttggttttggttctcttcttgcaggtgcaggagtgctacgagctgtcggcggagtacgagaacgacagggacgaggcgcggctcgacgagctggggaggaagctcaccagcctgccgccgggggactccatcgtcgtctccagctccttctcgcacatgctcaacctcgccaacctcgccgaggaggtgcagatcgcgcaccgccgccggatcaagctcaagcgcggggacttcgccgacgaggcctccgcgcccaccgagtccgacatcgaggagacgctcaagcgcctcgtcacccagctcggcaagtcgagggaggaggtgttcgatgcgctcaagaaccagaccgttgacctcgtgttcaccgcgcatccaacgcagtccgtcaggaggtccctgctccagaagcacgggaggtgcgtcgatgagctgtccccttctccgatgctctcggtgcgtcgggaaatgctaaatctaatgctcttgatgttgactcgctgtgcaggatccggaattgcctgaggcagttatatgcgaaagacatcactgctgatgacaagcaggagcttgatgaggccctgcagagggaggtaagttgatttttttttttgtcaatttgtggttacaatattataaagtcaatcatagcaaaagtgtccaccgcaccattttgattattttactgcttatcagctcaatggcttctttttcttgatgacttaaattatgggtctctgggcttaatgagatttgtatactctcaggcagtagcttaatttagaattaggtccatcctaaaagcttaatttagtcgaagtggcaaatcatgtttgtgcctcttttatctatgtggtgcctgtcctgctccatgatcttgccaaataatttagaaatcttatctctattgtctgtacaccattcttttatattagtttatttggacaaggatttttttttttacattagtttagttggagacaaggaaaaacattgaacactaggtgattatttccagatcctcaaaaggtgtttacctatcacgttcataaattaattgctctgtacttttggactctgtcttgacagttctgaagtccatctccaatagttttcttttgatacacttgaaatgagagctctttttgctagttctgatttctgagtgaaattcatcttcaatcagagaagtgctatgtgcatattgcaaagtttatgcagaaatgtcgtgttggtttctactactctgttctcatcatgcctttctgattgtgtggtttaacacgcttcacagattcaagcagctttcagaactgatgaaatccgcaggactcctcccactcctcaggatgaaatgcgcgccgggatgagttattttcatgaaactatatggaagggtgtaccaaagttcttgcgccgcattgatactgctctgaaaaatattgggattaatgagcgtcttccttacaatgctcctctcatccagttctcatcctggatgggtggtgaccgtgatggtatcttctcctatcctaacttatacatccatttttgtttagaaaggaaaacagaacttggttgagatctgtcacatgctcacatgtgctattgacagaaaattggcttgtttgtcctcttagtgacatcatggtattagttctagcaattggttatttattccccttccacacttttaagtcaacaaagattccatttttttcaaataattgtattattcacttgtctaaatatattttttgagataactgcagccttttctgctccctgtaatcctgtctgttagaagaagttgaactctaaaactgacttgttttctaggaaacccaagagttacaccagaggttacaagagatgtatgcttgttggcaagaatgatggctgctaacctgtacttctctcagatagaagatctgatgtttgaggtacagcagaattgcttattttcattgttcttaaaaaagtactgcaatactgatttctaagttttaacaatgcaatatgttttcctagctctctatgtggcgctgcagtgatgaacttcgaattcgtgcagatgatttgcattgctcctccagaaaagctgcaaagcactatataggtaacaataccataactgtggtgataatgaattttgggtcggcctgcgcatttgttgatttgtgtatcattttatagtctgaaggaaaagctgtacttttggtctgcttgcccttctctttttagcatatgaagtaaccattttcaagttttcagatagagttctaatatgatgttcatgcatttttttaatgaccaatatatcattttcttagcctctttttctatcatagccacctcatatgcttgtctataagatctgccatctttcctttaatttttatcagagttcacctgtactgtaaaatcttcaggtgattttacacttgaaaattgtgcttgccaattgccaattgtaatgtgtatattgtggataccagtgttgaattattagtcaggttaatttgaaaaatgcatctgctagttcagaatccactagaactttaatataaagaaattatttgtttagccaaatataattaggctgacattgttcttccagaggctgtgaaatccctactcaaaacatttatcaagttgactacagtgatggactaaaatggactggacgtttttatgtctaatatggatgcatcaactcccggcataactacattgattaactacatttcatttttcctcggtttgttactcatttagctgatcaacctgggtgaaagtcatgcatgattttataattgactgatttgtactattttttagcaaatgcctactaaatttgcctcttactgagaaaatgttaatggtgcagaattctggaagcaaattcctccaaatgagccttatcgtgtcatacttggtggtgtcagggataaattgtactatacgcgtgaacgtactcgccatctattgacaactggagtttctgaaattccagaggaggcaacgtttactaatgttgaagaggtaatcctatttatcttatatgtatcattgtgaatgtcattgttgtacttatagtactcaattatcaccctcctatcttgcagtttctggagccgcttgagctgtgctacagatcattatgtgcttgtggtgacaaacctatagctgatggaagccttcttgatttcttgcgtcaagtatcaacttttgggctggctcttgtaaaacttgacataaggcaggagtctgatcgacacactgatgtccttgatgccataactacatatcttgggattggatcttacgctgaatggtctgaggagaaacgccaggattggcttttgtccgaactaaggggcaaacgtcctttgtttggtcctgatcttcctcagactgaagaaattgctgatgttttaggaacatttcacgtccttgctgagctcccggcagattgttttggtgcttacatcatctcaatggcaactgcaccatctgatgtgcttgctgtggagcttctacagcgggagtgccatataaaacagcctctgcgagttgttcccctatttgagaaacttgcagatcttgaagcagctccagcagcggtggcacgactattttcaatagactggtacatgaataggattaatggcaagcaggaggtcatgattggatactcagactctggcaaggatgctggtcgtctttctgcagcatggcaaatgtacaaagcacaagaggagcttgtcaaggtggcaaagcattatggtgtaaagttgacaatgttccatggaagaggtggaacagttggcagaggaggtggtcccagtcatcttgccatattatctcaaccaccagacacgatacatggatcacttcgtgtaacagtacagggcgaggttattgaacactcgtttggagaggaacacttgtgctttagaactctgcagcgctttactgcagctactcttgagcatggaatgcatcctccaatttcccccaaaccagaatggcgtgctctaatggatgagatggctgttgtggcaacaaaggaatatcgatcaatcgtcttcaaggagccacggtttgttgaatacttccgatcggtaagttcacctctattctgaattctttcccataaaatctgctgcagttccgataggcgtaaatttatgcttaatttcaaggcttcttgacaagaccattctctaagctaattagatatactcatgagttctttgcagtttgcatagagcgtgtggtctgatgcgaagttgcatgacaaatgtgtgtaggccatgataatttttctaagcttcatgtccacagttttttgcaattttacttaactatgacaagggatcaaatactaatgtagagatatgctccttctccatcaataggtgcaccttcatgctccttctccatcaataggtgcaccttcacattctcttgcctgtgttaatcgactaagaactaccatatagaagggattgcatacatattttggttctctgttgtcagtcacttcgtgctttatgttatctcttatctgagctagatgttggtggtgaacatgaaattctgacatgtgtgtgtccatctgctgttccaggcaacacctgagacagaatatggcaggatgaacattggtagccgaccatcaaagagaaagcctagtggtggcattgaatcgctccgtgcaattccttggatttttgcttggacacaaactaggtttcatcttcctgtatggcttggatttggtggagcgttcaaacatataatgcagaaggatatcaggaacatccatacactgaaagaaatgtacaatgagtggccattcttcagggtcaccttggacttgcttgagatggttttcgccaagggagatccaggaattgctgctttatatgacaaattgcttgtggcaggtgatctgcaatcctttggagagcagctgagaaacaactttgaagagacaaaacagctactccttcaggtaaactactctagaataagaatgggctatacttagatattaagtttgcttgcatttaagctgcacctttctttttatcaccagatattggctttaacccacaccagtggttcttttagagtttttccttgagatatatatgatcctgtttgatgtggatgatatgatcctgaagaaatcatcaaaagatttatgtttgaaaattatactgaagacaaatctggaactacacctaggcattctgaatcataaaaacaaactccatgttttaaataagagtgcacatcatatcatcactgaatcttttcgcagtctaagttgcgacaactgagatctgagaagttagtgcccttgacacattgaaatcatctgcaggttgccggtcacaaggatattctggaaggggatccttacctgaagcagcgtctgcggctgcgtgagtcgtacatcactaccttgaacgtttgccaagcctacaccctgaagcggataagggaccctagcttcgaggtgatgtcgcagccggccttgtcgaaggagttcgtcgacagcaaccagcctgccgagctggtccaactgaacgctgcgagcgagtacgcacctggcctggaggacaccctcatcctgacgatgaagggcattgctgccggcatgcagaacacaggctagattgtccacaagaatgcttccagcaggtgcaatcaatcaatcatcaataactccttccatgatgagatggtgaatatgtttaactagtacgttcgccgatgctagtgaattctggagacttttttttgctcgcacgttttcttttggttgtgtacttgatgtaaatgtcaaggggggacttatttggcttttgcagcccgatccaaaataaaatatggaccaatcattctacgaagcttgattctgaacgcttcgaatttgcatcagtggtgacagcggctgtgtttgcatctttaaacgacagactaaaagcattgtgcaccgcaagatgcagacttgacatgtgcttatagcagaagtattacatggagcacatctcaggtgagggaaaccggaacacacctcttctttcaatgtgcttatagcagatttattacatggagcacatctctgtctttctatcaaatgatagtccttgcgtattaagaaagggctttctagagattctactggtcctgttggcacatatgaaagcagcgaaatgccttacctttcagcaaagattgcccactgttaaaatgaaggttctcttgcatactttaggatgagcagaaacaaatggttttagggtgtattcatttctcccctttcttaaattttcctctttcgttttctacgcatacgtttactaaactgctaaatagtatgtttttttttgaaaaaaattaaagtttttttaactaataattaattagtcacacattaatgacttgctccattttacgtgcgctaaggagaagatcccaaccattccaaataaacacaatatagactatagagtttctccatatgtaaatatcttttgatcttttcatttataaaaaaaatattaactactgggtttgactagtagtgttgctccttaaaaaattgttaagtccttttttaagtcactgaatgcacttccagtaattcagattacgaaactgaagagtatccatgacacttctaatatcattctagatggtcaaaagaaatgcttctcgtaacatttgtttctttttttaaaatctcatttgagtgcataactttatacttccgctgttacattaaaaaaccaatctaaaatcggagattgatttttttacgggacagatggagtatgtgctatttgtagatattttacttcgtcatctatgaactgaactacccatttcttgatgtgtcttctgctcggcctgccatccatactttagatccattcttcgggcttgatggacatttgggcccatttccatccgtcctggacaggacagaaatactttgagcccattaacttcctcgctgggaagcccataattctagccattcagaaatgctgtacactttctttggtttatagaaaaaaaaacatatgaattttataggatactaactttcctttaaaattcctatgaaatgataaaccatttggattcttccatttacatcttacaaccctatgttattctactagtaatatatgcctctgcattggaatagtcccatataccactataattagactggttatgtatctaacctaaagattgcaacgggcctataacactgtgaataggttgactgtactccctccgtaaacaggaggagccctaggttagattttttttggacggagaaaatatttcttaactaactactttttatttggagttttcttttttatgcgagagtacgtgatgcatgcctaagcagtgagggaacctgtttgggggagcttaagaccctatttagatgggactaaaacttttaagtccctatcacatcggatatttagacactaattataaatattaaacgaagactattaataaaacccatccataattttggactaattcgcgagacgaatctattgagcctaattaatccatgattagcctatgtgatgctacaataaacattctctaattatagattaattaggtttaaaaaattatctcacaaattagctttcatttatgcaattagtattgtaagtagtctatatttaatactctaaattagtgtctaaatacagagactaaagttaagttcctggatccaaacaccaccgaagattctgagaagcagctgctgagaagctagctgatgagaatctgaagaagctagaaaacccagcttctggcttctagtttattttccagattctacaactgcagattctcagaatctggataaaaagctggactgtttgggggagcttctagcaactggagattttacgagaagttgcagctgttaaaagctcctctaaacaggcccgagttttactttctgtgtgagtgcagtggggagggaaaaccaggagttctttttttttttttttgagcgcgttgtgcgcaagcagggaagaggaggatggctccccttttaagatagtagagatgtcgtacccggacattgaaacatattgttttgttattttcccttagttttgagttttaggtgttccaaatggtgtggcctagtttgaaacatactatcatttactggattattgtcgtagattttatctacttaaaagtataggggtaagttaaataattgaagaaataaaattaagaagtaagagatctacattatgcagtagaagtatattttttaggaaaaaaaaatattttttagtggcgtagagtgaataatccgtggtaatattctggtaaagtagctgaaagcctgaaaagaacatgctattaatatatggtgggctgattttgtttgtctctaagcccattattcgcccattcgtcaatataataataggcacattatctttacggaactagctatgtctttgtcgacaaatccttgggtcaaaatcacccagattttttcctaccgttagattaagatccagaggacacaaaaaatgctacatatttttttctctgactaatcagatcacaaaactacatgggctcgaattctagcccatagaacaatacaaaaaattatacaggccataactgcaaatacatcatggcccataatgatcaacttcacatccaataaaggttagaaaaaaacaaaataacacagggagaccacaccagttcgcacaaatcccctagatcgagcaaaacaaatcgagcacgccatagacagtgaggagaacgagaaaaagaagaagaagcaaattcttaccaagaacattgaggtcaagaagttgaaatcaacaagacataatcttccaggtaacaaattacctagcacaaaatccacctttacctttccccattgacttcaccatattctgccagtcatcttttaaatcaaacaaaaaacaactcagttctgtaaaaatattggagaaaagcacttggaatagtgaatttcttttggagaaaagtgcttggaataggaaatttctttagatcaagtagttaaaagtatgtaactttttcagaaaaactcgtaacaaaaactatcaatccatagtcagttacagttacaaataacaaaagttacatatataactacagtacatctaaactgtaactgggctgtaaatggaatcattcttaaatttcttaaaaaattcagtacttatactgcgacattaaaacatttccccaattataacaagctctaaattatgttacaaatatataaagaactatctatctatagtcagttacagtgagaaataacaaaagttacagatgtaactacagtacatttgacgaggttaaacttggagttataactggaatcatcctttgatttttttttaaaaaaattcagtactcatgcactaactttttttttgcctatgacaaaatgttctaaattatattacaaataacctaatcatgtagggtcaggtatattgcaatctcaaaaatcaggagatacacaatcagatggatatgaaatgagaagcaaaattgtgtctgaagaaatgagaagcaagaagacagttaaaggtgagaatcattctcacctagcattatggaccattttttatcttgtcagaaaatgtcatctagcaaaaatttatatacaacaaattagagatagtagcatgataaatttttaaagaactatatatctatatccagttacagtgagaaataacagaaattacatatgtaactacagtacatattgactgtaactgggctttaactgcaatcatgcttgaatttcttcaaaaaattcagtactcatgcaacagcattaacatttttttactattatgacttgttctaaattgtactacaaatgattgaaacatgcaacgcctgatagattagaagctcaagcaacagtgaatacagagtcaaatagatgtcaaagtgacaaaattttctcagaaaaattaataagcaagaagacacttgaaggtcagaacaatggacagatagcattatgcaccaaatttgatcttgtcagtcataaaatctagcacaattttgtatacatgaaagcatgatttttttttttgaaaaactatctatctccagttacagtgagaagtaacagaagttacatatgtaactacagtacatattgactgtaactgggatgtaactacaatcatgcttgaatttcttcaaaaaaattttgtctaatatacattatctaaattatattacaaataacctatctatgcaggttctgttacaattcgatctcaagtaacagtggatacataatcagagagatctgaaagagataacattaatttcgtctgatgaaaaaagaagcaagaagacaactaaaggtcataatcatgataacctagcattatggtccatatttgaccttgacagacaatttaatctagcacatatattagagatggcggctttgaaaaatctaaagacctatctatctatagtcagttacagtgagaaataagaaaagttacatatgtaactacattacatctgaactgtaactaggctataacagctttcatgcttgaatttcttcaaaaaaaattcagtactcatgcagcagcattaaatattttcccctattataacaagttctaaattatgttacaaataatataaacatgcagggtctgatgggttacagtctgaaaaatcaggggatatgcaatcggagagatatgaaagtgacaaaattttgtccagagaaataagaagcaagaaaacattgaaaggtcagttatcatgctcacctagcattatgcaccataaaatgatcttggcagacaatataatctagcataaaattatatacaacaaattagagattgtagcgttgataaattttcaaggactatatatctatagttagttacagtgagaaataacaaaagttacatatgtaactacaatacatatagactgtaactgggctaaaactgcaagcatgcttgaatttcttcaaaaaataaagaatttcttcagaaaaggagtcactttgtcacaatggactgaagattttcctcaagtgaaaatcatcttcagacagtggtgtttaacaaagcacaacaattagattagagcctaggataaaaaaaacagagcattgtggtccaaacggtcatatctccagttgtgtacaaatttgcccatatattaaattttgtacataatttgcacatatctcaaacttctgtgcacatatattaaaatcactcgacaacaagatgtgacaagttagctgatgcagaagggaatggaccagaagggaatggaccagccagggtgttgttgttgagcctcccgattaaatttcacagcaaatgagttaactgactaacaagctccacacataattaacatgggaacaatattgggatgggacgatgggtcattcagaataaagaagaaaaaaaatcatacagatatttcaggcatgtgaatacctccaggcacccaagtgaccttggttttgctaccattgaaatgcattagatcaacattagactgaaaccctccaaattatttttcagtttgctgaagtatgagattttaaaaagctcatgtcgactgaaagctcatgcctgctccaagattcaaaaaatactgacaattcaaatagatttacgagcgtgctatcccctgttcccaattcagaaatagtgccaattatgttcccaagttcagaaatagcgccaattcaaacagatttacgatttacgagcgattgacaatgaacaaaagttcagaagagaagaaagagcagatgcaaccaatagcccataatttctcaaagcaacagggaccaagttcaggtattggcttgctgctaactcatttagatcagcactgaaaagttcagaacatgtacaggaattttataaaccaaatagtactgtagaatacaatctgaagaaagcagaacgcatgtaggggtttgggtttaatttaaccaagcaactcagcatactgggaaatcaaaccgtacatctctgaaacgaaatgattcatatgctgcagaaggtaacacaaaacatacttggggttcagttagcatgcatatgtaaaacaaaattcttcagatgcataagaattcagatatatgcagggagttgacagataaatcatctctgaaacgaaatgcttcacatgcagaaaaattcagactcatgcaaggagtttaacagatcagtcaactaatcactgaaagtgaaatgcaacattcagataaagttgcaatgatgcttccctactatattcaaatcacacataaatcaaagcaaaaataatcaactcatgaatctgaccccctccctgaagaaaattcatgcagggatccaaaaaatgatcaactatctgggtgattagaaaaaacccctaaatccacctcgaattaaacctttaactccatcaaatacccctgaatccaacccccaacatgaacacccctaaagaaaaatcaaaccaaaaatacaaaaaccctcgtggattagaaaaaaaaacatagaacaccatcgaatctggtcgtttgcaaacaatggactagtaacaaaacaccctagactgaactgaatcaaactataactaaaaacttagggaatccaaaacctaaacggattccaaaactaaaacaagtgattctgaatcagatccatatgttgggagcaaaaaaaatcgtcatgtattgacccgaatcttctaaacctagccctattgacattgaaaaaaccaaaacacaagctaatgatgccagcaaatcagggaagaaactcaaaaaacactctctctcgagttgtctcccctagcgagcgcgcgcgctctctctctcccgctggggagctgctcgtgctctctctcgccggcgagctctctctctcgacggagaaaacgagaagagaaaagaaagaggagaaagagatgtagagaaagagcgagaataaagaaagagagcgaggaaacaaccaacggttacggacataatagcgcggaatccaaaatttaacatgggttggcccacattgactcccaggccatctgctcacaggccacacggtctcatccacacagggaaatgcacgaatcatggcgcaaatcctacggatagaaaaacgacaaatattgggggtgaaaatctgttgagaaagatctagcaaaatcgtatctttactgttcaaaacactgtttacctattgagtcatttcgttttcagatttgaaaaagaaaacttttagcccctgtttaaatctcaccttaaaattttttacactgtcacattaaactaatcgcatgaagtattaaatataagttaaaaaataactaatcgcattgcgactaatttgcgagacgaatattttaagcctaattactccatgttttgacaatgcgatgctacagtaaacatttgctgatgataaattaattaggcttaataaattcatcttacagtttacaaacggattatgtaatttattttgttattagactatatttaatacttcgaatatacgtccatatccccttaaaagatctgtcgcatgtcgacgtcgatctgtgcacgcgcgtcaggaacaaaaaccagaaacatttttgtcatctggagaacttggcacgtggacccgactagtagcggtcaccatgtcccgttttcgacgatgacgaccgatcaagcgtacaaatcacgcacgatactcgcacgcgtagcaatgacagcatcatatttccgattttttttctttttggtgaacttacaagttttatacaggtaggtggctcgtaaaagcaaaattgtgctccacatatcatatccattttgacataagcagctaggtcagcaagaacacgtcaagcacaaaacgagaacttgaagacaaaaataacgatcaagggcacgtttggaacgcaagatttgaacaatacgaaaaacacaggattagaatatcaaacatgcgcaaacccagctagagttcaaaacacaagaattttggggcattgcgtttgggtagtttataggaatataaccatagaaatttgatggaattaagagagagaaagagattaaaagacgcattggattcctcaaacgaaaaataaaatggagcttgaggtcacggtaaaattctcgatgcataggatagggaatttgacttgctaaaattctttgttccaaacatcgcatttaagaaaaaaaatcaagggttatcatccttaaaattcccttgaatttctttcgatccaaaggaaagggcccataaattttttgaggaattttcacattaatcatttcaatttcactagtaatgaaaaataaaaccctaagttcaccgtcagatatggaatttcaactatcacatattcacatgaacagtgtgaatgagacagaaaatacgtagatattattgtcggaattgcctgcaaaggctgttataggatactgaacatagcatactgaacaaaagaaacgaaaatgtagcctctcccaacctacagatgggtctctgaacagacgaacatcagcaggtcggccttctacttggacctaagagatgatgagatgatactctcagaaacggcagttaccgattccgcg

SEQ ID NO: 61365 - DNA, 794 bp, Oryza sativa
acgacagatttacaactagttttttttatactagatttaaaactagttaagatgtcgagacccaaaactaacaacttggatccgactgagattaatgtatcaatccctggatcagtaaaaattgatacatacaatataactggttcttcattgcatacgttaaagtcttacaatatcaagggttttacaataataggtactcttctaactgattaatacacagcggaagtttctatacattctgactagtgaggtataacctttagggattttctaaattatcgaggtcttcgtagtaatagtcataagggtcctcttgacccaaatctgaaaaagggggttataagagcaaggatgagtattcacaatactcagcaagttatctcggaaatataatatgcattgacatataatggggttctttgcaaaaaaaaaagcaatattggacaatctggaagaattatagcaagatttataaacatataaactttaagtttctaaccagggtaccatatgagtcccggtactcaattcgaatagtttcaaagatattctactgcagtagatgtacgctttacccgcagtccacgacttgctgataattatcggctttagtcatggcccagtattaagtcattaacaattgtggcacctgttccatgaacttgtatcctcatatgctctgaacgtaatattaacagcagcaagaggagttctggggttcccgaggtatttaaggggaactgatcgtatgacaccacgtcatctcgatcagggtttagaaatataaccat

SEQ ID NO: 61366 - DNA, 2767 bp, Oryza sativa
tttaaataaaatttaaaaataagaaaatagggaaaataagataaaatgcaaaaaaaataacaaaaaggggtccaaaagatagagaatgattttagaagaatattggtccaagtttcactggaattggatctatattttaaaagatatgggcttctaaagtttgaaaattgaataaaagagaaatggcactgtgagcgggtcccacctgtcagtctctctctctcttctcttcttcaacctccggccgttccccaaatcgggccagcggcgctagggtttaggattgcggcggcgctagaggataaaagtagttgcggccgaggaggggagggagctagggatctccggcgacggcgagcggcggcggaggagttaatttggtgcgtggacggcttagcggctagggcggcggtggcacggttaggccgagatagcgatcaaaatgataagggttagacatggctaggggaggggttctagagcatctacgaggtatttagagggattccgacagcttgccgacctttggcaaggtgcggagaatagttgccgacgagcacctccataggcgacggtcgtgctcacgtcggcagctcagagggtggtgtgttagtgcaaagggattgctaaaatagaatctaggtagtatgtagatggttgaaacggaagaactcaccgagatcggttgaaacgacggattgcggccggaaaaacttcgcggcggtgaagaacagagcagcgcgggggcggcgatgctcggcttgatgcggtgaggtaaaactcgacgcagagctttggttagggcttagtatgctagaacatggctgatataaggtgttctatgaggtatttagggcggaggatggatggagaagggtgaagtcgatcgcgcacaaggtgttcgaccgacgggcgagggtggttggtgagacggattgatgaagcagagcttcggggttgaggggctatggtcatggatgatcgatgatggacagggaagggattggggtcctatttatagggctaggaggagcggatgagctcgggcaccgtcatcgccatggatgagctcgagctttggatatggttagggcggcagaggctgagagagggcgggcaagatcaatttgagtggcgggaggccacgttcgaatacttaccggcgaaggattgacttgaccgcggttggaatcggctggcgacgtgttggcgccaatccgagcacgacgcgcggcagcggcgagggtgaaaacagccggcatgggggtgaatggtttgaattgagggaggggataccaccgtctatcttcaatctaaccgtgcggcaagaattggcgcgattcatcccgggtagaaacgaaatcgcactcggcggcggcttggacgggagcgcacggcgtcgagcagtgatttcgtgcggcggtcgtcgtcccggctttgtcgtcgtcgagattggtgcggcaacggtgggttgaaggcgttggacgggcggcagcgcgccaaggcggttgggcacgcgcgatcgatcccgagaccgacgcgcggcggctcggcgcgcggcaaagtcggctgctggtcggcgcgcgtgaaagggaggaagaggtaaagagaaccacggttttgagtgggatgtggtcccctaggaccaattctaaactttgcataagattgggttggagttgggctgctctagctgggctgggcattctgtcgagcaccttgagtgcaatgaacagtagatttcaggaattttgaatatttccctagaaaagatttgaattcaaactaggagtttggaagggtttcactagggtttaaagtatggcaaatccttactaacattagggtgaactaagaaaataatctatggtttgaatttgagagaatttgctcaaattcactagggtttagaataaagggaataaattggaagggttctaataatacttgaaccaattttgttaaataaacaagaaatagatttttgaaccaaacaaatttaattaaaagccagcatgatgcagtcaaattttagtttaaaatttgaggatgttacataagattataccatgtaatttctcaaaaaaaagattataccatgtaatcaaattatatatgtcacatgtaaattttactcatcaaaatattatactttaaaagtgatttatgatcaaaattaaaatagcactaacactcacaagtcacaactattcaaaatgaagggagtatatgcatttcggtatgtagcaccagcctaaaggagtatatacaggctggctaaagtcgaatccaatcgatgatagatgtagcgctgcatgctatagcctaaatatagcattgcatcggaggaacagataagcatccaagattgctagcaatatactctctggtatgtatgcaagaaaacaaaaataaagaggaaacatcaaaatattaacagtaactacaaaataaaattgatttttttaatttatttatttttaatgataagggggcggggaggctcctcacctcaaggatggtaaaatacctctagagaaaaaggactccccactataaaaacaacaaagctagcagtcaaacgactatggaatagagttggcatctgtaagtggctagtaatgtgctgcagtgtcctggttgggttggcatcttctgatatcaaaagaaataaatcaaaaataagccagagtaaaacttaattagttatctgatagaaagtcatatagttttcctaacagtatgatttaaaactctgtataatgat

SEQ ID NO: 61367 - DNA, 2468 bp, Oryza sativa
acattccaaaatgcatataatcctttcattttaaatagttgtgacttgagtgttagtgctattttaattttgatccttaatcactttcaaagtataatattttgatgaatgaaatttatacgcggcatatataatttgattacatggtacaatttttttttataaattacatggtataatcttaactagatgtagttaaatctagtataaaaaactagttgcaaatctgtcgttaaaatagtagtcaaattaagtgtggatatgaataacatgtagtgacaattattttatactaatgtagtgactataagttatattttggactgggaatgaattgttaccaaaaaaattatgctactgaatatatcatgataattaattaagccctcttattgcaatagcataattaatgttttagacaaattatatggttttagagatgctgaacatttttatcataaaatttgatacctcactagcgagtaccacaaaaccgctctttaaaatactacatctgttccaaaatataataaattttaacaataaaactgcaaagttctttgtacctcaaacttatagccaaatgatatatttttgaatggaggtagtatgtattttctctgtacaatcatagatgcgtgcatacatatactacttatgtacatgacatgcctgaatttcttgctgctggtgccgtaggaattccgcacgaagcaccagaagaaggacatggccatcgagcgtcccctcatctcgtcggactccatgttcctcaaagccatccttccgacgctcaaaattttaccatgcaaccccctgaccctccatggcgggattggttcaagcagggttcccgcggaggcctttggtggcggccagcttttcagctgcccacttcaaattccagttttccagcagcaatcccccggcaatggcaacacggtgattagcttcagcaacaatgcttcaccgatggccatgcgtgcgccaaccgacaatactatgatatcgttcaacaatgtctctgctgcgccggtcgccaatgcggtgatctccttcagcaacatttctaggtctgctgccatgcaggcaccaagcggcaaggggggccaacatctgtccggtgatgtccagcagctggattttccccagcagaagctgtactttgggcccttctcctaccaagggcctccgccaccttccatgcacaaccacatcaacctactcccgccgacgtcctcccctgtgacctgctccatggacaaaggcaaggttcctattatcgagctcccatatgggatgcctgtggatgacttcctcgtcagtcaaaccacatatggcggtgccggaccatccatcggagccactgacgctgctgccgctgcgtacccttacacagatgcaccgagcaataacgttgcaactggctgtctcatggtgccaccaatggggccagcattcagtatcactgagccaactgtggtggcccaaggtgagggcaccggcaccggtgtcgacgccggcacatcagagaagaacgcgatagtagaagcaccaaacaaccccgcgccattaatggtactggatcaggttgctgctgatgctgcaatggatgttcaagaagacatcatgttctctttggaatctcttctggggccggactatgacctgctacctatggaagacgttagtgctccggacaccgctgcagccggtgatgcagctggtggctcactggacggagaggaaggcggcatggacattggttgggatctcgacctggatgacatcctggtggagaacgttaatgacttcgcgttcctggacaaccttgccgggagcgagtagtcagtagtcatctcatcgcaaatatattatctcaagttaattaagctagagattagagagaggggatgtgtgctcagtatgataaaacaacttttagtctttgttgcaagtactctaaacattgatgatttttcctccgttatcatgccaggaatgtgaacttttaaaactccaaattcctatattgcagatatgatattatgatgcaagatactggagtattattttgagacatagtaagtattttgttgcattcctgcgctccggcgtcgtcgcggactaggtgcctcgcgtggctgcatgccatgcacgccgctggccgatcgaagtggttgtttcggtcgcatcttcctctcgtaccccgcgcctcctcacctcacactctgcctattttccaacaaatgaaggctcacactagtgctctgagtgcaaggatttctggtcacaaataagtattttgcgatcttgaataagttcacaggggtaacagagtgagaaataagatatactcttcatctatgaatacaagggttcctagtcttttctattcatccacaaataaaatggattttagagtacttttccgctccaactaactactttattatttattgctcact

SEQ ID NO: 61368 - DNA, 9629 bp, Oryza sativa
tttcctttcttctactcgggaaaaggaaaaaaaaggagaagaaagaaaaaaaagaggaggagggaaagataagaaaagaagaaaaagataaatgggtttcatttgttagtcaaaatgatgccacgtcttgtccgtgtggcatgccacatcagtgccacgtaggatcctataggggctggggcgatttgggacctaaatgacacactatgacaagttcttggacttggatatgtattttgagagtttagagacctagatgacatacccctgcaagtttaaggaccgcccgtgcactttactcttaaattaactagagaatgacaacaggatgcagaaaagctaaagaaaacaaactagattacaaaaaatcaagaggcatagacaaactagattacaaaaaatcaagaggcatattaaatttctgctaagttttcaacacatgaagaaacacaaactgatcgaaatggtataaatcaacaaaaaattacatcgtctagatataataaacatgtcatttcacttgccctcttttagagctattaagccacatgacctctatcaagcatgagctgctataatccacatttagacccatggtaatagtaaacgatattaaaatggaaggctacagcatccattcataactcagaaaaactgattgaagcatcaactgtaaaatgtgcagatagcaagggactccttacaggattggaaggaggaaggtacttactctgttcaccatttctatgaacacctccaatccctccagttacgaaaattggtatgccaacctgaatttgagagcaactttagtttgatatagagatgaatgattggcaccaactacatgtaacaaagatgaacaagaaaaaggctatcaaatcaaggaaagataaattaacagtaacaagagcagtaagatgtttttggctctgaccttatgagcgaaaaacatagtggcagaaactgttgttgcaccattaccaccagaggccacctttcaatcagtaaaactcgttacaggaagcaataagacgagaaacatatatcaactgtaaagttttagtgcagatataactgaacacattggaaaacattctgaacgaccaatttctagtgtgcaaggtactcacaacatgtgcaatatcccttctagccgtcttctgaaactgtcttccacttacagccaagctcttcaattgctcgccgctaaggcctatcacattacgaaaattatccggtgttaattggagaataattcatagtagctagcaactacggatcacgcctccagcacttgaacagttgaacatgtatctgatctccgagtcacaggaaaaatcacaggactcaccaacatgtggcacgccgttcagaatggctatggtggcaggaaccgccccgttctccctcacgacggcctccacctccatggcggtctggagattcttcgggtagggcatacctgggatgggaagaaagccaaacgcgtcccccagccgcgggcgcacatcgccggagtgagccatgtaatccgggagggagacggggtggggaggaggcggcgaggcgcgagcttaccgtggcagatgatggtggactcgagggcgacgaccgcgccgccgcgcgccagcgccgcttccacctccggcgacaccgccacccccatcggccccgtgctcgacgacgacgacgacggcgacatcccacggcggcgacggctctcctccctttctgacttctctgatgagtacgcttccacttccagtctctttttgggctatactaggctgcggccgacaaggagtattcggcccatgaatagtggtcgcaaagcgctcggcccacccgagatgagggcccatgggcttggttggccccgcacgtcagtgacacgttctggggttctaacttctcgtgcaatcctgcccttttcagggtcaaaacagcggcgaaaaatgttcgagaaaaaaaaaacatgtttgtacggggacggagttttttggataatggatatgaaacccggtgtttgcttcaagtgaagctacaaatttttaactcagaacctaaccataacagaaataaacaatggcacaactttaagtttatcaattttgctatatatttatcgacaaattttcttctaaaaatttaacaaatataactacagtataatcgtagtgtaattatactgtaacttgtatgtaattacattataacttgtatgtaacttgcatataactttcacataattttgaaccgttatatttgtttcaacattcgtacaagtgaagaaggaaaaaaagtcgctgcatgcatatatatgagaggattcgttcccagacctccatttcaccgaaatagtatgttatggagagatttttaaaagttacatgtaagttatagtataattacatcatgattatactataattatatttgttaaatttttaaaaaaaaatttgtgaagaaatgtacaggtgatcccaacaaaatacagcgaaaggcagtggcggcaagtgccatactgccatgtcgtctcatcaccggataagccacgccgatctctcctatcctctcgccgacacaaaaaaccacacaagaaaacgcgcgccaaccaccgcatcttcccctccccccggcctctccgacgtcgaccatggccatgctcctcgcctccctcctctccccttcccctcttcccaccaccaccacctcttccacgtcgccgagggctgtcaggctcgcgccggcgaagccgctcgccgccactctcgcagcggtggccgcggcggggctcctggcgctgtccccggccacggcggcggcggcggcggccggggaggcggagttcaaggtgtactacggcacggcggcgagcgcggcgaactacggcgggtacggcgggaacgcgagcaagaaggacgcggcggagtacgtgtacgaggtgccggaggggtggaaggagaggctggtgtccaaggtggagaagggcaccaacggcacggacagcgagttcttcaacccgcggaagcggtcggagcgggagtacctcacgttcctcgccgggttccgggcgctggcgccggtgggcgccgtgctcgacaacctcgcgctctccgacgtcgggctccaggaccagatcgcgtcggcggacggcgtgctgtcgacggagcggagggacggcggcgggcagctctactacgagtacgagatcgccggcgccggcgcgcacagcctcatctccgtgacgtgcgcgcggaacaagctgtacgcgcacttcgtgacggcgcccaacccggagtggagccgcgacgaggccgtcctccgccggctgcaccagtcgttcaagaccgtcgaccccgccagaccgccgccggctagctcctagtcctagctagccattgttcgccgccgccggccggccggagtccacgacttgtctcgatcgagtggagagctagcagctgggcgaaacaatttctagtagctttgctgcccgagatgtaattaaagcagttttgtataaattatggatctactatacgcgtaatcaaacattgtcctgtaaattattttcatccatatagtatatactccctctattttcagtttataagatattttgacttttgttaaagtcaaactgttttaattttaataagtgatcaagtcaaactccctcactcctagagagtgtggtgcgtggaggggagggagaccggagccctggccgcggctagctccttcctcaccgccaccctagaggaaggcaccgtattcgtagaggtgagggaactcctggcccaacgccgcctaggcgttgaggtccagcgtgtcaacactggcgcggggaacggattcgtgggaagggctagacgccgacagccgcgagggccaaatgttgccggctacggactaaataggatcttgagagaagaaatcgaagccgttggggtccatcttccggcagatccggtgcgcggtgatgtgtggacggcggatccggtggctggcaatgcgggtggggtgaggcgccggcatggatggccagcggcggatttaaaggaaggaacggtgcgggttaaagggagggggcagcgttggttgggcccggcggccgccccagccaaggtcggcgacgatagatcgaggtggctttagggtttttgaaaaccaaccgagggcaaaagcaagggaccaccagtgtgggtggctgcaatgggatccagagcaagtgagagataatgggaatcggtaggccccataccaaatagccccaattagcaccccttgagggtgataatttttggggtgagctatttacaaatagccctcctgtttgactccccttgagctattttgtggctaaaaggggttaggggtgggctaaaaaatttcccatggatccaaacatagcctagatgtctttgtttttgccgcgagaaatcaacatgtcagttgacgcgtgtattatgttattaatatttactaatattgttatgttacttccctcccaagaaaatattttagggtttcttaacggtctgtgtagccaatatattgtatagtattattagccttttagcatgaaaatattttagatgaatgaatttgaataaaggttcctatcaacataatcaaataaaaatgtattactactactaaattacgtgtttcaaggaagactatgcgcagttgctcgattttgtgtcattttcgtttcttgccaactactccctccgttacctcgggacggttttcgagaactactttgaccaacaatatctataagactaatatattttaaataaagatagtttgcatattataatagttcatttttacatgattaatcttttaaattttttttgctattaatagtcaaaatttaaaagtttgacttcgcactattctaaaaatgcttatattttcgaacgaagggagtattattctacgttgctatatttgttttctttgattattcattgcattggttataagtctcaacggaattagcgtaccatttataggtgtcacctcaattagcacagtggtttcaaccttccaagtgccacctagaattaacatagattccaggtgttatctgaataagcagacaagttctaaccttttagatatcacccaaaataagcgtaccaatacaggtgtcattcgaacaagcgcatcagttcaggtgtcactcgaactagcgtacgaggctaggtgtcacccgaactagcatacaaattctagacttccagtctttacaggtgtcacattaatcagcgcatcagttccagtcgtcgcctaaattagcgtatcagttccagttgtcacctcgaatcaccgcatcggttacaagtgtggttcccaattccggatcaaaaaccgggggtaacggaagttgttgtttcctttttaggggtatccccggggtaaaataggggtccaataactcggctctaatcttaaaaatttctttaattaattaattaattaacatatatatccctttttactgggcttttgcagccaacccggctctcccaaatcacggtaaaaaggtcgtttagaattccaaacacggtgtaaaaaagcgcagttgaatcatcaattctgtgatggcaaaaccacctacctggcgcctataaacgcaaaaaacccaataaatctcgccctcgttgcctcccctccctgcctacccccatctccacctccgcctccacgcgtcgccgccgccgccgccgccgccgccgccgccgtccgggcagtcgaccgctgcggcgccgtcggagctccccgggccccgtggatgagagcggcgcggataaggtcgccgcgggcccgcttcgtctgcacccgtctcggccccgggaccccactgggctggatctaggtttggcgaggggggttctggaagcctccgccgcgatggaggcggaggatgccgccggcggcggcggcgacggaggccggtacttcaaggccgacctcaccggcgccggcgtcgtccagctcagcgagcgcgtgcgggagaagctgcgggagttcgtggacgactacaccaacaacaccctcgtggtacgacgccgccgccaccgttctcttcccttcccttcccttccctcctctcgcgcatcgttggcgctccgctcggtgtgcgggcagtgtagtgacgccgttcgtttgtggtttggattatatgcttgcaacttcgggattttagtctagttttgagcgccttttgtagtggtatgccgcggtttgtgtgagatatatgcctgtgcggaggagctaaaattttgctaaactttcatgtaacctagcccgaattatgccgctgcgcgctgtgtttaatgtttggtcctctgctgttagtgtaatcactcataattgccgtaagatcccgtcttctttaaatatgttgggtgtgttcgcttcctggaggtttggttgggttggaacgaaatgttgtttatttgctctaatgtagttgggttggaacggaatgttttttatttgctctaatgtagtgcccctgtatactgctgtgctttgtttaattgaatccagtcggtctaatggtgccagaagcactagaatattgtgtagttacctgaaacatgtcccaaaaaaaaaattctaaaatgggagcataatgtactgccgctccattgcttttcttaggagattcttttcgcgaggtgatcactgattagatgctaggagcctagaaattcttaaagttccttttttatttttgccatgtatggatggatattttggtctaatctagttaagtttatttatttaatactaggttaggagatcgatatctcctttcaagaacatgatcatgcagtgtagcaacaaagattacattatctcatacttgacttgtgattagtcaagttcccatgggtgctttccattttagttcttattaacacgccatttattttctatttccctttccccatccatcaccaaattttcttaaccagatttgctattttgacctcatcttcttgggcacaacactttactatccaaaggtgaccaaactgtgataagattgctgcatctcctcattgtggttatagcatttatgcaggaatctgctgctaggttttcctctacctttaattaatgacaccatttttaatcatcgtgggtagaattgacatattctgtctgaggaagcatcctgcaatggcatggaatacattgctttcagcacattgtattgccttgaattcattttattcattttcttacacactagaatgctaaataccatcctttaccttttctatgttacactgaaatgctcctagagaaagcaataagtgtacctctgttgttgttttaagtgcaggagtacgtcattttgttgctcgaaggtggaaagcgcaaagatgaggccatcaaggagcttgatgtatttctgggaaaggatagtcgcgcctttatttcctgggttagttcacatgtcatatagattgaatttttaattttttggcatcaactatgttgttaaaccaacctttaatatatttttgcatttgtgcacagcgttctctatatttttgaactaatgcattggggggcccccccttaaaggggccccccaaaaaaattttttaacctttcccccccctttttaaaagggggaaccttttaaaattgggggcccccaaaaatttttacctccctttgggtacttaaggtcaaattgatgttttgcatacatttaaccatcaaaagcatttataacatctggttagaggggcgtatgaaaatatgccacatcccatggagtataattttcctgctaaaagtaaccctgcagcatggctaggcgcatccatccacataagcaaagacatccatgccgatatggttgggctgctgcatgacccaactaaatcacattatgggtttaggccacgctcttttttagaggatgaatttagctgagtagctgcacgcaaaatgagaaatgtgattagtatatgattaattgtgtattgattataaaaaaattgaaaaataaatttatttcatttttgaaagcacgttctatatagaatttttgaaagcacactatttagcagtttgaaaagcgtgctaatgggaacgaggcgtagataagctcaaatagcactttagaaaaggcccttagataaacttgtttggaagtacatggatcaagatcaaccatctgcaagttcaagaacttgccatgtaactctttaatcaaatcgcaaatcatttgtgactgagcattggaaaagaattaaaaaaaatgtttttgatctttgcattggttttttaaataaattttgctactttaccattcgtgtgaagtggagaggttgactgtagtaaaaacgaaaaacactttttacctggattatttctgtatataatttgcaaggactacaatatattataattacttgttaaacctgaaactggtttgtatctactgattaatttagcctttgtcatttgcccatacaagcagttcaggttacagagactgtttcttgcctgaatccatcatttcttgtgcatacttctcataccacttcaacaaaatatccagtccagaacaataaacaatccttgcttatttacatgcatattactttatcaagtgtaactgaataccatgtctttcatgtaggttgtgggatcatttatctgtaaatttgcacctttatgtgcaaacacaagaacaactgcaggtggataataaggatgacgaagccccaaatgaactacctggagaacagaaatcgtcagagttgcagttgagaagcaaagatcaaactcatcctgagtgtgtaagtgaacccagtacaaccagaagtcggactaaaagggattggaaaggaattggtcgggagggtaatgaaaactttccacttagaagtgtactgaaggatattttgcatggtgaggagaaaaggtcgcaaaaggttaatgaaatacgacatcccccatcgtctaatcaacggaatggcagaaagcgtgacagggatgacgaaccgcaacaaataaaggtgtgtgatgtgataataggagatgcataatgcttgtgttaaccaaatggattgactgaaacactctgctgtcttgcatacttttttaatgattcactttttcattaacttgctttgtgttgcagctaaacatttaattgtttatacttctctaaattgtgcaatggaagattccttttaacacactaaatatgaacttttatagcatcagcacaggattataagaggatagtatcatgttagttgttaaaatgaaggtgcactgcgattttccacattccctatttgaactatacactacattgcaacaaacgttctttgcaactgatgaattaacaatttttcatctcatgaatatgcatatgtgggctctagctgtttgtgttttctgcaatacttcgcaattagaatgaacaactagctgatctagttattttttcatgtttctaagtgttggggaaatcaccaaatagccaatacagtctatgtatgtactatctacctgaaatattgttggttttctgctctaaaattttcataagggaatgttagact

SEQ ID NO: 61369 - DNA, 2099 bp, Oryza sativa
cacgggacctcaccaccttgaagtgcacttgcggctcctcaatgatgatgacatcgttgtcattgccgtctttgccaacaacaccggcatgggcagctatgtcgtccatggagtcacgaggaatcctttcttctaggcagcacctacgccatgcaaccactctccacaattgggccattgtggcctggtcgagtggcttcctgacgatataggtcgccttcagcaagaggtggttcaggaactccgtgtcctcaccggcaaccatctgctctggttccgtcgtcgacaatactgtatgacacgtatatgtggatgatgtggattgattgatagacgcgacgacgacgaggagtaacatctgagcacaagcttagctagctagcttacggtagatgacggggatgtggtgttcggtctcgacgacacggcgaaagtcgaagccggaggagaccacctttttgacatcgcagaggacagtttggacgtctgtcatgttgtcgctggagagggtgcacaggccagcgcttgcggtggtgtgcgttgccaccactagaaaagacaaggagtaaatgcagttaagagttttgttttgttttgtcttatgtgggagaagtcagttttacagttttaaattactatgttactacttattatatatgatataaatgactttaagtaaaatcatatattattatatataaccatatattatacacactgttaaatatttttagaaaattttatgactataagtttgtaacacaaaagttagggagacatgcatcccaaaagaggaattttttttaagaaggggagagggagagatctcaatagacaataggagtgtctatatataactgagtaaaatgagaaatgagtgaagtataagtgcaattgcactacagtataaaaaatccttcatagaaataacatgttttcttaaaagaatatttaatttggcacaaagcaagagcgcgcaaccgactaatttgaatttcagttgaaacaaggaagaacatgcatccatggagaaaggctataagatcagtgtttcaagtagttattttgaacaaaaccatatgcagaatcaacacagcaagaacatcaaacaggttggtcaattttatggaagtgaccaatgatgagtttactcactgcctttttaaacccacccaggatcaaaacatttgctagaagcaagatatatcaaagagatgccgagtgaacaaaaaagttcattttgtaaacaaatcctatagaaaacacatataacaaacaccaatattttctcaagaatccccacaagaatccacggattacacaacacaagaatccgataagaaaaaagaatcacacaagcgaaatatcggatctgtagtgcacagagaccaacagaaatcatccaaacaagctagaaaatcaaatgtacatgagtagtgcaaggtagaaagcgttttggttgcagttctcgtgttcttcgtgtcaccatccacgggcatgacacggaggccaccagggaagaaggagagctgatcctccatggacaaagagatcgatgtacaacaactacgtgcactcacttagcttgttcacagatgaattgaagtgaaactgaagggaagaacgtctgcatttgtaggccggcaaagatggggccttgggggggggggggggcgggttggagagataggcacaaggaatgacgtgtagtgtcatcatttgttttttccttcattatttttggggaagaaactgacgttgccctttgacgattaaaagttgggtgaaattaacctgttgtttcggtgtgtgagtaagggaatatgtcattagagctgtgcattttagcccttaatttcctgctcaaagttggaaaaaagaaacctttctgatcagttctgcgtgcacttatagttaattatgcatgcttgctccttttctgaagtgttaatataaggttaaaatcattccctgtgccaatggtaaattgtactacgctgtaccttaacaaaatggtactgcacactcattgtactatacttccatagagacgtttgccctcgatctcttgaacttttcttgtgttgcctctgagagac

SEQ ID NO: 61370 - DNA, 2378 bp, Oryza sativa
  unsure (1)..(2378): unsure at all n locations
aaaaatagatacccttttatttttataggtaggctaaaagggacccgcctatgacaaatgaacgagggttgttcggccaagaccttcctatgaaaatcgattttcaaaggtagtggttttcattatttggctagtggacgagacatggatggaggcagccaccataggaatattctcaaaagatgttggaggagtgaatccggtaaaattggttgttgtgttcatccatcttgtctaacatagatcgttggtaactaaacagtgataattaacatgttttattgttaattagtgattatcatttcaagactagtgctaattagagatagttagtatgttttgttgtaaattagtatttattattaaagtatagtgataactaatagtggtaactaacatattttgtattggggtttatatccatgtgtatgtaataccagtagacactaggattgagttcgtagtcatttaatttatagttgtttaactgtatagggattgtgtatgtgttgtgtgggtagggtagacggtctactagatgatatgtgaaggacacaacatcttcggtttcatgtaaaaaaatgaacattttatttttaatatgtaagatcatttgtgtttgctgaaacaattgtattatttttttacctttgccgccatatgtgtggccattgatccaatcgtggccggtagataacctggcaaaataaagaatcttgaaagacattcgatgttagaatgtgtctcatgcatactggctaagactatacattggtgttattcctatcccaaccatcatctttgaccattaattacactcgttacaatcgaaccaacatccaatcattaattaaggtcgatatccttcatcatgtttcctattactaaatatttatgaaatcaaccataatgccctaaacctatcagtctgacttcgattactcccttagtccacaaatataagggattctaggttgtttagcaaagtttaatgttaaggttaaattactatgatgcccctaaagggaccttgaggattttgatgttgcctaggggatgaatagacatttcctaaattataaaaactttgcatcttaattagaactagttggagagtcctgtcatggtctggacaatacgaccaacacagagagaatgaaaacgtccttgtgagataaaactgtgacatcttggcccaattaggatatgacctatgtggcccatgagagttgtatgtacatatttagtaccacattgctagtttagcaagagtgaaaccaacttataagggtttgtccctccaaccatatcactcccagattaactctcatacacgaagcgatgacaaaagtgtaagtagggtagtatgtcgattggccttcaggctgagtgggtgaggccagcctactgaccttgcttcttgcatcggtcaggctagggtgccgggcttggcctagccctcctagcttcctggtctccagcccaacagttcggggcgagctgtcctaatgtaacaccaattgcttggtcggcctaggcactctggactagtcagttgtggttcctcgagaactcgtgcatttctaacttattttgactgacacttgcaaaatactgaggagattgttagtatttcttacattcacaaatactgaggagactgttaatattttcttacatttacaagattaatttgcaagcacccggaataccgttaaaaccattttaaccattagtatttcccaaggtattggatttatatttttcccaaggaaggtgatggtataaagatatgattttttttatgttccttaatcaactaataattaattcaccatagtctaaacatgggttaggataataattgataaggtagtggacacacaggagattcacctctaaaagaatatttaataggaaattagcattagaaccctataattcatatgtacttctatactaatcatatctagtatacacttaaggtacacatgtttacaacataggacttagttccaggcacccaggtactaccgagagaccactccctgctggtctgccagcgtggttatggcatttacgcactcttacgtcatacccgaacgtggaggaatacaagggacgaacaaggctgttaacacttgccacctatctcactttccgtggtgcacaaccatatctaacgacatttatctagcctaagcaccatgcttataccagtaaataatatcactaactcgnnnnnactcaccctaaggatgaacaagttggagctagagcaacctataaaggttattggattgttaccatagcatggatcgactagcctaggatgaagcagatatacaaagtatatactactcatagaacatatactc

SEQ ID NO: 61371 - DNA, 3929 bp, Oryza sativa
ataagtgattcagctatttcgaacaaaatatagcactttttttgagggatttttttagggaaaaaatagagcacttttatgtgtgtaaccgagattcttttaccagattaagaaatctggtaaaagaaccgcgctgctatataaaggtgcttctcaatgctatatcccatccacactccccacgcatttatatgactactaaagtttcgcatttatatgactactaaagtttaattaggttgtgtttagttcacactgaagtttgaaagtttggttgaaattggtacgatgtgacagaaaagttgtgtgtatgaaaggtttgatgtgatggaaagttggaagtttggaaaaaaaaatttagaactaaacagggccttagtcagtttttatttaaattgcacaaagctaaattaggatccatataattgatatacatgtgttgtatacatctatagcaatcaatccgtactaatactttttggaccaccgcgatcaaacagtattttttttctctctataaacagcggataaatttaattcggttggttatttttttaaaagggcgacgtggtttgtctttgtcccgtaatctctttatcttttggaactatctggttacatgtattggatagaagatgtaaactattttaattatcttcaaaagacgtacgtactcctagtttatacatacggtagatttttacattatttacaacctgtgcttaacaacatagtaagatgtactcccttcgtcccataatataagggattttaattttttttcttacaatatttgaccactcgtcttattcgaaaaatttgtgcaaatataaaaacaaaaagttatgcttaaagtattttagataataaagtaaataaaaaaaataattcttaattttttaataagacgagtggtcaaacatcgaaagaaaaacacaaaatctgttatattacggggagggagtaattaaggactgtagtagtactatcgtgatcgtgacgtcggttggcgatacatgaatccagctttctctataaagagatgcttggatggccatattttacacctctcgccgactaaatcctctgtttattcgagtcatcaccggattggttagtttatagggaaagtggtttagtgggctgcccccacgaagcacagcaaacaacagggtgtgttcatcacctacagaaacacgatttgtttatcggtttgggggaaaagacgagacggcgacgtggccgctcaagtggacacattttaatagcataaatgtagtatagtactagtagcatgattttttggggggcatctctatcaacagaaaatccttaaattacacctaaagttgcttcacaaattggtgaggtccaggcaaaaccaaatcgaacgggatattgtttttttcttcaaaaatttctgtccatcatctctccagagccgtgacacatgcaccaccatgtttggcatgatagggagaatcgattttgcttatcaagaaacagagaaaagatcccactaggttagtaggtgtttagtgttttcctccccctactaatcaatggttatgaccttaattaattgctgggagccaggattgggtgaactgcccacgtatactataatgttatgccgtatgtaagtgtgtatgagaaagagagaaattatatactccctccgtactcataaagaaagttgtttaggatagcgatacggtctccaaatcatatctttaacttcttatttctataaaagtatttattaaaaagtgatatatgtatacttttataaaattatttttcaagacagatctattcatataatttttatattttcaaactcaactgcttgagagttattcatgatttatatccccaatgtttgacttaaatattgtcctaaacgattcctttataagtatgaagggagtatgtattgggaaaggaaattggtgcgatgtggtgtggagttgaggacgcgtagcttcattcactaagatttaattcctgatgtctataaattttacgcacttaatgtaagtgaacttttaacagaaatatagctgagattagaaatatgcctgttagttttcgtcttctttaaacgtgtattagctgttgtgtaggtgagtatggcgttacgctgttgcgtatgtaatggtgtgcgtctaccgtgtaatagtaaaataaatgacatcgtgtacatggattatcgctaatgacgccattggattagtttaggttgcccatggagcctaaggtcccctaacaccaaccctaaacccgtaatttaatatcctctcgtgaatgacagcacggtgacgctgtgctgcgtaggaaagccactagctggtgccgtggtgcagcagagcagcagcatcacgccaatgactcgaggcattacacaatcgattgatacgctgttgccttcttcacgtgcccgcgtcgcagcgagcttcgcctttccacacagagattttgtggagatcgcattctcctctcctgtgtaaataagtggctgatcacatgaacgacaatgggtggcaatttggcaactggcaaagcatcgcaaatttgcagtgctgcattctaggatagatatgctcgtatcaccaaaaagagagactttaggaagccgacgagttccaaagtagggactccctatgtttctaaatgtttgacgccgttgattttttttaaatatttttgaccgttcgtcttattaaaaaaatttaagtaattattaattctttttttatcatttgattcattattaaatatacttttatgtatgcatatagttttacatatttcacaaaagtttttaaataagacgagcggtcaaacatatttaaaaaagttaacggtgttaaatatttagggaacgagggagtaaatgactacatgtatgcgcagtagcattagatctcatgcaatcctccttccccgctgcattgatacaagaactgaaaaccaaagcattagaaatcacaatgcagtcacaacatagatcgaacctgacaaaaactttgtttcaaaatactccaatcgatagtatttcgtttcatattatataagactctctaatattgtctatatatatatatatatatatatatatatatatatatatatatatatatatatatatatatatatatatatatatatatatatatgtgtgtgtgtgtgtgtaatgtgttactgattgccactttactcctagactatagccaacccacatataaaaggggagcaaaacaccttgctgaaaatcagaaaatgtcctacacaaattttacatctcaaattagggatcaaaacatttagaagaaatataatatatatcaaagaagtcaagacaaccaaaaagttctttcttgtaaacaaatcatatagaaagcacacatataagaacagtacatttttcattctcaagaaatgcccatgaaaaccgacagatcacacaaacaaaaatattttattcaggacacaagtacctgaacgcatttctacacgttgtagacacaatttaccgatttatagtgcatggaggcccccaaatatcatccaaaattaatctaccagcgtagtggagttcggacaacatcgccgttgcccttctgacggcctttgcgtcgtcgtcgataatcatcacatgaaggccatcggggaagaacaagatcatctcatcctccattaattactaaagagattttctttcttttttgtataacatggtgaacacgcgtacacactagtaaatatgcaacatcacactcacacctaacacaagctcagagttttagacaacacaaacggtttactgctcagttttcactgacgagagtgattagatttgaggtgagtgaaccctctgtttgtaggccggctaagccagggggatgggttttactgcctaatggtgt

SEQ ID NO: 61372 - DNA, 4257 bp, Oryza sativa
tgttctatgggctagaactcgagcccatatagttttgtgatctgactagtcagagaaccgaatatgtagcattttttgtgtcctctggatcttaatctaacggtaggaaaaaatctgggtgattttgacccaaggatttgtcgacaaagacatagctagtttttgaggcatcggccgtgtttaccagagaggacttgtcagttaaggccgagtttagttccaaacttttcttcaaatttttaactttttcattacatcaaaattttcctacacacaaactttcaattttttcgtcacatcgtttcagttctaaccaaacttttaattttcatgtgaactacacacagcctaaacaatcagcttatgggcagataggatagtatcttacactaataatcctcacgtgctgtgcgatccgatccaacccaagcgctttgcgtgtgtcgaaacctccggtgtcaataatgaattcgccgatgcaagcaagatcgatcccaggagcagcaaacggttagcgatctatgggtgatatgatatcgggagtagtagtacgactgtacgagtacttcacatgtgatctgggaaagaacactgatagatttcgtcaagcgtacggttgtttccagaagactaaacgatactgtatgacgataggttaaggagtacctctccattccgccgaggaaaaaaaatacgaattagtccccttaagtccaccgaattacatccctaaactataaaattaaatattcttcacccctaaatatgcaaaccgtataaataatccctctggttcaatccgcggtggttttattcctactggcagtctagtcagcatttgtttaaaaaaacagtggggcccactttctacctctctccctatcctctttctctacctcttgccgccaccggccattgcattagcagaaggggcaatgcacgtgcccccctactgccgcaccgccgccaactctgcctgtcacgtcagcgagcgctagtgacgaagccaggataaaattatagcggggctacgccaaaataaacaagagcaacaaagagagatatagggttgggttaggatttttttgggccttcttagccttttggcccttctaacaacctcaaacaaaatctataataacccctcatctataaatatatggattaaaattttagagggggtattataggggctctaatggtatattaggggctaggagggtctaaagaccccccctgccccacgctttctccgtccctagcgagcgcatctttgtcgctgcggagggcatcgtggcaggagaggtgcactgcgaagttggtgctcaatctgcttcgccttccacctcacgcgcggttctagaaccaaacggcgacctggcgagggtggagacccatacccaccgaccggtggcgaggatccagatcaacaacgtcgctccaatagagacccgtcctcacaggcaggctccaccacctcctccggcagtcagccgcgcctctcccagtcctcctattccctggccttctcctcaaggtgtcgtccccgtcagatagatagccggcaacatcagattggggagaggccgcagctgttgagtaccggggcgctgttgagctcattgttgcctctctagctccctcccggagttcgccactcccacctttgcgtcccgcgccacgcccgccgcctgcctctgtgtgctatcgtgcgcgtcgaccgcccgcgccgctgcttgaccaatgcccaatgacgcccgagagagaggatgaggggaaaaaaatttatgacgggactaccacgtagtatcaaaaccaccgcggattaaactggggttaagggcaaagaatgtctggttttgtagtttaaggtataattgaatctcgttacagtttagagagataatttatacttttttcatctgtaaaatactcaatacaaacacgtcatattcaatactaacacatgcgtatctagctttatgattggtttttttgaacgactagtagagagtactactcctatcctcaattagtttactgtagacgtactgtactactagtagtagtgtactgtacacaggtgatgcgtggctcaaagtgtaggcgtcctgctcaccgatgtggctctagctgccaccgcgacgtggcacccggggcggccgcttccggaaggcacgagatcgacggagacgcgcgccacggagactccctctttttgggtcgatcgctagctagctaacggcacgcgcgttgcgaaaccggcgcgagctccggcggcgcggccagcaagccaaccacgtaacgttggcgaaagggcgacgcaatataatttagctggtgtacggtgcgcccggttgacgggtcgaggcagcgtgtcgagctgaccgagggggcctgctttcagagcaggtagcaggctatcaattatgatagcaaagagcaacgggctacagatttataaccagctacagtataaactacaagacgcagtgtgtgtatgacaggtgagaccagttattaatagtttagtatgtaactattatatgaatgagctattagattggctatagataaattgaagctagtaattggctatactattaaacctcctctccgctctctccacctgatcgcatcccgaattttttaaatagcactattttaataaaaaattaattataaaatagtgattacataattgaaatcgcaattttaggtgcgatatgtgcgatacaattttgtgccctgttaaattatggttgttcgttagggtaaaataaaatatatgcaggcaagtgtaaaccggatgcatatatctgagatgaggttcatccatctttggtaggttgataggtgcgagggcatcagcgaggcccattgatgtcgacgagctcgactctacggcgcagatccgtggcagtgagctcatctcaaggacggcaacgaggtgctgatccaccggtagcactagcagtagcgataagattggggatgggaacaatgcgagtagatccatgatgacgagcttgaggaaggcaatgagttgcgggtctaccaatggtgctagcagtagcggtgagtttggcgatgcgaacaacacgagcaagctcggggaaggcaatgaggcgtgggttcgccgatggtactagcagagaccaggtcgaggatggtaatggcacgaacagatccattgcggcgagctccgggacggcaactaggcgcaacgcaggttcgccggtggcactaaatagccacgaataagggagatatagatacctgatgggcctacacgcccctgaactggagcttaaacttgaaggccccaacaagtgaggggcggacacccatagagatagccacgacactcttggctggcacacgaggcactgttgaaaattgcgcagatgggatatgatatgagagggtgaaaggaagaagaagattctaacatgattgggcccatgtgccgatgagtaaatgggtggaaaacgtcaccatagtggcgccgctaccactatgtaaaaattcattgtcatggctgctactagacgaattgtaatgatatttatttgaaatgatatatttgcaataccatggagcgaattacccttaaatataaatttattgtagtctaatcatttgagagttatgagtggtaaaatttgatacaatagtgaaaacggagggagcatgatgcaagacaagtaaaaaaaggaccatgtaaaatttttaaatcaaagttaaaatacaaaatactttccaaatttaccataatttacagctgacgaaagcacagcttggtcggtccacgctggatacgaataaacaagagaggttattcccgccggtaataagaagcagacactatcgcaatgcctgaaacggatatgagctaaaaaaaaaaacacccgctaaattcccgcgaagattctttcccggaacggggcagttccgacatttcacctcctctttcccagctgcggcctattgttagcgaggagtcacccagattcttctccaacctctcgcccccgaaatccacacctcacaacgccccttacgccccacgcgagcgaacccacaagaaacacgcgcaaaatctcccctcccgccgcgaattcgctcggtttgatcgcccgaaagatcgaagtgttttgcgcgggattcgtgctttgcagcttaagtttagtgcggccttctagctgctcggatttgaatgaatgattgattggcgggtggtcagtcgatttaagt

SEQ ID NO: 61373 - DNA, 967 bp, Oryza sativa
ccggcacacacaccttacccctcaccgcatgcgcagatagaactgtacccctatacatggaaatggctataaatgactatgaactaatccctaatgcctgcgaatattgtgtacatgtgagtgtgctttcaatatgagttctgtgaggtaagaatatattttccacgggcctccatctcgttaagcttggattaggacttaggagttgcactcactcttgtgtgcgtgtagtatacgtgcgtagtggtatgtatgcatgtgcttctttgatgtaatagaaaatggctaggaatttaaaactagcctgaggaatgtgctgatgtcttgacaagcaatatcaatcaactgaaacatcccatgttcccactcatagtaaaccgatacggagaaaaaatgtctacatatatatatatatatatatatatatatataccatgatctgaagaaggaaacgtgaccgagtctgaaaaaccgaacaaaattaaccaagactgaaaccaattttttttcgttagaaatctggtcagcctttttcactaaccgaaattaatttggttgtcaccatcggttaactgaaatgaaaattaccaaattaaccagaattaagaaagaagcctaacattcattgcattgaatggatttggaaaatagtattccaacattcattttatttgtggataaatggagcatcctaaaatccctaatatctgtggatggattgtttctcaccttattatacctatgtaaacttattcaagcctgcaattacttatttatgacaaaaaaaatatgtgcattcggagtattaggatgtgctgatgtcttgacaagcaacatcaatcaactgaaacaccccatgttcccactcatagtaaaccgatacggtgaaaaaatgtctacatatatatatatatatatatatatatatatatatatatatatatatatatatatataccatgatctg

SEQ ID NO: 61374 - DNA, 653 bp, Oryza sativa
tcgtaaatttgtagtactagaatagaatgcggaagtttgtttaactcactcgccggtgcgatgacacacagccacagagatggaaacctgtagcgcataacgagggcctctccaaacatttacatacgcgacgacctgacacgaaccaccgcgcaacggatcggcacccgttccacgcgtctacgcgggcaggaaaactcgccgattcccaactcccaagcgaaccaaaaccctacatatgtgatgcatataaacgagcgcctccgctgccacttcacaagcaacttaactcgacagccaacaatttgaagctttgaacagatagcagatcgtacactccgttggtgtagaagccgggttttacaacttttcattattaaaagaagtagagcagagtagtctccgttcctggccgatccaccatggcctccttcttctggcctgggccgccgggagcgcagccggtgggcgacctgcaggtggcgaagttggcgctgctcgtcgccggcaacgggttcatctcgccgtcgtcctacctccgccgttgctgcgacaacaacggcccgtgcttcgtcgacggcgctggggaaaggtgcttgcacctggccaacctcgtaaccgccatgctcgggctggccctcgtgctcggccaa

SEQ ID NO: 61375 - DNA, 4155 bp, Oryza sativa
agcaacccagctatattcccaaactgacttgtgttttattgtactgagatactactggatggctgcgaagatgtatgcaaaatgttctgatgactaaaaacatcgagaaccatgatttagtcttgagacaatatcacgtcacgcagaatgggttcaagtgcgacaatcagcaagtgtcttgcattgtctcacattctgtgtaggggagttgatcaggcctgatttatttctattagcatcggaggttagttgatctaatggtcaaagacacgttgatctaatggctgagatgattctgatgacgtggctagctgagagatcttctttatagcatcattgcacttagtgggttccaattatataggaagaatggatttgtaatcaagttgttgtaatcaagttgtaattttatagttagcagttatttgtcctctaaattttatgataattggtttaatcttatttagagtaaaggtgggaacggattctattattaccttaaaaatattgttacttactataaaaaatgcatgtgcgttagaacggaaaaaaactaatgttatggtaatgatctatctatctattaacctattaacttaataaagtaatagaaaaaattagcctccacgttagctctccaagaactagaaattctcatattaattagagtataataaaaaaataaggagaactcatttaagacaaggactctttttttcctttttttaaaaaaatcatgttatatatgtgtagtgtccgatcgaatacctgcatagaacaaatcttttgcaaggaaaaaattacctgagctggatagactaatctctctatgtaagtaatacaacataatacaaagtattcctattttttatttttttggtggaatacaatttaagaaaagaaattaaattcggaatttaaaaataagaaatattgatagatgagattagagttcatatagaaatacaattaggaataataaaatttcagaattaaaaaaataggaatactggaagaagaatctagagtccatacagaattaaaaaataattaatattattaatttttagtttaaatttaaattatatatcatgacaaataaataattacatttttttactccatttagctataaatagtttaatttggagaagaaaaaactatttcaaattttagcaatttttaatgcagaaacagtttaaatcgattgagaataaataaaacgtaattaggcccatatttagaaggacggctcaaatatctctttttcacatcatggcatgttaagtgaacagggcccaagtggccttggcccaagtcggcgtagaagcgctgagagccaccggattcgatcgaacggttaggatcacttgtgatttagataaagcattgcactgttgaatcctaaaccctaattcattcttcttcctctcagtggcacattcctccaccgtgagcggccgtgccggcgcccttccctaccaggtgttgccgcagtgccctcctccctgtgagtaggggcattgccttcccccccgcgaccgggtggggcagcgcctttccctaccgcgagcggcggtggtggcggtgccctcccgcggcttcccacgagtggatccggcggcgacggcggcttcccgcgggagaatcaggcgatgacgaagatttaagataaaatttgtgcgtttttttattattcttcatattccttttctcttttgatgaattgtccgattggattttgtatttatttttgaatttgtgctttatccacccttacacgatgtgttactcgcgtgtgtggaacggaggtcatcgttggatcggacttacggaccaaaaaatgagtgatgaacgaaaagttgtgttaacgtcaacttttggtaaaattatttagtggattcggttaaggaaagagcacaatcaactgatggaaagcttatccagaagagtatgagttcaagaaagaatcatgaagactatgccgtggcagtttaattctatctattaattacgtaggatttagtaaatttcctttatctttagaaagttttatctagtatccgattagtacttgtatattttcttttgtatttaggaaacatgcgtcgtgtccaatatggactagtatctacccatgagtataaatatgtatatacagggtcattgtgatctatcctcgatcaatataactactcccggcgtatcgccaccctcttttccaatgtatttatttattatcactgacggaacttagcacctgacgcgggctgcattgacttcgatctccggcgaaggggtaagccctatgttccgttggccctggtgaatatatcggctacattggtgttgttcaaggtacatcgcttcgatctcttagatcgttctagttcggtcgatatatttgcctacctgatgtttcgattctattttaaaatttaagggggcccccaaatttttttggggtttggggttttttaagagaccacatcggtttagttgggactgtctcgattaggtctgattttatgtcttagcctatatatctctacaatcacaatgttgttttaaatagatttgttagatccatcatattagacaaatttatcggctcattgagtattagattattatatgcaatctcgtgttgcatcgattaggttctacctactaaattgttgttaataatcaaagtcttgtcaagctgatatgttcatgctaatgtttcattggagggttagccgcttatataatatgttaaatttattgttgatggttttattgtcttagttaaatttaagacatgaccactctgaaaaacaatgaaaggcttggttgtttagatcttatactttcttttatacttagtactgcattagtcgtacttggaattgtaagaactaacttgctctttggttgacgataaaggtagcatcagggttttcagccgatgagttgtctcaatattgcactggcttataaggattatatacaagttgattttagccgattggatcattacttcattatatcatcatcgactcttggattatttgttcaagttctttcattgcttatctaagcatcggaatatacattgaacaaaaagcgaattatttaaagccttatcgacatcggctaagtaccattacatcggcttgtcaaccaatcggttttttgatcataaccttttttttattggtggttccttaatcaaattgactagcacatttgcatgtaatcaaagtttaggatatgcactagagttaagcatttctttcattcattcgttttttttcacatcaataagttgtaaatttgttaagtagttaagattttcattgctcgagagtgaacggtctttacttgggcctcgccggtgcgatgccacagagacggaaacttagccgcgtcatgacgacccgacacgaaccaccgaatccaacggatcgacacccgttccacgcgtctactcagccaggaaaactccccgatccccatcccaagcggaaccaaaccgttcatggcgatgcttataaatgagcgcctccacagctcctctgccacttcacaaagcaactcatcaacagccaacaattcgagcagagcagatattagggaaggagaagaggtgagacttgaaacccatatcgtctagcccacttcattgtggagctagcccgaaaacctctagttgtttctcccctgtccgccgatccaccatggcgttcatctggccggggccgccgggagcgcagccggtgggcgacctacgggtggcgcagctggcgctgctcgtcgccggcaacgggctgatcgtctcgccgtcctacctcagcagctgcccctgcgacgacggcggccggtgcttcttccaggacggcgtggcggagcagaggtgcttcgacctggccaacctcgtcaccgccgtgctcgggctggccctcctcgtcggagacatggcattctcgacggcagtgcccggccggtcgacgcagtcgcaggccctggccaccgttgctaggtggctcgtcgggctcgccaaggtcgccacggttgggaccttccagcattggatcaatgccttttacctttgcctcaaaacgtggtccatcacgtcttatattatccacccgtctttgcatgataaccctg

SEQ ID NO: 61376 - DNA, 1377 bp, Oryza sativa
tggtatgttcacttcctgggttgttctttacaactgaagcaaatttatgattggagctacatttggagtcacttttttttccttgtttcatagtagtataaaagttactccaatgtagtttattttctttgcaaattgtttgtccgaaacgtcatctaattatacatgtcatgcgaaaactacaagttacttaaataaaatctatttttcaggtttaaataattataactcaattaatcatacgttattttcttattttatctgcacgcagttacattttcagcagattcaaaagggacatctagtagcataaacactcacatactcagagaaaaccattgacctgagtaatgacccggttagtcactaaccgggtccccgtaggaccgtaacgaaccaaatggagcagcgtcccacgcggataaaccacgtcgtccccgtcgatctccacgcgcggctgccagagtcgatcgtcacctcggctagctcggtctcgccggtgacctcaccgtagacgacgacttgacctgacgaaactggaaccaacccaacccaaccaacataaacgagctcaccccgcgctgtgtgggccgccaattcacaaatcacaagcaagaacacaccaagaacccgaactgtcctacctcgatcgatcaccagcagccagccatggcggccgtcatcgacttcctccagttggagccgccgcgcgagccgcggccgcagccggccgtgcaggcggccctccccgtggcgaagtcggcgctgttcgtcgccatcaacggcctcgtcgcgccgtcctacctgtggtggtgcctggcctgcgacgacggcggcggcggcggcggcggcctccgccggcgctgcttccgcggcgaggccggcggcgacgtggagcagatgtggtaccagatggccagcttcgccaccgccgtcctcggcgtggcgctcctggcttttcacgtggcctcctcctcggcgccggcggcgatggcggcgtggctggtctggctcaccaaggtcttcacctgtgggactctccagtttggcctcaatattgtccacttttgtatcaaaataatttacttcaagttgatacgggggttggattctaatctttcgaggggataattataacacattttttttactgcttggatgcaatgccgatagctgtaaatggatttgaatcgatttgagtacataataatgtacgaaggtagattcaattttgtcagagctgcggcgtgctaatgtagactccatcgtggctaattgacggaataaacgaaacggtatatttgcaaacggaaaataatttgtaaataaaacttttatatacgtgttcttagcgattcaaaacaaaggctgtaaaat

SEQ ID NO: 61377 - DNA, 3063 bp, Oryza sativa
caatcatgtctaacgaacccacacacccagccaacgattttggaacgtgtggcacgcagactttgacagtcaaatctagacttgataacttgacaagtggtatcccatcaaaattttcagaaataagaagcgaaaaatggtctgaaagttagtaaaatttttcacggcagtttgaattttcgctctcaggacatggtagttttttttttcctttaacgactgaaatttctactgcactcgagtgaaatgactgcgaaaagtacacagtggaatcaagaacgggatggtgctcaccgagtcgaggaggatgttggatgccttgaagtcacggtagatgaccggcgtgtcggcgtcgtggaggaaggcgagccccttcgccgcgccgacggcggtctgcatcctcctcatccatggcatggcgccatcgagacctgcacggacaggaggacggttcagcgtcagctaaagtcttccccggaattttttcagagctgaaacttcagcgatggcgtaagcgcgctctaagcgcaaatgattcggttaaccactcgcgtataaacaccagtaatctcccggattctattgacgattgcgacgggggtaaaaaaaaagaagaaaagattcaacagttggtaattattctcgtgtgcttacttttgaagagatgcttctccaagctcccgttgctcatgtactcgtacaccagcatccggtgttcgtcctcgtagcagtagccgatcagcttgacgagattcttgtgcctcaactgaccaaggaagaacacctcagcctgcaagaaagaaaggttcgtagattaattagcacggtgagctaaagctcgagctagcccaacaatggcggaaggaacgcatgaggtggagagtgacgtaccagccactccctgtggccctgcgtgccgcagtcgaggtcgaggtacttgacggcgacggcctgcgcggcgaggccggggcggaggccgtcgtcggcgcggcccttgtacacggggccgaacccgccggagccgaggtagttggcgcgggagaagccgccggtgacggccctcatctcggcgtaggtgaaggcgtacaggttcgagcccgacagcgtcagcgacaggtcctccggcgtgagggtccccgtcgagctcaggctcgacagcgacaccctcgacgccgacgacgccgacgacgacgacgacagcagccgctggtggtgaccaccccctctgaccctcctcctctccggcggcacgtcgtgctcaacgccggccaccccgccgccgccgacgcagcagagcatcgacttccacgacgtccgcaactcagccatcgaatcgatcaaatccaagatgaacaagaagccaagataaaccaatcgcccacgaacacgaagcagcagagagccagagcccgaaatgcagagacggagacagcgagtaccagagcttgtaaagaagaagaagaagagaggacagagttgaggaagcgtctgcaccggcaatggcgagatatgtaggcgctgtggctgtggcttgtgccttgaccgtgtcgcgcggcacgaaaccacgcacggacggcgacgccgagggctgcggaaaacggcgtcaaaaccggccacgaaacgactcaaaaaaagcggagtgggtgagtcccccgcagcaacttggtaagttggcagagagtactattactgtttccgctgctgcattgatggttgaatttttttttctttgaactttttaatttttagttttaaaaataaacatttttcaaaacgtattttcaagatattaaccttttgggctacgctagccgaactggtgtaaaaaaacaacattgtcactccgcgttatttggtcacgccgatttgacgggcgtggccacgccatccttgctggcatgacagaataaaactatcatgtccactgcgtgtagcgtgtcagtattgttttgccatatcacgtcgattggttcggattatagaaagaagttttgaaaaggtctatttttaaaattgaaaaaaataaaagttcaaaagattaaaaaaaatcctcgctggttccatgtagaaacgatgaaaaatcattctctcttttttttctttttgaattttgaaaattcattctttcagacctgtagaacggtgaaaaatcattcttttattagaccgatctcgtacagtctcggctgcttttcaccgcatgtactggcactgtgggtttggtcatttcttccttgccacggaaggtagcaatttttctgttctatttttggggttggaatggaattctctgcgtgcgtcactgtttcttactctctgcttaaacgtgacgctgacatacttgtaaaacaagtgagttcttgggagggttgcttatagcggaattaatccagcgtgctccatgctgatactaaactgattataacagattaagcaattccaagtgcttggatcatgtgaaaaatttcgtgcaaagtatttcattctttatatgttgcttctagttgggtgtttctgcttttctttttttccttttaggctaactgggagtggtcagactggggatgctaaaaccagagttgttttgggaggcaaagcagcggatgcaaaggaggtgaagccatgagctgcatctggttgctacctgaagcaggtagatctgcagcaaaaggaatctgattccagccgcagttcctcccacaatgttctggctcaccattctcgttttaatttaatctccatgatccttccacgcacgagtgaaatgcaattatgcaattgcagtcgatcgagatgagatgatactgtgataggcagttctgaactgaaactgaaccgcacgctccgaacaaccgtacaggatgcagacaaaatctctgctggaatttacaggagatgggaaccatcgtgtcttgcgctgcagatcaaggcgcataaattatgatagttttgtaatttaaaccctgcttaggaaaatacgcaagctggaaggaagcatcaatctgagctgtttgctaacccggtgttcagcctagccgtcgtgtttaaattcagttgagcttc

SEQ ID NO: 61378 - DNA, 1869 bp, Oryza sativa
ttcagctctgttttctttttatcacagttatctctctcgttttcattttttcaaaaaagatgataatagtgaatattattccctcatttcttgacggcagcattaacgcattggatgcggtaagcggattgacctgccaccgtcctaatacttttcttctactactactatttctctgcaaaaatggatggattatactgtgactctgtgagccgtagcagctggcacaacgactttgaaccgaccttggatagtggatgcattgtaactgtacaatacaatttgtacaggaggagtgtatgcttgtaactgtacaatttgagctgcatgtctgaaaagatcgccgggcacgagagccatggccgccgcgtcgtcgatgggttcgagagatgggggggaaaagcagagcacgcctacgacgtggggtgcatggctcgatgcgtgggcgtcggcggcagcaaaagggaaaaaaggagagatccgtctctgctttcgcgaagaggaggaggtcacggccgtccgatgaggaacggatggctcagatatcaagcgcaaacggtgacgatgctgacaagaggggagagattccgtgcatctctccatttcgaattcggggcatgggggcggctcgctccatctcctacccacacctgagatctggcgagcgagtgacgacgtgccgaccaccggccaccacaataatattgctcggtttttcttttttttttgttatctaattatcagccgcaacaatttgaaatctaatatttgagttgattttgaatttttttatcgaagtttaatttttatattggcttttaatcgttaaaaatataagtacaagagttgtttacacataaattgttttttactttatttgtttatgtggtgtttggattcaggggactaattttagtccctatcacgtcgaaagttggaacactaattataagtactagacataggctaatgataaaatccattccataaccctatactaatttgcgagacgaatttattgagcctaattaatccatgattaacctatgtgatgctacagtaaatatgtgctacttatggatgacttttgctttaaaaaaatcgtctcgcgaattagctctcatttatgcaattagctttattattattaatctatgtttaatattcctaattagcgtccaaatattgtaacgctccgcttttcgtgagtcgttaaaaactaactcggcaaaatcctaattgcgaaaattttcgttctttgtgtgagagtctaagttgtgccaaggatcccaatttaatctcgttgttccctctcatcgaaatcaaaatcctccccctcatccaaattccttttccgattcgagtctctgaaatcaaattctgaaattcaaatccttcctttgaatcctcgccaaatacttctacgaatccagaattattcaaatcctgcctcgaatcctttccttgactccaccctatgttcccgagaacaaatacccaagtattccttttgaatcttttccatgacttctccttgagtttcccttgatacatccctaaaccctcgagttcgaatatcaaatttgaattcgaatccaaaccctaaatcactccaattctatccaaatcagttttctctgtaaaagtctactttacctccctgtatttttggatggaccgattttcctccatcggcccatctcccctcccagcccatcatctttccccctcgcacgtgcgttgcacgcatgcgagccgagagagagccgtcgctcgctctctctgtttctctcgctctctcgtcttcctcctctctctctatgtttctctctctctcgttcgatctccctctcctcggtgcagatttcc

SEQ ID NO: 61379 - DNA, 1556 bp, Oryza sativa
gtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgattgactccgttcagcttccagtaattccgtaaaattgagatctatttaatggcactactaataggtctaaataggatctttcttttggtcttttgtttaggttttcgattatttgcatatagttgcggttatcggattttcgtcgatcgcgggttttctcgaagattcatgaagctttgtgaaaaccttgaaccaaggcaagtcaccctttgatcaattgcccctattaattaaaaagtcattattattttgtttgcaacttgcattactagaatcacacacttaacttgtttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcgattcagggaaacctcgcatgccaatagttgggaacgccggggcggggtcggacaaaccgggttcctggtaaggcaaggacgagaagcttgctcacataccgatcaaggtggttggagttgatttgtgaatgcctaaaatggcctatacttacgtgaggatttgatccttctatgtggcatgaggtaaccttgggtcggcttgggaaatgctttgttgcgaacctctgacaccgatgggtgtttggagtaagttcgtgtcttgtgggtaaagtgtacccctctgcagaggttaactaactgttcgaacagccgtgcccacggtcatgggcggatgtgaggtggttcccgttgcgtagagttgtttgcctgtgctttgtgaaaagttgttgtggtgtgggaatcgtaaccagaatcagcctatgtggcagatggatgacctgagtggtcaagaaacgaatctgtgtgattcgggatgtctgcgggcatcatagactaggcttcccgagtggaagcggattgttgtgctgctaggcagctggactctgggagtccgagaaaatgaaaaaggctctgggagccgattaatccagtggaatggctttgggagccgagaagtaatgttttgaccccgagcgtcggtacattactaaatgagctgttgaaaaatatctcttaaagtcgaatcgagacgc

SEQ ID NO: 61380 - DNA, 907 bp, Oryza sativa
aaattgatagggctaaaattattccctcccatctaaacaccaccttatttttcatgtcttatccattgtggagcgcaaacaatacgagtgcatgactacttcgatctggtgtgttcttgtcaaatgttcagatatgctgacttcttgcgttgcttatgcgtcatgaatatacagatttttgcactatctgaagctcccaacatagtagtacatggctacctctgaaggtgtcaaactgtcaaggtgatcgaaaaggaatgctaggctgctaatttagcttcgacgcatgttcagttcgacagacatgctcaacgtgtgtacacatcgaacacactgttgtcaacgtgcatgaatccgaaaatcgcatgaatataatgcatccatcgttaagttggcagggcggcagggccctacgctcgtatgcatggctgcccttcctcagccgagacgaaggtgcatcacacacgcacgagaaccacgcgtctggtctgaccatggccgacctgacgaccatgcatgcgtgtgtacacgtactagcactctctgtattctctactctatctgaatctctgatatcatccaggtgatgggaatggttatatggattggattaacctggacgtcattttaatttggatctgtctgaccttttcccggccgtctcgtaatctcgttacagtgtcaacgtgcagacggctagcggcttgtttttgtccgagccgtttggaccatctgcagagcggcgttatgccttctgagtttgaccagcgtgtgtgtgtgagtgtgtccgtccacaccgattgtttcgagtcaaaattggctacagattcacatgctcttttcaactcctcggtatgtatatgtgtttttttgatacttgaattcgatttggtttttcgtattatct

SEQ ID NO: 61381 - DNA, 948 bp, Oryza sativa
tgaagatttgtcaagatttccttggtgcagtttttgttggacagaaattgtgtgcacagctggttgatgagcctaggattgttggctctggaggtgacagctctccaggcaaagcttgtggacaggaggcagtactgaatgaggagaaggctgaggaaaattctcaactatcctgcagaaatcatgaaagcaatcagacatgctatcaaaatggagatcgagaccttgaggcacatctcaatcaggatggatcgccgggctggagccttggagggatgcaacacggaggagcgagatcgaaggcatggctggccggtggagctcgatttttcgcgtcgtcttcggttcaggcgtggattaagctgcgtttgggattttctcgggatgcggtgctagggttttgatgttgggtggcatggcaaactcatcagcgacgccgtggcggcggcggcgcaccgccggagcggaagccgggagcccgaaggagtttaaggcccaccaaaggacacgaatgaacgccgactaaattcctgtcaatgaattcggcctgcatacattcagccctcgaattccactcagcgaattcgtcccacctaattcggaaaaagtacaccgaaggtccctcaatttgtcatcgggataaaaaacgtccttgaaccgtaaaaccagatatgtggggtccctcaactatacaaaaccggtcactcgagatccctcggtggttttcaccccggttttagcctacgtagcagctgtcagcgtgagacccatgtggccccacatgtcaggtgtctacgtcagcctcctctccctctttccctttttctctcccttccttgtctctctctctctctctcacttctgacttctctgcaatgggcggccaccggcgaggaggatggcgcgacgggcggccgcggccgcgtcgggatcctcgtcaacgtcgcg

SEQ ID NO: 61382 - DNA, 1637 bp, Oryza sativa
catatgccaatgcatctcacctggaccatcaatactgaagcttctatggcgtttactttggttaattcaatatttcaatcagagttcctccaccaatcttgtgtttttgcctgcttactttggttaagtggtagatgtgtatatatccatgtgctgctgcctaattgtttcaaaaatcaggatgtaatttccaaaatatataatcggcaaaaactgccatagagttcaggaagtcctgatcggaaaagcggtgagcggtgggcagcggtgagcggcgtccggcgtgcagtggccggcggtcggcgtcgtaagcgcttttcccgtttttcttcgtgtaacagtgccatgcaggttggacctgggcacctggctagcttgcacggtggtcagcggacagttgccggcgtcgaccggcggcttgggggccagcgacgtgcatcggctctcaggctcggcggcctgcagctagcgacgaacggcggagggtggccggcgacgagcggcggcgcggcaatcggagtgcggcgagcggcggtcagcggcggaagcgtccttcttgattttttgttcggtggcggtggccgcgtggggcgtagcctgccgccaccgccgcgcatccgctttcgctccgctccgctccgctcgcacgccgcctccgccggccgcatcctcccgtccgcgctctccgccgtggagagatcgagtgccgccgcatcctcccgtccgcccctctgccaactccctcctcgccgcatcctcttcgatggagagccagacgaggccaacgggcgcgaggcgggagaggagatccggccgacgacgcggtgacggccgcgccccgctgctcccccgccggccgccgctcgtgcagctgctgcccctccacctgcgcccacccgcacgccgctccgccgtccgccgcccatggagaagagagagggagaggtgaagaggagaggagaagaagaggctgacacgtggggcccacggggtcccacgctgactcagccaccaacgaccgtggtcaaagcgcaacgtaggataaaaccgggacgaaaaccgctgagggatctcgggtgactggttttatatagttaagggacctcgtatatctggttttatggttcgaggacgttttcgtatctcgctgacaagttgagggacctttagtgtactttttccacctaattcatgtcctcgaattcgtctcaagaataaatatggcccatcaaggaattcagcccaccatataacttgacacagtttactcattaatacttcatccgttttaggttataaaatgtttcgactttattcaaagtcaaattgttttaagttttattaagtttgtagaaaaaagtagtaacattttcaacccaagacaaatttattataaaaatgtattcgattattgatttgatgaaactaatttattattataaatattactatatttatcaataaacttagtcaaacttgaatcagattgactttgtctaaagccaaaatgtcttataacctaaaatggagggagtaatttggaccgccagcaaacttggcccacttattcccatcaacaatttcagcccacctatgaattaggcccgcttgctgcttccgtccctacagcgctcgtc

SEQ ID NO: 61383 - DNA, 3300 bp, Oryza sativa
agtttaggcaggggcatgatggcttgggagttcgaggagatcacggaggagctcgatgtaataggggttgggcacaaagatgcactgggggcaacgtgtcgtgcggtccacagtggctaagtagaacagcgacggtggtatagggatggaaactgaggggttttggtgtacttgggacatggattttattcttaccattaattttgaacaaggacggtttggtggggggtgaattttgaggtttggacactgacgagtcgagttaggattcggcttcctagctccaatgacggtgattggcgctgctgagagcagagcagcttcagggagcaaggagagcatgctgtggcgtttctgtttgttggtggtggcgaccgatgaggcagttgggagagggagaacaacggtgaggacaagagagcggcaaaggagagctcacgtatgcgggcacgtttgtgaaaaaaaaaagatgggagaacaagaatgagttgattggtaggtcgtatattttttttttcacttacatggggtcttgtgtaaacacgttagcgagtcaactatggttaacctatcatattagtaaaaaccgctttctaaaccaccaaaaaagttaaaatgcactggttttcaaagttggaggatatgatttacacggtttgttttgctgttaaaagatgcgattcgaacaggggcaagagggaggcattatagattttagtccatttccctttagtatatttgatccacaactgaaattggccttgttaattcccgtcaactatttgggtctctaatgaatttggcctacctactgtccaatcaacgaaattgggcaactacggccacgaaagaatttaggaaaaagtacaccaaagatccctcaacttgttagccagatataaaatcgtcccccaaccataaaaccggacatctaacgtcccctaacttacaaaaccggtcacaatagatctcttggcgttttttgacctcggttttgtcccacatggcggctgactcaacgttgatctatgtgggccccacatgtcagatagaccacgtcaccaccaaggttgttaggatcgggatactaggcagtatcgttttgctcaaagtaatatcgtatcgtagaatcgtatcttagtatcgggatactatgagattttctttttttaagtttaattaatatttatattaattatatatagccattatctactactacttaaaaaataagaggtgcttctatcgtccgtcaaaaaaaccgagcgaaaaaaccaggtttgtccgataaaaaaactgggcaaaaaaaagtgcgaaaaaaagaaaagaaaaaccaaaactgtccaatccagaaaaaaaaagggcgaaaaagaaccgggccaaaaaaccaaagttgtccgatccaaaaggaatcgggcgaacaaaaccaaaccggacgaaaaaatgtgcgaaaaaaagaaaaatcaaaaaaaattccgattcctatggcaaggcggaaaaaaaatgtccgattcttatgaaaaaaagtggcgaaaaaaacacagtagatccgattcccttaaaagttggaaaaaaatcatattcctatattatcctatttcccgtacggttgtttgtttttcttcttttttttccgtttcttttccctttttttctttctttttctttcttttttttatttcttaatactatgtatgtatataaaatttatatacacgtatacaaactttatatattgtatattttttcttttttatacgtatgtatatgagctatgtatacttctctatctctactattaaaaaatttaaaacatttccttcgtccgtccctacttaaaaaattcatattaaaaaaggtctgtccgatttataagaaagtgggaaaaaaaggttcgtaaaaaataaaaaaacaaaggagaaaaaaagtacaaagggcgaaaaaaagcacggcaaaaaaaaagtccgatttctattcgtttttagtccctatatatctcttctctatctctaatctaatctaatctaactatttaaaaagaaaagttttcatagaacaactaaaaagaaaaaatgcgcgagaaaataaaaacggttaaaaaaagcatgagaaaaaaaaagcaaaaaaacgcgtgagaataaaagtcagaacagaaaagctaaaaaaggtttctgccgtctgtaaaaaataaaaaaacatgcgaggaaaaaactgttagaaaaagcacgccatttttaaaaaaatggtttgaaaaaacctcacataaaaaacaccgtttacaaaaaaaacaagcagctttgaaaaaactattagagaaaaaacgttaaattgatagacgcatgagtcggatagtatcaatcatttttttcatctcttaaacggcttttgtttcgtcatctatagaaattatattaaaaaacaaacatatttttaattattatttagagaagagtgcacatgtagcaaagtgattctattttgtgtagacttgattatacgaggcaatgtaggatttgattgatcctattattggttgcaagaatgagatcgaaaaagtattttagattatatgtatgttgtcgcgtgaataatccaattattttaggtaaagcaagcatcggtaaggttgtgatcgtttatgttgggccattacattaaagatgttccaattttcacccgttgcaacgcacgggtattttgctagtatattaaaaaatgtagtaatgatatatgtcatacaaatagagacatttatcaaaagaaaccacgttggtttgatatatttaactgatttttatataaatttgagcatatttattcacattattttcaaaccatgttttcttaaataatattttgtagtatcgtagggatcgtcgaatcgggataccacctaagatttcgtaggatcgtgtaggatcatgtagtaatgaatagtagaatcgagatactatgaaaattaggatactaggtgggatcggtatcgtttcggcttggtagcatcgtagtattgtaagatactaggatacgaatcgggatactgataagcttggtcaccaccctttctatttttcccctcttctctcccttcctctctcctttttcctctgggcgtggatggcggcagcgtcttcaacgcggcgtggaggacggccggcgtggccggcggctgacggggaaggagcagcgcggacaggagggccgatgggacgggcggcgccgccaatggctgccgtcgcgcgaggaggagcgcggcggtcgtcgtcggggtgaggcggcagaggaaggggagattgaaga

SEQ ID NO: 61384 - DNA, 2100 bp, Oryza sativa
ttcttttagcagcgcatcgatcggagtgggccgccgccgtgaagctgacgccatccgccgtcgccaagccgatcccgaggtcgccgtcgtcgtccaagcttcaccaagtcacgagctatctcgactctcgagtaagcacctaagaacgccgaccctcttccccaccgcgtcagtgacgccgtcgccgccgcatcggccctcctctccgcatcggtgatgatggctgtagccgcgcgccgccaatgccgaccgcacgagggggacggggaggccggcgagctcgcgctgccctaagcccgcgcgccgccacccgggagctgccgtcgccagccacaccaccctctggccgcgcgcgccgccgcctgtgcgagagcagagagcgaaaggaaggagagaaacagagaaagagagagggtgctgacatggtctccatgacatgtggggcctacgtgggtcccacgctgagtcagccgccatgtgggataaaaccatggtcaaaatcgctgaaggaactattgtgatcggttttataagttgggggacgccggatatccggttttgtggttgggggacgattttgtatgtgggtaacaaattgagggaccttgcgtgtactttttccaagaatttttagcccagctctttcgtctacgaattcggcccatctatgtcctagtgtcccgtttcggtttcgggcctctacagatggacaatgggccatgcgaggtgtatggtccacaatggtccggaccacaggagccatgccaagcgaaatctctgcgtctaagacatacttcgtacttccttttgtcacgaaggaagaaattaattcatccgcatgtagcaaacactagggaactatacgaatgcatctaaccaatgagtattaacatgttggctcaggttttgatcaataatttaatttagcatcatacaacgataatccctttacataacatttaaaatatgcgtagtttattataaaatactaataaataaaatatgtatttttggattaagaagcatcaaaaccagataatagaaaatacaggcgcgaccacgatgccatgactcggaggttgcgaccgggtggggccaaaactcgccgagttcgcaccggacagatcgatgccctttatttgcaattaaggtccttcccctgctttttggttttaaccttacatttttttccttaatcacttacttttgtattaacctattaattttttttggctttggctttatcttctaaaaattctggtgcaacacacgagcctttagctagtcctttaataaaaagcaataaagaagtcacactaccaaaactttctaacgattttgttatatacatctcaacacatttctcttaaaaatttatcacatataaatataatattattatagtgtgctttaatataattttgaactgttaaatttgttttaaaattcatattagcaaggaagaaaaaatcaccacatgcttacatgtgaggagattctattccgagaggtccgcttcgagaggtccgcttcgtggaaatagcatgttactgcgagatttaggaacattacatataagttgtatcgtagttacatgcaagttataatataattacactataattgtattatatttgcttctgtcaaatttttgtaattaaatttttttcaataaaatatatagaaagactcattttctaactgaaaagcacaccaacacatgttataactaggtagatttttaataatgtagtcattttaaaaaataatatcaatagacccataaaacacatcttacatatggaccctacctcagcagtgatatgttggtgccgagatgggatatctcagggctaaatactccggcgctgagggtctgatggcgccagtgaattcagcgtcgatgaattcggtgccaacctctcccatctagacctgcaagtccaattaatttgctgtcaaatttttggaagaattgataataatatatcttaattcattatctctaatatatttttgtctataaaatcttgatatggaggagaatgtgcatcctttcctccttataactaaatcctattgatttgctgtgaaattttg

SEQ ID NO: 61385 - DNA, 2513 bp, Oryza sativa
cctatgatgatggacctatatattcgatggatttatatttcatttctgttgcatcctccacacgtggaaacctccgcttttccctcctcgagctccacacccaatgctccgatcccttttctgcttaattaatcaagaaattaacaatctgcataaataatactgtaacagtttttttttataacttcatccaagttacagcttacaggattagtggatcaacgacgttgtctgttctattttaatcatcaccagaaaaaggaaacaatcatctctcttttacacattcacgccaagggggatgcatgcattgtttagtttgttactcccttcggttggtgcggagtactgatgacatgccattgtgttcttagatatgaactttagaaatgatactgatacatgagtagcaaacaaacagtgaaggctccatcggttggcttttttttctaataagccaaaacggcttattaggaaataaaaataaatttgtaggtaaagcttttatatatatgtgttcttcgtaacttaaaagccaatgctgaaaaaaaattacgttgaaaatatctcaaaatcaatcttaaaattaagtttgaaaattcaaaatttggcttattctttggcttattaggtcatctgatgggagcttgattaattcttctatttattactggagagatggtttgagacataaaatctaggcaaatttattatatatatatattaaggacttttattagtagctccagagagtagaaatgaccgccgaaatatttaaggaaaaacagctagactgacatgtatccagataaaaacaaccctgtaatgcaaataaatccaagaaacaaatcgactattttagttataaacttaaaaaagattacattagtggcgttcttcttgagcctaaaattaacatgctaccactaaatgggaaggaaattgaaaggacaagctagtatgtaagctattgattgattatggatatgcacatacgattctataacgtgagctgctttctctgtcccaaaatattaacatgtacgtattggcattaactttgaaaatgtactaggaattcagttagtttacaaacaagataaaactaattaatttaaagcactgaagtacttcctccgtttcacaatgtaaatcattctagcattttccacattcataaatagagatatatgtctagattcattaacatcaatctgaatggggaaatgctagaatgacttacattgtaaaacggagtaagtaaatcattctagcatttcccatattcatattgatgtgtctagatttattaacatcaatataaatgacttacattgtgaaatagagggagtagcaaagttaagagagagagagagaaatagaaaaaaaaattaagcatgtccatgtcagcttgggggtcctcttataagtcgtctcctccaaaccctcctcgcctctccatcctggagccacagccttctcccctattcttagcccgcctcgccgcctacgtcccggcgcgcgcgcggccggccgtcgtacaaacccgcgccccctgccccccgccattgccgccggcggccacccatggacatcgacctcgaccgggcgcgcgccctgcgcgtcctcggccgaggcgccatgggcaccgtcttcctcgtcgaggcccggtacggcggcttccgctacgccctcaaggtgttcgacaagcggtccgccgcggcgaccaggcacgacgccgagcgccgcgcgcggtgggagctgtccgtgctctcccgcctcgcgcacccgcacctcccgtgcctcctcggctccgccgagacgcccggcctcctcgcgtgggccgtcccctactgccccggcggcgacctcaacgagctccgctacgcgctccccgaccgcgtcttctccccggcggcgatacgcttctacgtcgccgagatcgtgtccgcgctgtgcgagctccacgcgtcgggcgtggcgtaccgcgacctcaagcccgagaacgtgctcctccgcgccgacggccatgtcaccctcaccgacttcgacctctcccgcctcctccctcccaagacggcggcgccgtcgtccgcgtcgccgccgccgcgcatgttccagggcggcggccaccgcccgcgcgtctcggcgaggagcgagatccctctcttcagccatgccaccaagcccgacccctcgccgccggcggcgaacccgtcggcgaagcagcagctccagagcctggtccggttcatcatgaagggcgacaggagcgagctgtccaagaaggccaagtcggcgcgggtgtcgccggtgagccggaagccggcgagcttcgcgtcgtcgtgggggaagtcgttctcgttcgtgggcacggaggagtacgtggcgccggagatggtgaggggcgagggccacgggctcgccgtcgactggtgggccgtcggcgtgctcgcctacgagatggcgtacgggcggacgccgttcaagggcaagaaccggaaggagacgtt

SEQ ID NO: 61386 - DNA, 2666 bp, Oryza sativa
aagacttcagcataagagaatacttcgataagcttcaccagccgccgccgccggagtcggagagctcctcgtcggagttctcgtcggagttctaatctatctaacgtggctgctgcctctgtactcctcctactttttctttgggtcatttttcggtttggtcctcgttaggttactattttgtaacgaaggggctgagggtgcgtgtatatacgtggagaggggcggcaatgtaaattcggtgtagaggctgtggagatgtgcaaaacaacatttttggagggctgtcgcacgtgcacgtttctgtatgaggctgtccaagccattttttttctgtatttttctcgtgtccttttttcagtgcctggcagaagaatttaccaaaattgtcacactgacagaaaaaagcttaatagtaaagaattttttttttcaattacatggattacatggaggacggaaagtcattttgtttacgatcttgtttgtcctttcgaaattgagtggtgaaaaaccatttcccatatatatagaacactaaaggtaaatgataagcaaaatagtgaaacgggttgatatacaattgcatgagttttaaaatatggtcataagttacaaatcataattaattatttcaagttagtaatacttttttttgaagttaattagtacatgcatctttaatcatataaaagacacattcatcacataattaaacacgggtttagtatattgtctttgggcgtgcttaactcctttgtttcgattttgtatattgcagaggagaatatttataattacctcccgtacatctctacaatgattgatccacgagcgctggtggttatatacatttatcatgccaattgcggttcgtacacatgcaactctgattaattaggctatgttgtttctgagctgttggtggttgaaatccttaacatgctcatctctcctggtttccagaattttcgattgacacgcatgtggcatgctatgtttaatctctggaccttgatttatataccaatgagaataatatacatactgcatttaatttttgggctaatgtgtgcacggatgacatgattccttaattaactaggtgaaaccccgcgcattgctgtgggaatttagtatgataataataaaaaataacatgtaagatagctatataacatcagattaagtaaattaatgtggtttatgataatttaaatttaaatagtatgtagaatggtgatttaaacgtaaaaagtaaggtggtataactttatagaagaagaaaaatagagagatagtttggaccgtagattaatcatctaaaggctaaaaaaaattgatgtgatatgacttaattagaggaaaaaaaagagaaagataatttggaccatagattaatcatttaagcactaactaagtgaggatgaactatataagtatataggatatgataaaacataataaagatatacattgaaacattatgtgaattatgttgaatgataatttaacatgtttgtattttaaaagctcttaaattataaaaatataaagatatagcatgtttgtatgatgtttaaatatgatgattgttagtggatgatgatgtggtatcttgttagtggatgatgatgtggcatctttgcatgttaagcttaaggagttagtggaggataactttacagtaagataggatttctatccacatcatattcaagacagacagttatttacaagctcattcattagagaaaaaaaatatatcattgtttagaaagctggagattataaaaagcagcctaataaaaatatgaaaaggctagattttagctcttataatatctagtttattttctgggttctatagcttccgattcttataatctatataaaagaaattgtactactccctccgttctaaaatataacaacttttaaccttcaagatttatccccaaagataacaatttctccaccaacattctcttcctaaccaaccacaactctccaccattcacttttcccacctaccttcactaatcatccaatcacaaccctccaccattcacttttacctactttcttaataaccgtgttcaactctaaaacttcttatattctgggatggagggagtatatatttaggggagttagagattatgagagaaagttgtagctatcataaaatattatctatatgtttatacatattcctattccttttaaaataatggattaaaattcaacatgtatatccacacaaccaattcctatacatatgaaatgctataagagcaagtttaataggcggctataagctggactataaacttacgtgaagaagaaagaacttgaaagagttctgctatacgtacgactctagtcgtatggcccacatctgaccagcaatcagtacacttaagatctctttatgtgggtctaggcatgtagtagcgtacactagttggacacaggtcggacacgttgtgtatagacatttcaaatttgaaaaataaagagagttggctctcatgcaagagctagctattcacgtatttcaagatgaattcattaaatacatatatgagaggtagagaggggagaagaaaaatagcgataaccttatacctcatctactatatatgttaaatattaaatataat

SEQ ID NO: 61387 - DNA, 3484 bp, Oryza sativa
agaaggcaggcgtttaatttgaccaaattaaatttggtgtgtgggcgcctaaatcttttgaacctcatcaatcgattagcgtaattggagaatttcatggagattgctcatggattaggagacagtgggccggtttgttttacacgttatggtactactgagtaagccatgcatcttcttcctaaaagcattaataagttgatgaatccacattcggcgtgaggttgcatgcatttagcagaatatgcgtgtctgtaacacttagtttttctttcaaaccaacactttggttttttgtggcacaaaaaagttcagttgtgttggtagccacgttcaggtatggttgaaggccccagtccgctcattaatatcaacacgtttgaaattagacagaaaaacatatcacagagatgaactaataggtctggctcggttaatcatttttccaaaatttagaggagatttatttcactcctatttgaatgtaaaattaattaaccatactcagtctcttcctatccctttctctaattagggattaatcgacaagggctagaaggtaaatctgatgaccaatttctcttgtttaattttgacaagatttttttatgaattaagcaaaataattttcacaggagaatttcctgcattattacaaacgggtctggtctgacaaaggtgctagaaaattaataagctgtcacactactaggtcagttatctataatattacctggcaatcatatcagcttattaattaacttgatcttgcctactctgtctcagctttgtccattcctttgttgtgcaagcatatctagattgagttttcagtaaattggaaaaatcagctacattgagtttaattcctaagctcaccacttcaccgtgtgatgcattatgctgacaatatctttactactgctgatgacagatcaggtgaagtcgatctcggacgccgactgttcagcacacacaaccatatctacattacactgaacattcatctcttttgatctgagatcatatatatatatatatatatatatatatatatatatatatatatatataggggtcacttcctggggatctatatcagtatagtttctttgcaatacaactactttcagattggctactactttactttcgtaaggtactgagaatctttcagcaccaactgatcgaacagctggttcatacatgtgccacgtagtcttctgatgaaacatggagatgtgtatgtatgggagctcgacacttgttccatttttggtcagtaccctgcattcatatacccactgtgtcgatcgtgaattcgtgatgcagtcagtctcagataatgacggatcgatgtaagtcattgcctctaaataaatccgggccggggtacattgaatccatctatatggacttttggcttcagatgataatgtcaacgagattccaattttcatattgtctcttcggaaaaaaaaagagagagaaattgaagccatggaattggagaaaagaaataaaaattgctagcaaaaacagagcaagttcatgccgaaaagggtagtttaccttgaaagtgttggagtagctcacgcccagccaggcgtgcatagaacgctggcgtggtacttgccctgacctagaaccaactcgccgccggatgacggcggtcggcgggcgctcgacgtcggcgacagagttgggcgcgggggatgaggacctcgccggacgccacaccgaaccttgactcgaagacttcggcatgcaggggaataagttcactttaggtctctctatttgtcgtccagtctgatttttgtccctgaaccgtaaaattgggtacgacccgtcccccaacttacgaaaaccgggcaaacgaggtccctcgacggttttgatagcggttttggctgacgtggcgcctattcggctaatttgactcggtcctcatctcacatggcactgacgtatcgcttacgtggtaattcgatccggaaaaataataaaacccatgagacccacatgtcaattgcacacaaaataattaaaaatggtgggacccacgtgggccccacatgtcatcctcactcctttctttctcctctctccccatctccttctcttcgtctctatccccttttcctctctgttctctctccagcgccaccaccacggactcagccgccgctcccgccaccgccacatccctcgctggtgatcaagatgaggttccacggcgtgccggtggatctcgtgtacgccggcgtgtgccttccgagaggagaagcgagcgatggcagtcatcgagttgtagtttcataggatttgtgttccaataattaagggatagagaggcatgcgatattatatctgattgatcagccttacaaatgatcttcatcttgtatcttcacatatgcagtggtggtttgaacacttagttagtttgggcatcaaaccagtgtagcactcggtgccctcgtaatcgttgcccctcagcctcccaacctaacagattgagctctcatctagaaacgaagagtggagaaataggaccggtctaatacgcgaaaatgtttgtggtcatcggcatgcacgatcgagaaaacaacaaaatcggtggcacctgcaccttctagatcgcgatgccatgtgcattttgaaaacttagttggcaatgtactggcaaatagttatacatatgaactttgtcccgacacctgggctagatattgtgtaagctattaagcatgagaactagaaatattcagccagactaggtctcaaataaaaattatgaattcaaatctaaaattactgtatacttagtgtgtttcgtagtagatatgcgaatatttcttgggattttacctcgcaccatttatttttaggaaaaagttcgaattatccccctgaactatcgtggtcgatcgatttacccccctgaactcaaaaaccagacattgctcaccctgtactttttataccgatgaattacccccctcgacccaatccagagcggttttgtcctatgtggcgtacgcgtggaaatccagtcagctttttatttattaataaaaatatgggaccacctgtgagactcttatccccctcttccactctctcttctctcttttgcacgcatggcgggcggcggtggaggagaggcaagcgaggcggggccgtggcgggaaggcaaggcgggcgggcgcaggtcaagtggcggcgggcggtcagtgtgtggggactggcagtgggcggcggcgcgggacgcagaggcgggagcggaggcgggaggccgccacctgcacccccccccccccccccgccgcgcgttcgtgaacatccggctcagcacgctgaccttgtgcttccctccgccgccgccgcgccgatttccagccctcgtcctccgccgcctcgatgatccgcactcccctccgaatgactgcgtgtaccagacatcagcctcccccaaatc

SEQ ID NO: 61388 - DNA, 1566 bp, Oryza sativa
  unsure (1)..(1566): unsure at all n locations
catcgcggctcgatcccgaggtgcccaacagcgctgctcctccacagcgtcgtcgcgcgtgggcatcgagaggaaagccggaggcgcatgaacctatctcgcttggcgacgacaggagagaaagactagaggtggagcgaactgtttggtgcgggtcaagcagaggcgggagcggaggcgggactccaagggccagcggctgctcttgtccctcgccggagttcgccgccgccgcctctgcgtcccgcgttgcctccgcctccgcatggaaataatcgccgaattcgatacaaaaccgggtgttttgtgactgaattcaaccctatcatatacagtatatttgatcctttggatcttgttgaacttaactaggtaagcatggcagctcatggcggtggagacctcgaagctgcagctgcagcgcagtaccatgcatgccgtcgagggcgccgatccgcacgaacacgaagcgcctggtggtcgtcgttcggtcgtcgttgttcgcgagattgcctcctgtggacactggccttgctggggctaaccgtgctgctgctatccacgaggctggccacgacgacgacgctgcgcgggaggttccgtaaccacgacctcggcctcggcgccttctccgtgcacctcgccggctacgagggaacgcctaccgctgctcgagagagaggaagagtgagtgtgtgtgagagagaggaacatgggaaagaggaggtgagagagtatgacaggtgggccccaccattttaaaaaatgaaaatgttgattagattgccacgtgtacgtcacgtaggacaaaccgctctggattggatcgagggggggggtaatttatccgatattgaaaattcagggcgaacgatgtctggtttttgaatttagagggtaatttagtcaaccgcgatagttggaggggtaattcgtactttttcttattttttcgtatattggcatatgaggcctattaagaaatgcaaataaagataaaaacaagtacaaagtttcttatcatatgacttgacataaaaatgttacatacaaaagagcacaagagagtagtggcatcattagtgccagtttttcaaggactggtacatgtgaaagtacatatatgctggtttctattgagaactaacacatactaccttcatcctaaaataagtgtatccgtggatctccgtttccaacatttgaccgttcatcttatttgaaaaaaatttaaaaaatagtcacacacaaaatactattcatgttttatcatctactagcaaataaaatactaatcttaaaaaattttcaaataagacgaacggtcaaacgttagaccttgaaccgggcgcaaacttggacctatttttaggaccggggggggtnttttacattttgtatggggtcgcttttccctgaccgttgcgccctatgccaccttatttgaggtcgatcttcatatgaccgtggcaatgacgtggcggcttacgcggcaatttgatttgtaaaataataaaatttgtgggcccacatgtcatttccactaaaaaaataatttaaaaatgg

SEQ ID NO: 61389 - DNA, 6349 bp, Oryza sativa
ccccgtcctggaggacctgcggctcatccgctgcgccacgggcttcgccgagattgtgtcgcggacgctgacgaggctgatcatccacggcagcggcggcgagctggccgtcacagctcctcggctctcctccctgtgcctcctctctcgctggcctccgccgtaggcctcggagccgccgtgcttccctgcttcagccgcgccgacctcctcctctcccgccgcagagaaaactgagagagagagaggaagggagagaagagggggagagatttgacgtggcatcctgacatgtggggtccacgtgggtcccacgctgactcagtcgccacgtcggataaaaccggcgccaaaaccatctaaggacctattatgaccggttttaattagttgagggacgccggatatctggttttacggttagaggacaattttgtaactcgatgacaagttgagggaccttcggtgtactttttccaaaaataaattggtattgactcaactgccaaacggtttattttttgaaccaattttctgtagaaaagttgtttcatacaatcatattaatctatttttttaaaaaaaaatagctaatgtttatttaattattttttaataagtcgatctgcgtgcggaattcccaatctaatgagctgcctaaatgtagaattaaaataatgcaacgcacatgcattttgctagtgaaggagaaaaaatgtaagcttgtaatcatttgcttgctggtttaatcaatggttcagtgaatccctcaaaaaaagaaaaaggaaaatgatttagtgaatcgtttatttgaagacaaaaacgacacaagaaaatttggcagaatgaggcatcatcaacaaattatttacgacagaaatatgaacattagatccaccagttatctgtcaaaaaaaagtatgatttgatacttacagtcccagtcaacatattgacaactatgttgggcagcagttttatcaggtaggtacaggtaaaaaataaaaaatggaggcctgatgtccctattttacatcttcctagaaaaatcaggtaagctcaaattgcagcacaactgcatgactgcctaaaaatatgtttttttttaaaaaaaaagaaagtttaaaggatgccaccatgtgcaactgcacttcatgttcttttccagaactggtattctggaacaactttctctcaagtttcaactggctttaaggttggaacaatccctgttttcctccatattagagcaatcatcatccagaaaagagttatcaacagataatttcgtcatatgcatagactttgtaaaagctccacctccagttcttcatcatcaagttatgtcatgtctgagcattgtgtgaggcgccaattttccgaaaggttcctagcatgtgatgtcgaagaattatctttatcaggcaatattcaagtctttatatctaactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccagaaaggatggtcacaaaaccacacagcttcgtgacaatttgtgttggattttgtcgatcccaatccctgcacgtataaactatgctatcacaaattgaagaaataaactttccataaggcatcaatttgttcttgaagacagcaacattgtgaaagaaaattaaggtgcgtagtgcacggtaacaacattgtgcaaaagtataatcacagcagcatagttagcggagcaggacacatgtagaactacacattaagccaaaaaaaaaaattgttcatagctttctgcaacaagaaagttgagtgtataagggctgaatgcctaatggaagtgatagaaaaagcttaccttaaacattatcacactggctaaaattgttagtgaagtaaacatcacgtaatatattggtgagacaactgctgtattaaaggtgtccaatgcctgcaagtcacagagataaaagaattactattgcgttaatgtaataagcccttatgtgatatgttacaataatggtagctcaataagctacatgttctgtactattgcccagagtgacatttcaatgccccagtgacgagccaggaaagttttacagcctgaagccctggaaaaatctaactacgctgagtatatgcggcaattctattttcaatccctacaatgatattaaaattctattgcacattcaccaacgatcccgggtggctccaccactgctatgccctacatattatttgagctagtgaagattcttttaaggacaggtgcgatgaagttgtatgaatgagacaagctgttagaagatcccttaaactcaagttaaatctcttcatgtaccttatttagatagtttatctgggtgctcacacaggtggctacaattagggcaaaagcccatgtctgaggatagaataactggttcactcctgagaatgttaacttcaatgcaatgccgagagcttttacactcatcacctgttaaattctcaccatcagatagaacatggaatttagttgaaacaacagtagaaaaaacaacaaaattgattatgattgggtcatatatttggacaggaagcgtacagtgagagatcctagaagagaacagactccgatgtacaccatgatgtttgtttgtccatgttgagggacaacaaaatatataagcaccagtgctgcggcaactactatagcagcgtagcaaagaaaacctggaaacaaagggaaaacaataatgaatcagacattcagtctagcccgtggaacttacagtaaggctgctgagggctatgttatgaacatattttaatacagtaaatacctggttcagttgcaagatcccaaacttcccttacagaatcgatgttgcgctcctgtggagcatggagtacaattgtgatagatccaactacacaaagaacacaaccaagtatgccaaaggtgtgtagtttctcctgcagaatggcgtgtgcaagtgcagcactgcacaaattgacaaaagattatggttttgatttagcaactagatagcaaaaacaaattttagcaagtttcttatttgattcatctgaaattacctgatgattatactgagtgccccaagaggagtaacaagaatagcaggagcaaatgcataagcagcaaaatttgcaatttctcccacaatcactgttcacaaaggtcatgtaagatgccattagtcaagtttctttccttagtgacattttttgtctaaaaacaaatgaaacagtaacttcagtatattagaaaatacacatttctgttcacttccaaccaataaattccaccaaatatcttactgaaagaataacaaggaaaaacaacagccctaggagcagacagtagtaagagatattcatgctaaggagccatattcaggtgacaggaaacactttgctccgtacaatcacttttcatgccccagttaagctcaaaggttctactaatatctagtcacatacttgtatcaatgtaattatctagaatatcgttttggcttcattgaattcagccccaattaaaaatgtttagtttctcctaatacaaagtaactgtatttatcctgattctcaagacacagaaacatcttattacaggtcttagggagttgacaacttgacatcaacacgagtttacatgaccaactaaccaggtaacagacaataaagatctcatcataatcaaagtgacatcaataaggaaaaaataattgcaggataatgtttgagcagagcaagctatatgttaagatcaaaggggaaaaaactgataaatccaatgatagaaaaaaaatattgtgcacataatgtgacagaaaagaaaggaacattttcaagaagtacaaaatattgtataatttaaaaaggaatcaaatgtggcttactagaaatcatgcctatccaccatagaggctccattaagtaagaaaatcctccatatcctgtttaatgcaaataaagaaaacatgtgacctcctgcattgaaacttgtagagcttgcaacacaatagcttatgaaatatcacacgaataatgaaagtgcattgatctgacatcaatcatttcaggtaagtgcataaggacatagatcaggttgagatgtaagtgcatgttttgttcatacgttaccactaggctgtcctaaagtaagctattatagagtaaagtatcatagtagttggttggtttgataaaatattgcacatgtgacatcgctatcatggaagtgaaccactagccagccaaaaagatgtaatttcgtcctggcatactgaagaaccatatcggttagccactaatcgcagaagcaccacaaccacctagcaatagaaacaacaacccgaaatttgacttgactttactctttccgcaaaccgaatcaaacaaaatccacagtaatcatccatgactcgatcagatacagcttacgatccagaaattcaaaataagcaaagcattggtaccacaagcattgaacatcatcttgtataaatatttaataatggaggacaattgcaaaaggccaaggataccaccacaaaagacaacttttttccggactcactcatcttagttccaataaaaaaaaatctcacaagtaacaaatgccgtatcaaatgaagcaagaaaaaaaaattcttcagagagtcaactgatcctccttgcaagtaaagtaaagatccttagactcgattagaactacttttgcaggtagaactttccagcttccacgcccaaatcattgcaatccttttcacccgcgagaaaagaaaaaagaggaacaaatccatccaatcgcgaagcaaaagatgtctctgacaagattcactacttgaatcaaagctatatttttcacatcagcagaatctacccgccaaaacggcgtcacctgtgcccccaaaaattttcaccttttcccagcctctctctcctctgacgagtgacaaccaaatcaagattctaaagaaaaatttccaaaaaatatttctactcccatgagaaatccccttgactcaatcagactatcaatttactacccaagaacaacaacctcgccaaataaaaaaaataaaaaaccaaagcagaaacagatccctctctctcccaccgagcaaaccaacaaagcaaggaaagaaagctaaccggaaaccgcgtcgccatggaaagcaagatcctccgctcgattccactgcccacgaatccaacccaacccaacccaactcaacccagcgaggaaaccgcgtagaccctaccctccccaaccaccgccaccgacgaacctcacaccggcgcgcggggggagatccaaacacccagagagcacgcgcgcgcgggcggccgcgaactcaccagcgcggacgccggagtcggcggccctcctgagccccatcttcttgacgatgaagctcgccccgatgaaggcgctcgacgacaccgcgaggaccagccccttggcgttgtcggtggacatccccgcgagccccgccgccgcagccgccgacgcgggcgccgccatcgctgccgcagccaccgccgcaacctacacttcgcccccgccactgcacggttactactccaacgccgccgccgccgacgaggaggtcatggaggtggaggaatcggaagcgggagggaaaggtagaagaagaagaagaagaaggtgagaagaagtgggaattttaaggggagggggtgtttttgcgacggggtcctcgaggattcgctttattaccaaatcctattcttttttgggttagacaagtagtatccgtttttagaacggtttacctaaatattaaaaaaaaacttgtctaactcttctagtttttgttggattaggcattgcattctcatctcagatctactatatgtgttgttcttgttgtaaaaaatactatccttttataaattattaaattattgctcgtgttcgcaaataaatacttgctatagtttattttatataagtactcgtacaaacgaagacaccaaaaccacattgggaattgtttatgtaagtgttcgtaaaagactcttgtatgtatgtttaaaattacttatatttgaaatcaaaagtgtaaatttctatgaggcagctt

SEQ ID NO: 61390 - DNA, 672 bp, Oryza sativa
atatctgccatcaaaataatgtagtctacaaacagttcaagacagtatattatatttgaccatttgtgtatgacactgtcctatccatcatctatgagatcatcacttccaccttctcagaatacaaacaagattacttcaacttttcaagtcatacttccaaaaatacaaaaaaggtgtgggacaaatcttaattcaagatgaactgttcattcgcattttgctttgaaactgcaataggttgcaccctttcttttcatcatttccttgcagtttcagtgtaccaagcagggggcttatatctgcattcatgcataggcgcaagaccatatcaaattcatccaaattctttgctatcctccaatttgaatcgatctgtacatggagtcatcgaatttaattccgccctcatcaccttcatttgcgtcttgaataactctaattaacactgcaacaagaaagagtatcatcatcattcaacaacaaaatttgatctgatgattatctatcaaaacacaaattcaacaatacttgagacatatcgagagataccaaaatttttggtgcaaaattggtatgtcttaccatcagagatattaagaggtatcaaaatttatattaaaaaatagagaaaagttatggtccttaaaaaaatacctcgaggtacctaaa

SEQ ID NO: 61391 - DNA, 682 bp, Oryza sativa
cgaatccgattgtctcaaattagcatgcaagtttttttaaacagatttcttatatgattccttctatattaccaaagtgaagatcttaaaaaccgactcaaatacagatatgtatttcaaaaaccaaacgaacttaaaaactgactcatacacgaatgacgtatcaaaaaaccagcaaaaccatcttcaatttttataatagtagagaagagatatagattaaaaccaaaaaataaaattaaaaccgactcaaacacgaatgacgaactgcgaaaacatcttcaatttttataaccgactcaaacacggatgacgaaccgcaaaaacatcttcaatttttatagtagtagagaagagatgggatgaagcattccagtctttgctcaagagctatagccaattattacaaggttcacacaaaagtaaactcacatagtgagtatgtagccaaagtaataaaaccaaacaaggtaaagatcccacgactactgaattctattggtgaatctccatccgaagttgtcaaagagctgcatgatcatcgactcaagttacgacacacatcttttattagcttgatataatcatcatgccgttttaggtgagcccattcccggagctaatgtgttgtcctgaaaagacatgcaaataaattttgaggtgatctatcaaaaacatttca

SEQ ID NO: 61392 - DNA, 1255 bp, Oryza sativa
  unsure (1)..(1255): unsure at all n locations
gcatgatctgaatgaggcggttantttggttgggtgctgcaagttgcnggatggcataagaaaaanaggaacgccnaatttggcacttttcctctgcanaatagagaatgcaataattntgtatggtgggatggagtatctgctgaaggacgttttttttctcctaaccgctattttctcgatggatgtttggatggcatatctgttgaggatgctcttactctgctccatctcttctatcttcagccggctctgttttgagaacctttggaagttatagctatttcaaaaatctctagcttcatgaaacaatctatgttcttatttcaaaatgtaataggtttagtgaatttttttaggggtgaataactaatacggtccttgatatttcatttcgggctcagtttagtccttgagatttcaaatcgtccaaacaaatcccccaaattaattattgggataaatatagtcctttgacccacaaaaaatgccacgtgagcacgttaagtcatcttcgcatcaagcagaatgaatgaaatgaccattttacccttatataccatatagaaaagaaagaaaagatacaaacagaaaaagtaacatgccagcccaggcccagcattgttgcagatgggtggccgacaaatgaatttacatgatcagtcctaagtgacagttccaaaacgatcatacacgtgtgaaacatttaccttcttacttttctttcttttctatatggtatataagggtagaatggtcatttcattcatgccactacatgagagaatgacttagcatgctcacgtggcattttttgtgggtccaaggactatattaacccaaatgattaatttggtggacttgtttggacgatttanaaacataaggacttccccccccccccncnnnnnnntnnnnnnnnnnnnnncnnccnncccnnccccccnncccccccccccnnccnnccccccccccccncccccccccncnnnccnncnccccccccnnnnaaggaaaaccgtcaaaaaaaaccttacaaatacacgttaattgggggaaattcgctaagggccacaccaggaattaaacaggatgcatgcgggggcacaactgaagttaagacacaagttaacattgttaaccttaaaagagcagctttgtcttctttagaacaaacccccgactttatgacccaaacgaccaagaaaaccgttggccaggtcttttataccaaaacctccaagagggaagaaga

SEQ ID NO: 61393 - DNA, 1911 bp, Oryza sativa
  unsure (1)..(1911): unsure at all n locations
cgcgctggaaatcacttgcatgaaanncccctangaaatcctggcataactaaactgttttctatgcagggccagccgcaacacccgcattatcctttgccagcatcatttcctccactagagcgtcagacaatagcctggacacgcacaaaccaaatgtagtcgggaagaaaggcaagaaacccaccaaagtgctcttgtccactggcggtggccgccgatactgaaggaagagtgacactggaatggaagcagttgccagttggctgtttcctataagcagtgtgtatagtgcataacctggacttcacatctgtaacactcccaagtcccaagtagcagctttttctcccatttggtttgatctaaatcgcctgactgttttagaaggtttttactgtgtatctacatcctgacccatgctaagggagtaagggtgactgccctgtcgcaaaatgagaagagctatgtaaaatttgataaataatgatgctaaggatcatgcgcaatactttgctcaatgtacgtcgacgagttgatccgtcataggctgatacagcctgctgtttaaatcgtgagatgctctgagtcatattttcaaaatcacggttacggggcatatatataaattataaaatacacaatatagaaggaaggaaaagcagaaatgcatggtttaatgcaataagtttcaaatgggatggaatgtcaaactttaagtaacttatgatgatatttatactaggagtattggcaatgtatggactaaatattgaaaaagtagcagaaattaatttctttgtttaaaaagcaacggaaatatgtgttcgatagggtaaagctaatgggcgatcgatcgccccaggtgatcgaccccatcccccctatatggctcctctccccttcttctcttcctactacaccataaatctttttaaaaataaaaaaacagttagaaaaatttatgtatagaaatactatatatataaaaaatatttgaattcaaatttaaatttgaatcgggtattttgacttataaactttgggttaataacctttagatgtatagaaaatcctatatataaaaattatttgaattcaaattcaaatttgaataggatatataactttggctctctaaactttagatgtatagaaaatcctatatataaaaaatatttgaattcaaatcaaatttgaatcggatgtataaacttttgacttataaactttgggtctctaaactttaggtgtatagaaatactatatatataaaaaatttgaattcaaattcaaatttgaatcgggtatataaacttttgacttataaactttagatatatagaaaatactatatataaaaaaaatttgaattgaaattcaaatttgaatcggatatataaacttttgacttataaactttgggtctctaaactttaggtgtataaactttagatgtgtaaacttgaggtgtataaattttagatgtataaataaatttactaaaaatagaaaagtaatacggtaccaaaaaagaaaaccacgttgaggaggagggggtgtcgccctgatcgcccttagcgatcaatcgcccattagcttttccatgttcgatatgcattcgagagtatcccgatacgcatttgtgtttgatacgatatctgatatggatatgcttgtttttagaagtatggttttctctttttttctgaaataacaaattaaaatggtggtaaatttgtaattgctcttttattttttgaaaggcagcatccaatattggacatgactacacagcgctactacttcatctatgaaaaatcctatccacctatacttcaaataaaaattcctcttaaccacccacgtctagggacctcaagtgccgggggcgagagacgtcacctgccc

SEQ ID NO: 61394 - DNA, 833 bp, Oryza sativa
  unsure (1)..(833): unsure at all n locations
cactgcgattggaatgcanatacngcactgnacccaaccaaaacccccgcgcatgcaaccccctctgctctgtcgtaaccaaaaatttccctctcccctgcgaactcccaccacccaaatttaacttcctcaaccttccgcccgtcgcgccagctggcccgttactgacagggtgggccccacgccccggcgcggtgggtcccacgcgtcaactaccgtgggtagggtgggctcgggtgcgcccccccccccacccagtcccgtgctccgcggtggcggtcaccgggtgcggggggtgggccgcgtatataggcgggccgccgcgccgcgcgctgctggctaggtgtaggagcttcagctttggcccacatcgcccccctctcgccctcttccgtagctttcgtctcaccgcccccaccgcctcgcctgggggaggggaggggaggggagcccttcgccggccctggcaggttccgtaagcatttttagcatgagtatgtggtgggccgcgaatttgtttgacgttggtctgcctttggggccctgttttaaattccttttggtgccgcttttgaagtccctcttctaggtttttgtagggaaggtgtttgtagcagctttccttcccggccccaaaattgttttgcctactttcggtaaaaattttagaggagctttgtcaccactatttatattttttattccccccccatctatccacaaatattttttgagggttcggccctccattccagctggtgtttctttctctagtaccgcacgaacccaggggtgatgagtggatccctctcttcatattatttcagtatagg

SEQ ID NO: 61395 - DNA, 2809 bp, Oryza sativa
cgcgtggattgatatacactcgtaccccttcgtagacacctgcgaaaagtttcgaccaagcgccggtcttttcatcacctcggtacgtgttcaatatgttgcgcatatttgatatgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattgttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggataaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcattgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacacctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgacttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaaagtggtgttcaagaaagagct

SEQ ID NO: 61396 - DNA, 7014 bp, Oryza sativa
ccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaagaagttctgtaaaactcttgtccgaccagccattacaagccttaagcttcatgagttccaacacgcatgacaacttgctgtgcttcgacttgcatccatcatacaacggcatctggcaatcttccaccaacttactaaacttctcaaaatctctgtcgttgtcctctgcgtcttcaatgtcatgcaacattgtagatagacattgagtgtccaaatctatggtctctccacctaaaggagaaggtacgaacatgccttctcgagctgcggcggttttctctacatcctgatccaacacttcttcagctgcaatatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacaatgcgcatagtacatccatctacgatccatctgaaatcaacaacatacgaagaaaaataaatgataatcgatatgttgagaatgaatggagaataatgtgttttttaccttgaattttagcaaaaaatcgccccccttgccctcccaaccgatttgtgaacagtaaaatggtcgggatggaaagcagttggcagtttgaggggtatttatagacccaacacacctcaaacgggttagataaaaaaagcccgtcaaaggtattggtcatacctttgacgggcttctattcagtggcccgtcactggtatcccctcacctgtgacgggccagaaatgaaagccgtcacaggtggcggcccatcacctttgacggcttctaatgtatcggcccgtcacaggtgaggggataccagtgatgggttggaagcaaaactcgtcactggtatacctttgacgggttttcctttcggcccgtcacaggtgaggggatacctgtgacggtccgcggccggatggctcaccggtgacgttatcccgtctgacccgtcagaggtaatggtcactagtgaccaaatcgtttgcccgtcacaggtatcccgtcagaggtgtgacgatctggcgtagtgccaatagtatctgcttctttaggggaggaggagtaatgggtggcctttttaatgtcgccttttagtagccacagaaaaacccccggtgaaaatcaaattttcattggcagatgtttaagtgcgccgccagcgaaaaggtgtacatcttcgctagcggccctcttaaccttgctgccagcgaatatccattttcactggcagtccatagccccccaccccttagagtattttcgctggcggtgatcatgtatagccaccagagaaaaaaaataggttgacggcatgaaaaatcgtaagcccgttctaggattctgaaaaggctatcaattagaaagagaatcatatagaccatcaaatttatgtataacttgtgtaacctatggcttagattggatttataatgagacaatgcatgaaccacttatgaaaatcttattgaaatccgttataaacacggctgtatggatgatctaaggtggctgagcctacattaggaaatctcatacaatgtatatataagttttattgtgaatgttgagtgccatttcctttaatattatgtgctttaacttaggattctagaaaaatacacaggctatgtttgggaggtgaatttggaacttaccggaaagaacacagctatagtagagtgtaaaatttcaatttttgctcagatgaatgatccgagaccatggatgactagagctcatcaaataatgtgaaatatactatatgcacatttgttgtaatcagagtatctagagtttgggtgaaattacggcacaattgaattaattagttcggatcatccgatttccattattaagagccataattcttttgcaacaaaaagaagagagagaaatacagagatgctggagggctcttgcatgttttattaggatgaacaatggtcacccggttggctgctcatgtttctgcacatgcccatgtgcctgagccgtcgataccaccggtcgcagacatgcgctgcatgtcacatcaggaaattaccatggatgtatctatcaggacgcatggcagttggtctcgccatggctgggtctcactaactagttttgccagctcccaaccatgttggtgctcatggtcgtgaacgggcaatatggatgcccgatgcctccgaagcctagccacatcaattacttgttcgtgagatccatggctgaaaacaatgcaggcgagctgcttatccgcttccccaggagtacaacgcatggctgaaaataatcgacctcgacagatctacgcacgggttcatcgaccacgtctccttcgcttcgactacatcgactatggcacaaagggctatcatccgtattgagcattctcgatggttcattggtggagaaaccatttatactctcggttggtaaccccttttagtcccggttttccaatagggactagcaatccgggactaaatatacacttctttagtcccggttagtgttaccaaccgcgactaaagagaaggtatctttagtcccggtcttttttttcattgtttcttttgccatagtttaatccctgtattttctcccaaatcgagtgggatgcatatccccaaatcccaaatcaaagtaacatcccataacattcacatcacagatcttaagttacttatacacacaaatcaaatacatcacaaatcttaaaaaaattacacacaaatcaaacacatcacatattatacattttagatccatgcaacgaatcacaaaattatacatctaagtgaatcacaaattgaaaaaaaaagagaaaggatgctggcagtggctgccccctgccgccgctcgccactcgccacaggcgcggccccgctggctgcctgctgcgtgtggtcccgccggccttcggatgggaagggtggaggggggagagggccggggatgggaggaggaaggggaggagaggggagaaggaaagggggaggggaggagaggaggaagggatcgatctgaggagatgagaggctagttgtggaggagaggataactgcgaagaggccggttgtggaggagaggataagggagagggattatatactacgcgttgaattttagtccaaccgggactaatctttagtcccggtttgtgacaccaaccgggactaaagatcctcagccccctgacagactactgacaggggataaacttggactaaagatgatctttagtccccattgttgttaccaaccgggactaaagatcgtagaatggctgtggggttttaaaccgggactaaagatcatctttagtcatggttcatcccctgtcagtagcctgtgagggggctgaggatctttagttgtcacgccctaaaaatcgactaaattaaaaatgcatattttaaatcatttttagaaattgttttaaaagcctacaagctaaaccctaattttctaggaaaatttccaacataaaaatgagctagataaaattttattaaatactatgcttgctcctctattttctagagttttctgggaattatttgagcaagggaagtatttttaataattgaaacaacatttcacaaattgttttattcaaaaaagttcaaaaatccccctcctaggccgttgggccgatttcggcctaactctctctttctctctctccccgcgcgcggcccatgccggcccaagccgccgccgcccgcgcccctctctctcgggacactgacatgtggggcccacatgtcaggcccttcttcaacctccggccgccgccgagaccgagcccgagccgccgtcttccacctccgattccgcccaaatccgagcccgattcctccgggtttttgaggggttttgttcctctcgttctcctctttcttttcccccaagaatcaaagcgaatcgttgagtattctctccgaatcgagttcgttttgattttatccctaaaaccgagtttgaattcttcccgaatcgattcctctcgtttggagctcgatctcttcaatccaatgccatatatagcttcctctcgttgtcctcttccgtttgccccctctcccgagctctcccgtgcctcctagcgccgccgcgacgtgttccaagtccgccgccgccgccgcccgtcttcggcgtcgtcgccgcgccgtctccgccgtcgccgtcgcttgccgtcatcgccaagaggtgcgccgtggtgagaggaagctcgtgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacaggcgcttgacagcaggcacgaactagacaccaaagccttcatcttcaaggaactcctcttctggggttgggaaaaattgagcaagactgagtacaaccaccgtactcaacaagacacacccgcaagtgcagaataaatgcaagggagtacaagggaattatactataaagggttagggttgcagtaaacagcatttaaagacatttagttgctccaaagctattttgtaaacacgattctagaactatacaatgttattaatcacggccgtgaacccacacggacctgccttaacccaaggcctacgatgattcagaccgaactggcaacccgaccctgggtcccagctcgtcccaagccaacccaggccaaccattccacattttagttgataagcaggttttaagacttagaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgaaccgcagcccgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggcagaggtgctactgtcaaaaccatgcacccctagcccagcccaaaaccattttagggattttgaatagaaggagcggtgtgaagccggttccacgataaccagaccattccaaagtatccaggtgacttgaatatttcccaaagtctaaagttgtaaaaccacctaatgttacctaattaacttgcgaagcatctacctaaaattaaactagtggtgccatgagtagagtgtccactagttggggttttgtttattctagggtgaacaaggtaatattaacaataacaataataaggtcataacaaaggaaaataggcatggctaaataaaacagtgataacgcgggaatttaaataaagtgataatgcaataatttaaatcaacataattttacaaactgggattcaatatgttcaaagatgatgtgacttgccttgctcgctttcccaaacatcggcttcaacttccacgaagagcggatcttccgaagctgtagcgtctacacgaccaacggaaaagaaaaggctattaccctaataaactccatataacagcagaaataaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaattggatttattgcgtcagccgggagagagggcgcgcggaccgggtccacgggagtggggcccacgcggcagcctcacggcccacggtggaccgggcgcacgcggctggcgtcggccggcgccgtgggtcccacgcgttagccgcacccacgggcgcgggcggctgacggccgggcccacctggcagccgcgggcgcgcccgaaggcggcctcgccggcacggccgatgggaggcggcgcacccgcgccccgatggtcgccgccggagaccaacggcgcggcggagcggcacccgagagagaggagggaagagggaaagcgaacggcggtccatggctcaccccgggacgacgagggcggcggaaatggcgaccggagcggaggacgacggcggcgcgggctcgggtcgacgaggacggcggcgttccggcggtcggcgagcgaagcggaggggcggacggggtcggcgaggacgcggcgaagccgaagggggtgacgccgaaacgggaggaggtccggagcgacgacggcgactgaccggagctcggcggcgatggcggagagagaggacgacggcgcgggctcgattccgacggggagagtgagcggcgagcggcggaaacggaggagcggagctcgggaagcgattaaatagcgccgggag

SEQ ID NO: 61397 - DNA, 657 bp, Oryza sativa
agtagatggataggatgaaggcccggactcgcagcgggatcaacggccggcgacgaaggcgccgaccggagagggcccgcgacagagttggggcgccggcggagggcgcaccggccggccacgcggatggagccggaggtgggcgttaacggcggcgccgtggatggcggacggcggtgctggagctccaggcggcaatccggcgaccacatcgctggcagccacgtcctccgccgtcgctccctacgccgggctcgtcgccgcagccacgtcctccgccgtccgtgcctcacgccacgctgaagctcgtcgccgaagtccgcgatgccgggggatcgttgggggtggccgcgtcggagctcgtcgccggcgaccgcgacctccgtcatccacacccatgccacaccggagctcgtcattgacttagttgcagcagcacgcatgagagagatgtggtagaaagaatagctagatagaagaagagtggattggttggtgtctatcctatcccgtcgggacggtataccggtgtttagcatttccgtattatttactctattgagtaaattacattgctgatacacaaatttggattcagacggcagtggcactccggaacgatctcctacgtgcgcggacagcttgaccatgacccat

SEQ ID NO: 61398 - DNA, 2903 bp, Oryza sativa
tatataaccaattttgcctatagtgcgttacatatactgcaaggtggatgggctttaacgtgggccataacattaagcgtagagactggattttacattaacggttacaatggtacgatatatctaaacaatagctagatctttctggttaatatgagatcttgtagaaagttctcaattagtatatgtatagattagatttaaatatttgaaaatggaaaatacactactggaaaactgatctttactcgctcgccccaaaaccacaatagtcccggttataaaaagaaccgggactaaagatgatctttagtcccggtttaaaaccccatagccattctatgatatttagtcccggttgctaacaccaaccgggactaaagatgatctttagtcccgatgatctttagtcccggttcatcccctgtcagtcccttgtcagaggggtggggatctttagtcccggttggtgtcacaaaccgggactaaagatcaccactttagtcccggtctttactcccggttagtattaccaaccggaactaaaatcacgcctagtatataatccctattccctatcctctcccccacaaccggcctcaatctcctcaacaacaaccggcctctcctctccttagatccatctcctctcctcctccctctcctccccttccgcctcccatcccggccctctcctcccccttctcccttcccatccaatgcccagcaagggccacctcctccccctcctcccttcccgaacacgtcaggcggggccgcgcccggcggggccgcacgtggtaggcggccggcggggccgcacgcaggccgcgcacggggagcaggcggcgctaccggcatccattctttttttctttttttttacaatttgtgattcacttagatgtataattttgtgatttgttgtatggatctgagatgtataatatgtgatgtatttggtttgtgtgtatttttttaatgatttgtgatgtatttgatttgtgtgttgaagtaacttaagatttgtgatgtgaatgttttgggatattactttgatttagggtttgatttaggaatatgcatcccactcgatttgggagaaaatacagggattaaactctggctaaaaaataatgaaaagaaaagaaaaagagacctaatgggactgccgctaccctctctttagtaggactaaagataggtaccaaccgggactaaagatcgatctttagtcccggttatttcactcgagactaatggtagcgatctttagtcccggattcgtagtcccggttggataaccgggactaaagggcggttacgaatcgggagtacaaagggtttctccaccagtgatatagatctgccatggaaagtactttatgtatggtgatacatgaaaatatagagttgtgtaaacatatactttgtaaaagtaatgcatgagacatgcgctataatgcaagtgggctgacctgcgaacctacatttatgttaaataaggggtaatctatggatttccgtgtaatggctcggcttgccccgtcgtaaagatgcaagtgggtcaacctataaacccatttgtaggtcaaattagtaggtaacccacagtttacccactaattttgtctataagcgggttcgcgggttggcctactttcatccctacatttttagggttatatatatggttttggaagactttgtgaaaatatacgcgtacaacagttcaaaaatgcgcgacaggttgtttcccgtggcatggagccgcgggaccaacggccggaacaatcccgcgatgctgacgcgcggtactgcgtcggtcctgcgggcccgctggctggccacgcgcgaccgagcagtgcgcgatgcccggtctgcatgaccgtgtggtgccgcacggctggctggcgggaccgctacggtaccgctctcccgattcatgggattgttccggccgtcggtcccacatctccgtgcggcgctaaaaaatcaatcgcgcattaccaaaccgcggtacgcgtgtattttcacaaatctttgaaaacattatatataattataaaagcgtgaaaagtaatatatattttcaaattttgttcctaaactcacagccgtgcgtctcaaatccaatcaagacagaccactcaacgctgtgcatacatacgaggaagctgcgtgttgtggcagtaataacaactcaattagccaacacaagttgtagttttaattcatcgtcgtaattgatacattggtctagcacgaatgcagaatgccccatgcattcaacataaatactgcactaattaattttacgacatgggctgcatgttagatgcaaagatgcttaaattattatcagtgttgatgcaaaacaattttcttgtgatgatatgatgaagcaggtcgctctctccgtcgctgtaattaagaaaacaagttgaatgatataagttgtattttctttttcccttgtactatatgatcaatcaacatgatctaatgtaaataagtggttcttttaatttggccactaaaataaacaatcgtttaatttgttcaataaaaagttatcactacgccagatcggcccatctgtgacggcctattagtgacggaccaaagtgcctcgtcagagataacctcatctgtgacgggttacaataaatcacgtcatagatagggctcaagaaaataacccgtcacaggtaagtactcatctgtgacggatctatataaggaacccgacacacaacatctttaacgtgtctacatatagacccgtcactgatgacctcttacctgtgacgggttttaagtttgtaacccgtcacaggtgagatacctcacctcaaacgtgttggatttttatacccgtcactggtgagttaaaaaaaaag

SEQ ID NO: 61399 - DNA, 7387 bp, Oryza sativa
taccccccagccacacccaccccacatccctcaccccgcaccttttagaaataacgtataataaattaattactaaatgattgtttgtggcgcaatatacgataagtaacatatttactatacgtaaaaattgaatgatgtatcaatcccgcaccttttgctagcccagccaccaacaataatatgtgtgactttagtaattcatttactatcagtatgttttcgataagtaatcgagttactattctcgagtaaatgagttactatcagagacaaagcccattagtaaatgagttactaacagataagagtaacatttgtttggcacttcccttattggcccatgagtaaatgcgttactaacagagacttggcccacaatgagttactaacatataagaatatcgtttgctagccacatctcgtattggcaatgagtacatgcgttactaatagagactcagcccatgagtaaatgatttactaatagataagaagcaacatattcatggaataaaaaaattactgatatgtattgggattatccaatcatggagggagtaaaaaagttacttagtagttgattgggcctgatatataaggtagtaaatattttactgcacgaatacgggtataatggactttgtttttacaattgatcgtgccatcatcgttacaaacacatatacactcggtaccaaaaaaaaaaagcacaatccagagggcatcgcatcgcctgccaccgaagcctgtcatcaattgtggtgtggtcgtcctgggttgaccctttgtgttggccgccggcgacgaacgttgacgaaggacatgtcgaggatggcattccagtggcaccaccaccactggcataatcttctcatgttcttttctagtttcctgaacacaaatgaattcacaattaaaaagaaaattcagatatagatgagcaaccaaaaaaattagaacatgtacatcttcaacagagcaaataccaaccaccataccatcaagatgtgcatccacctgcaagagtgcacactgtagatgctgatgcctgcaagaattagaagttaataatttcagtaaaatttagaccttagtcttagtctgaagatgtctgttctgtcaaaaatatacagagaaaaaagggtatgttcaacagcgaacatatctagtcagaagttcagaaaaaaaaattcaatcgatgtgctcctttgaacaacaaaaatttagaaaactgctatccgatcgagctttttgagctttcatctatccgaaaattcagaatcaggacatgcagtactaatttcagaaaaatacgacgaatactgtacacatgctgtaaaaatatcacatatctcagagtttacacatctcacaggacatgcagtactaatttcagaaaactacgacgaatactgtacacatgctgtaaaaatatgacatatctcagagtttacatatctcactgcttatttgtgaactagattagtgaaccaaatttgtcacttgaattgctagtaaagtacctgaactgctcgtaaagtaattaaacaatggctccaatatctctaattagtacctgaagaatcaaagcacaaacagcatcgcataacattgttattcagccaaattaaccgaaaaaaatctccaagatttcagcaattggaaagacaacaagtcattacagcttattgaatagatcccacaacagtctgagcactcaaaaaaactatgtccaattaaaatagtatggagaacaaaccgaatggagaccacggcaagacgacatcgcagcaccctagaccacgacaagagggatgtcggggacgcgcggggccgctggatacggcggatctggcggcaaggctcccaaaggctacacccttcttcacccctggcgtcctcaagtattcctcgtcgatgcaggctaacctatggagtgcagggagcaggagctcgtgtcgccctgtagcatgtacatctggaacagaagaacaaggggcatctaccagcaaggagcttctcacatgatacccatgccattgaagcttccagatctggagcagaaccaccatgcaaaatcccatcgcatgaagtaaagaaaaaaaaaagaaaaaccaaattctgattcgttcctatacgcagggagggcagaggaaccctataaatcccccaatccccaaaccctagagaagtccccacctcaccaaggagaacgatacagcaatagggatccagcggaggagttggcgtcgggaggtagcgcgggtgcggttggtggaggcctcgtcggcagccttggcggaggcggcgcgcttcttgcttttctcgcttgagggagggagccgacgacaaccacggaaacgagagcgaaaccgtccccgcctcctcgccagacatggacatgcccgttcttgccgcctaacccattagatccagcacggcgcctcctccctgtagcacgccatcgccgtcgccgccgcctccgcttcctgatgccacagctgccgagccggcttcctgcctctatagatccaaaaaaaaaaggggggaaattgattagtggttagttacggtgtgggaccaacacatgtatgtatacgacgatttaaacactactaccagtaaaacaattactcagtagaaattgatagtaccgttagtaacaccattacgggaattgagggggacagggatgtgctagtgtggtgtggtgtggtgtaggggtaggggtgtgggttgcccccagggggtgggttgcggtttaatacaacgcaacccatctgtagtatagggccggtttggttcatagcctaaaatggccttaccaatgtttgggccacattaacagtacaaagtataattttggtttggatccaaatattggctggcctatgcaaaacaataggtcacgcacccatttgtaaagttattgcactcagacgtaaaaataataattgaaagtcaattaaagtgatgtaaaaattattatatttcggttgatatttgagaaggtgaagaaaacaaaaaaaaatcttaaaggtaattggatgtaaattgtactagaacgcacccatttgtcaagttattgcactcaaacgttcaattcccaagttcttgcactataccgcacccacctgccaagttgttgtaccgtgggtgcaatttactcgcacaactaatttattgttttcaccggcgccagctaatgaccgtgccatcccacgaggaaacaatctcaaactataatggaaagaaaactactaggaggctcaactgaaccccagtacggtggctatttcagaaggcctgcagaataaaactcacctctaatgaataataaaacacaaaggggagaacatgctaacaatttcaaacaattgatttccccacgtaaaacttgtataagatctggcatcggcgaaaatttatggtctatgaggtggttagggtaggggtgggggggaccatttctatatggagatcctacagattttccttttgaccgatagagttggcatcgcctacggagtgtgtgtgcaacaaggaagattagacctaaaggagtcaaatatagccagcataaccactcctgatgcatgttcgtgtgaggaagatcggcgtgccaacgaatggctgaaatgacaactcctgatgcctcctatgccaacaaccagggaacatcatatggctggaccctggagtttcagggtgtgctatctatcaagtgttctttcatctctctctcagcctgtaaaagttgtcgctcttcctccgatctttgatttatacagcaattacatttttatgcaattgttcctactctgtcaggatagttcaatgtagcacctgccactccgtatatatgggccagccaatcaactcctacatacgtttagacaaggaaatattgatgactactccctccgtttcaaaatatttgacaccgttgactttttagcacatgtttgaccgttcgtcttattaaaaaaattgtaaaatatataaaatatatatgtgtacatgaaagtatatttaacaatgaatcaaatgatatgaaaagaaaaaataattacttaaattttttgaataagacgaacggtcaaacacgtactaaaaagtcaacggtgtcaaacattttgaaacggagggagtatcttttagtaccttactaattcagaaccatccactccaaacccactcgagctatacctgacacgaacaattcatcaatagggggatgatgggactgcattatatgtgcatatatgattccctgaaatgttctaatacgtcagtatagcacttgaatgtatttatgtccaagcctttggaccaatgcaaccaggtaatcaatcagaacggggcgttgacagttccatccaatcaaggtagcggttccgaactagggtacgtaattttatcattcttgagaaggaactgagagataccacatatttcagtttaaaatttggtacttctagctacgtgctaagtatctcaaagatcgtaaaatttcttgaacaaagatttctaacccacccaatatttattcgtattattggtcgagaatgcagcttaccactgtagggataactcacatgccaatggtaatagatcgctgcatgtagggatgaaaatggatcataaatggacggaaactagctttatcatatttgttttcatatattttttcggaatcggaatcggaatcgaaaactcggatacggaaatgaaatcgaatattatcgaatacagatacggagcgaatacgagacggaacgaatacggtagcgaatatttaccggtatataaaaagcccctcaaattgagtttcttgatcaaggaagagagatcacttattattttagttcaacatctccaacatttatatcgtcaattttgtagatggtctcacaaccgcatatgaaaatcgattttcatggttgttcctctaagagatccatatgcaaatatgattatcattttctattctcaagactttttagtagatgtataacttacttgacattgtataaattggagatgttatttattttacttcacatcttcgaaactagtaatatttgttttatgctttaaatgctttcaaatacaaatgttataaactacaaagtggtaaatcccgttgagctctacaattttgatatggaacacatctccatcagatgtcatttgaattgtagatctgagattttgtaaaaattagtatggtatattataatgaatatttagacccttaaataacctcaaataataaaatagtcaataagaaagttgtagatctcatcgacctctacaattttgatataaagtttgtcttcatctgattccgtatgaaaaagttatgtatatatacgtgttttttctaaaatttgctcaatgtctgcggatatccgaaaaacattccggatagttttcgaccgttttccgattccgacggatagtacccttactgtattcgttttcgtttccgagaaaaaaaatccgaattcgtttccgaatccgaggatttccggatagttccgaccgaaactatccgaatccgaaaaatggtctggacgaacggaaactatccgaaccagtttcatccctagctgcatgtgtacattaaaactgattgtgacaggcacaatgtatcggtgaattgatgggattattccactttgtcatgagggcatccacaatatgaaaaaaaacctgcaaataagtaggattactacttggttcaccattgtagaagtagatattaagatgggtaatagcttaatccaacaataacactactacatgacaataactaaacaaatattgaaatctctatcttcccttcatcctccctcgccccactagccattcatgcattcatctagaacaacaatagatgttacggctcgtgcgcacccatgagctgcaactcttaagcgatagatgtagcccagcaagataaaattctcaaggacatggtaaactagaacacttgagtgtcatccttcaagatgtcgcaagaggatcagtaacacaagagcttccggtgcctcccagacctaccctagctagtgacccactggacacggtaatggacctgaccataactcatcatttctgtatgataatttgtagcactggcgctcagtcgtcttatcttttatggcacaaaaagggcagttttagacaatcgtaccaaatgttagcttcccatatcgccgtacaattgcaaatgacatttttgcatagaaaactctccgttaatacaagtatatgttaggccccctgataatcctactgagccacctcccacccgtccgctcaaaattaagtggtagtctcttcgttccaaaatataaaggattttggagggatatgacacattctagcactatgaatctggacataagtttgttaggatgtatcacatccctccaatttctcttatattttgggacagagggagtatagatcagtctctttgggaagcggcagtgggtgtttttttcacatggaacccttcgttttatccgcatttggagtgaagaaatactcttacactgtcattactcacatctcacaaacttgacgccacattgccaccaagtcacagattcaaccttgctagggaaggaagggggtgggggagggtgtatcgatctcgtagcataggcgcatagccaagagattgatgcagttcttgtgaagtcgccagtcgccaccacagtccattcaggttgcgcctaccagcattctccccataaattttgatccttgtaccctgccatggtgatttgaagaagatatgataccaaggttggttttgtcaaaggctccatcaccaggacaacatgtaccgccaccgctttcagcttctacgaaatggattgtatgatcaatcatccatgtggctaatcagaaaggaagaattctgggaggtttatgaattctgacagctagcgtaatatcgtcaggatctgtatctaccaatatttgccattgtctggaccattcctcaattcttagtttgtaatcagtataaataataaaaacatgatcaaacaattgctagcggtgtgcctgtgttaatttgacttcctcattgcatttttctgaattctagctagttcaaactgcaagcaagcaccagttttagtaatgtccagcacgtaagatttacattttctttagatactagatatttcattgagtagtgaagttacatccggtgctctcttcatctagtgaggatgcacccagcccgaaaagaaaagaaggaaaaaaaaaactaaaacagcatgaacatatcatactgttgcaactgcctgcttcacctgtaactgtgacgacaacatagtgtctatgccatttgtcgaga

SEQ ID NO: 61400 - DNA, 19831 bp, Oryza sativa
  unsure (1)..(19831): unsure at all n locations
gaggaaaaagaatggaaaaaacgggaaaaaaaggagggaatcacggggagtcattccccctttttatgccgcccagcacggcagaattcgcggatttgacgccggcgccggtgtaaggcacggggccgacgatagcccagctcgagaaagggaatacggttgggccccaccggtcagcgagggtgcaggcggggcccgcctgtcaccggcgcgcgcgcggggaagaagtcctatgggcctcggggaacagaacaaagaggcagaggggaaagtgggcgagccggcccaagaaggaaaggggggaaaagaagacttttagggtttttctttttataaaaccttttaaactttgttaatttcttcccaattataatttgtgctctgaaaattccactaaaattttattaacacattttaggcttttaggaaataaacaaaaatcttccaagccttatttgacttttaaatttgcacattttaattgttggaggctttcacatgggttttaattattctcggcacaattttaagaatatattttagagtcgttttggaacgcgacagctcggccgccccttcttttccgccgccgaccaccggagctcgttcgccgccgtcgacccgagccgccgcgccgcttcttctcgtcgccggccgccgtcgtgcgttgttggtcgtcgtggtgagtaccaacgggttcgcctcgttgtcctctacgcgtaggtgtcctccaatcgtccggccgaccgctctagcgccggcgagctcgcggacccgagccggccgccgttgctgacgtcatgccgacgttatctccagggctgacgtcatctcctctagggctgacgtcatcgtttccttttctttttcttttttccgattttctaatagattaaaacttcggaaaatcataactaaataaccgtagatccgttttaggtggttcaagtttctaaatttttctaaaatcaagatctacatgttaaaaatatcctcatgtactgtttatgcttgtttttgtactgttttgttgattttgtttatttgcttttgtttccgacgttccggaggagagcgtttccgttgaggaaggttccgaagcgtttgtggaagcccaaggcaagtcacacagatcccaaacaaccctttgagcatgttgatcccgtttaaagctattgttttatttcaactatgcattgttttcgaatgtcatcgggtggtgaacctttcccagttatttattggccgaagatgactttattttcctatgggctataatttgattagcatgaaccttatatattggattggttcagctaaatgctatatataggtttgcttagccatgcatagaaacattagctaactaaaaggggttaaatataaattatattacataattattattgttaataatggttatatttaatggtagctcacgatggtcaatcgtgtgatgttaactaattgataattaaaatctggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtaattcattatagtgcgccagactgagaagtggcgagaagtccatgggggtcgctggggagtccatgccttgttttaaagggggtgattatgatccaggaaaggtgcgctgtaatgggttatgttgtacaaggggtattgtcacaactcctttccgagataccgtggtggtattgaggcacatggtgacatgatgtggggttgtgtcttgtgggtacagtggtacacctctgatcagagtttaaactattcgaatagccgtacccgcggttatgggtgagttgagcaatgttcttcgtgattagtctcacactactcattaatggtaataatgtgtaattaatttaattcctggtttggaatggttaattcctggtttggagggttaatttgttcaactggggttggttgttcaaatatggttgggcctatgcaacacgggtgtgttgtatggtgtttatttaatattgactaattattcaactgttttactattctcttaaatatttattaaatgctgttttctgcaaatgagctatattatgccatcctttgttatcttgtgcacttgcatatttgctgtgtggcttgttgagtatatcatatgctcattcttgcaatattcattcatcagaagaggagtatctcagtgaaggtgatgatctggaggattaggcttgttctggttaagttgcttgtggagtggagtcgccatagctgttccgtagtttgttatagttttattttccgctgcgtagaatgttatttttctttgagaggaactatctacctctgtaataattttaatttgcaaatattcaatagttatttatttgtactctattattaatttgtcattgtgtgcctcggttgattcctggacgagggtttatcacacatgtaagcgtttggaattttggatagaaattccgggcgtgacaatagtcccggttggtgtcataaaccgggactctaaaattcaacgcgtattatataatccctctcccttattctctcctccacaaccggcctcttcgcagttatgctctcctccacaaccggcctcttatcctctcctccacaaccagcctctcatctcctcatatcgatcccttcctcctttcctcccctccccctctccttctttttggaaatgggactattgtggttttgggtcgacccaacaaagatcagctttctagtagtggttccttctctagtccaagagtccgcgctgctcatgcttgtactgcgggggatgttagagtatatggataagatcgtattgtatccggtttgccatggtaggataggattagtttctatctctatctcttaaagttatttaagacctaatctatgtaataacctatatataccggtcctttgaggctcaatacaataattcacgttacccagtatatctcttttcttatacaatccaacagaaaaacaggcaggtagtgatcttgaacctgcctgtaggagaatgagagtagcatagagagtcacaccaagtgtagtagtgggctccttatatgtgctataaattctcttatactttaggccagagatagtacgagttccagaacatcctggtggttgtatccaagaaaatatgtgtcccatacatactcgcacatcacctttgtcgctgtatatgatgccgtgatgggctttaagctagcagtctatgtgtaccgtggaggatgagtaaccaaacacagctgtccttaggctatcaagtcatgtaagtataggggactatgctattagacattggtactcttaaataggggtgaaaacggtacggaaatttccgagaattccggctaccgtttccggtttgcaccgaccgtttcaatcggtatcggtaattgtcggtatcggaaatggaaacggtaatctctttcggaaatggtagcggaaatgatatggggttttttccgaccgttttgtcggtaaccgttttttatcggtaatttccatcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctggggcaccgccgcgccatgttgggcgccgccaccaagtcgccgacgccggccgcaacctccttcgccccgacggcctccgtcgcagccggccaccttccctcccccatgctccaccgccggcttccgtgccaccgagccaagcgccgagcgccgncgcacccgcccagccttcttcttcccaccgatgccgcccctttctcctctctccttcccccaccgccgcctgcgccaggccgncatctccggcgcctctctcctctcgggcgcgcgtgaaggagccaaaggcagagaagagaacgagagagaaaacaaagaagaaatcgagagagcaggaaaaggaaccgagagaagggaaggataagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttctcatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcagacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgttgttttcgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctactcttaaattggttctgactggaaaccggtagttttaaccagctcccgactggcaccaataaaaggtttctgcagtagtgaatgtggcatgcgagaattgaaacagttcgataaaaacagcaataacacattatgcggtctaatttaaattgtgtatggtgtcatctaatttaaaacatctattgggtaattaaggaaattgctcagtgacatgaaaaatgactgaattggaatccctatggctggtgcactgaatggaatgttggccggaaacattattgttcttaggttaggtgtataaattcgagcaatgtgggaagctggaagctagagcgcttagatggagctaaaaacacaaggtacactgcaagaaagatccattgattgtagggtttttttttggggggggggtgctgggaatctagttaattgcaactgctagtgtgctacaactttagctagcttaggcaagagatttgcattgcaagtaggatgcaactagggatgaaaatggtacgaaaacggacgaaaatccaactatcaagtttgaattgagtatattgggttgggctgaattgagtgacttaggaattaggatactgaattaggttgggctggggaggaattatagactatggtatgggcctttataattccagaaattccgagaaatttttcggaaagtttccgaccgaatccgagttccgacggaaactgcccttatcatattcgatttcgtttctgagaaaatatttccgaattcgtttcaatttccgaaaaaatccaaaataattctgaccgacaaattccgttttcgaaaataagcccgctgtaccattttcatccctagatgcaacatagccgtgaacttatttgcacaagtatcaaaaaatccacttgttctcccgaatcagtagatcgctgctcacccagatcccgtgtgttgatgggtgatcaatgcacatccgaagtcttgcttctgacggtctcaaattgattggagcaatggagttaagcagtgaccctccatgacctcggaactgattgtgatgttttcttttgtttagtacacttgtgaagctaatagtcatttgccgaccatgcgcaccacgcttaaccagaaaacaaacaaattagccatacaaatttcactttacattcctctccagatcagtttctcttaatctgtaaattggtcatggtgagttctagctagttattgtcttattgagggtcttctctgaccttatgtggaagttacatgttgttccacagttgctagctagtgttaattagctgttcctctaccttaatatgcgtggtgcctcattaacacaaccaattgggtaatgagaaatagctagagaagtagagattggatagcaacagccaacagattggtctccagcagaatgaacacaaccgattcactactaaattataatatgtttcagtaataagagcttgccaagttcacaactacaagagaaacttttcaagctagctgttatatacttgtattaaactgcacccacttggcaacttcttgtatccaaggtgcaatttactcaaatgagaactacacatataatgacattaaatggaatcccatgagttaggttcactaaatgaaaggtttggatagagagacattattgcttttagatgtataaattcgagaaatacaggaagctagaatgcacacaaatggagctgactacaaaaaaggtgcttacatagcaacatgaacatttggtttcttcaacagttgcaagaaagacctactaattgtagtattctccttcttaattgtaggcagaactcctgccatctgggtttataaagagaaccatggacagaaaatggtatagcgtgtgcagacgtgcagtgatataaaggcactacatttctagtgtcatctgtgtgaaatgtcatggtgtaataaacgactagttcgattgaagacgtatataactatatatatggcataatgaacaaaatcgagtcccatgagagcatagtgtactatatgatagggtgggctgaaaacaccattgttctgctaattttaggcttgaaggtgactgggaatctagttaattgcaactgctgcaacataagctacatcagtcaacagattagcattgcaagtaggatgcaactacattgtgaccctttctttgcagaaatagatgataaggcacgtcgatatcaggctttgccgtttgggtagatcgctgctcaccaagattccatttggctgctcattaattatctgaaattttggttggcgtaggctcagagagatctaagtgggagctggttgtgatgttcagtattgtctacacttacgaaggtattgctcaccatgtccacaaggcttcagctacgggactagagaaagaaacaaactagccctacaagtgaactttacactcctctctagtcaagtttcactgtcgtgtgattcgaacatatgctgataggtatacttctctaatacttcgagaaataacatattgcaaacaaactaactaaatgaggttgttaattaacaaatgtttacaacatgttctagtcgacaagccttttcatgttcatagcccaaaagttacttgaagagctgaaggtacgtagcacaaggtccatcctaacgtacttgcagttcctttatgctaagaaggtatcttgcgaaggactgaaaaatactcaaatgataacactttcttcgttttgcctattcgcggaataagcgaaacatcatatttgcaaacgaaaagtaatttgtgaaaaaaacttttatatactttgttaaatcaaagtgtgtttgattgttattctatgatgaataattggcatatgagattattggttttggtatttagagattattggcgaagtgggtttagagatgattggatttgcagatgataaacagggactactggataattggaccgtttagaccggtcaaggtttgccggtcacaccagaggtatacgtgtggtcagaccaaccagcccgcggtctgaccattcgactatgtgtcggttttagtttcgggttatttcattggatatttgtggataatttgtgtttatgacttctagatggatactatgtgtacgtaatactgttgtttgctaacaatgagtcaagttggagatagcttgtgctcgagatatggtttcttgtttgattcatgtgtaggtgatcttgacgcctcgagatagtatagcggattgggagtcaacttggagataaggagacgtccggacggtcagatattatgtgggatacttaggctaaagatcaatgcacatggttagtccagattccatatggcatacgatggaggtattgtgtgcgtatgggatgcggagtcgaatttggaggaagtccaaatttggaacgattggagtttgtaaagttagtttcttgtacgggaatgtttcctagaggattagaacttcttgtacaagtttggctcatggctttacgctaactacctcgggtatatatagaaagggagagtgtggcctcctggtatcgctttagagagcattgagttgagagaatagttagggtttcgagtttaatcgagattttcgtgaggagtgctgttgttgcactttgtaaacacagagagaagtaataaagttgtcatctactttgagagttcttcgatttgtgtttgctcgtgttcggcagtctaaccgtcgagacaccaccggtcagatcgatggcatcggaccagttagaccggtggagtaacggcggttagaccggtggcggctacaggtgacgacaagtgatttcggcagtcagaccggagcgactactgcggttagaccaacggtttccaggcggttagaccggtgcatctactccggtcagaccgcgtatcatcgaattgagagtaacttttaattccgctaaaagttttagtttttgggtactccaaccattcacccctctcttgttggcttagttcttgttgttcgatcctacattttcttctttggattttaatcgatctagagttttgccatggctaacaagtttacaagtagccacgtgttttcgatggcttggatttttcttattggtgtgacaagatgcaatcttacatgatggttgaagattatgatgtttggcaaaaggttgctcagacttatgtgattcctaatcaaattaataatgttgctttgaaaactgaatttaacaaaaattgcaaagctcgcaatattttattgagtgggatttctcgttcggattttgatcctgtttcacatcttcaaaccgccaatgagatttggaatgctttgaaaaactttcatcaaggaactacaaacattaaataacttcatcgagatcttttaaaaaaggagtacatttaaaaagatccattgattctgcttatgacactaattattcacaatctaagattcctcgccactttttgaatggtcttgatatgtctgtttgggagatgaaggttacatctattcaagagtctgttgatatgtccactttgactttggattcactttatacaaaactcaaaacacatgagatgaatattctttctcacaaagttgattctaagtctagtgcatgctttggtttctccctcgacttgtttggatattggtgcttcatcgtcaaattctaccgctcttgctttaattaatgacatgtccgatgagcaactcgaacaattcgaggaggaggactgggctttggctgctaacaagatttctcaagctatgaacaatgtcaggtacaggaaaagaggaggtcaaactcgttgctttaaatgtggagcacttgatcacattcgttgaatattttggattttcagtgcaatattttgaattttttataatggatttttgtacaatatcatgaaatttcctatagcgtatatttaagctttgtgtgtacttactaaattttaatatttagttaggagttatcccaccaattcctttgatacaaacaaacatcccatggtgcaatcaattgttttttgccacaccgcgctaagtgcaagggaatcttgattttctttttaagtcattgacatgtagggatttaatttattggaatataatattgccacaacggttgctgtaaccaaatatctgtcaagttgatcaaactagcctaattttagatcaatgtagcaaactatggttaagtgtggctggcaatcaaacatccctggagtatttatggtacaaattagatgagtgaaaaataaagttatcatgggatggagagaatttgtctagaagaagtaaaaaaaaaatagacacaacttggccgcttgagtgttgagatcatggttcttgtctttctgtgtgccatattgccttgttggcagtgattgcttcttgaaatcatttcatttgtaaagtatgacacgctaagattttatgcgtttacaggaaagagataaattaacagaagtcaatggaaatatttggttgaatcaagaaaataaatagactcaaccacggttagtgacctggccatgctattgagtacggacttgaacaatgacataagtagtcgtgcaaggtattgacataaacaatgatataaggaatccagcgggcatgtgatgaccgcagactttcagttactgtttataggtcatgtagtccctccgaaaaaaaaaaaagaaagaaaacacaacctaagtaccaagatactccctctgttttatttatatctatctagattcattaacatcaatatgaatataggaaatgctagaatgacttacattgtgaaacgaaggaagtatcatacattctagtacaacgaatatggaatagtatatatactccctccgtaaaaaaaaagaaaacacaatctaagtactgagatgtgatacattctagtacaacgaatacggacatagtgtatatgtctagatttaggttgtttttttttaacggagggaatactcatcatattatatgattttttagctaaggacgcagtattaaattcattgacattgagagtgtgctccggatgcccctatatataaatatataaatagacagagggagggacagggagagagaatgggtatctcaaatgctctgcaatggtgggaggagtggcagctccgggttcttctcttgggcagcctcgctttccagtacttccttttcattacagcctcccggcataagtttcctatccgatcctacctcagatcctttatctggtttgtatacctcggtagcgatgccctagcaatatatgcccttgcaaccctatttaaccgtcacaagaaacaggatgttggtcacacacacaacaacgatgtcttagagattctttgggctcctatcctactgattcaccttggtggacaggatagcataactgcctacaatattgaagacaatgagctgtggatgcgacatgttctcacggcactgtcccagatcaccgtagccatctatgtcttttgcaaatcatggccaggaggggacaggagattgttgcagtcggcaatcttgctcttcgtgcctgggattctcaaatgcttggagaagccctgggctctcaatagagctagcatcaatagcctggtgagttttgacgagaaagtccgtaggacgattaacaggcaaggcaagcagattgattcgatcgaagattttgtgcgaagtgcaaggggatttttttgtggaaatgatcatctggagaaaccaagtagatcagcggactttacacctgatgagttatttgtagaccttgcatctccttgtactgataatcgcgtaagaaaactaatgtcattctcagcactttgtggagacgaagcatattatttgttacagaacaacctgtccgacacctttgatctactctatacaaaagaaaagatgtcccttaaaactccccctaccgaagaacttgagactggccttcatcattttgttgaattatacaaacagttgaattataccctatttagctctctcagtgaattttttggtactgtaatacgtgaattagcaatgtttctaccatttacggccatcggcctatttcaccagagtaacagaaaatcttataatgataaagatgtcaaggttacttatgcattgctctgctgtactgctgtcatagagttttacaacccttttgtaaaggtattcacaagtgtgacactaaaccaacgatcaagctcagtttccaagctcagtcaaaggccaaggcaacgctacctttaccaacatcaagatgacatggtttcccaatacaacctattaggatactttgttcgcaacaaaaaacattctacgataatgaactttgtgggattctttgggtgcagaaactatcttgaccgacgttggcgaatgaagtcctgcttttcatcgcgcagcattacaaacgtagttcttgggcatgtgaagcgttggtggaaggatcacataactgatgttttcacctacaggatgttcaatgatattaggggtcaatggagtctcaaagttgagggttgctttcagggattaggctggagcttaaagggagctttcgatgagagtgtccttctctggcatctcgccacggatttgtgcttctaccatatcagtccatctcatggccgtgaacatgccacaacaatgtgcatagagcgatctctggcctcaataatcggtgccctacttggtgcgaaaaatctattcaccataaaaatgctgttcagtgccgagaaatgtcgaattacatgacgtacctactgtttgtcaatcctgagatgttgatgccaggcacaaggcgaaacctattcacagacgcctacaacgaactgaagggtgtcgtcaaggaaaagaatccaccactggatgaaagagaacttgcagagagaataatcgccgaggtgcagcaacaactcgaggagataactggggaagataagtcaccatccagtaaaagagggctcattgaagatgcttggtccattgctgaagagctcctgaagttagaagatgacgagaagatgtggagagtgattgaaggcgtatgggtggagatgctttgcttttctgctgccagatgccgagggtacttgcatgctaagggcctcggtacaggcgtggagttcctgagctatgtttggctactcttgcattacatggggatggagaccttggcagagaagctggcaagaggagacctccaaaacagaggacactcaggtaatttgcggacattccatgttagagagtcctctggtgaagagcaggttgctggaccatcgacttcttatgctaacggagacaacggtgatcaacatgttgttgctccattctctgaggatggctttaccttggctggggatgaaaatgtgtgacgtgatacttacaagatcacttagttcctgtttgttgctctttttttttttgttttgctcctgcatgtgtgtttcagcttttcttgcgatttaatattaccagtgtcatgcaactgatttttcatgtgaatgcttactaattacactaccacaatgttaagtcttaatgccagtatgtttttcttcttaaagttgtatgagcgttttttaagggagagaagcttgtgcgcgcgcgcgcatatcttctaatagtactagcctactaggtgaatctccgcgctttgctgcggaaattactaagtaaattttaatattttttaatatttgagctaaaactaaaaatgatattagttattaacaaataaaactggtttgtcaaactatatgttaggagagaaataaatttagtagtatgtatgtgattgtagataaaatatgatatcccacgctttgattatatggatgaatatatgttaattattataaaaatgatggatgtatatatgttaaaaatattgtgaaaaaaaatatgaagcaagatgattggatgttgatttatagaattcaatgaattatagatgatgtttcatgcttacataagttttgtatgtaattattactaatggatgatgaggtggtatgtttgcatgtagagctatagtattagtgggttataactttatagtaataaatgatatgatttatgatgaatcattgatcttaaaatgctctattctaaggtgagtcatagcgtacatctgaaaaagagtgtggccatggtatgcaaatcaacgtgtgtttgattattattctatgataaacaattggcatatgagattattggtttagatatttggagattattggcgatgtggttttagagatgattggattttacaagtgatgaacagggactgctggttatttggaccggtcagaccgggcaggtgctgccggtcaatccggagctatgtgagcggtcagactggctagcccacggtctgaccggccgactctgtgtcggtttaggtttcgggttgatttgttcgatatccgtggataattcgtgtttatgacttcgagatgaatactatgcgtatgtaatactgttgtttgctaacaatgagacaagttagtgagaacttatgctcggatatggtttcttggttgatgcttgtgtaggtggtcttgatgtctcgggagagcgttgccggtgatggatcgggagtcaacttgggagaagatgacatccgaacaatctggatatcatgcgggatgcttaggctaaagatcaatgcaagtggttggtgaagattccatatggtataagatggagatattgtgtgcatatgggatgaggagtcgaatttggagagagtccaagtttagtacaattggagtttgtaaaatttgtttcttgtatgggaaggtttcctaggggattaggacttcttgtacaagtttacttcgtagctttaggctgtctactagggtataaatagagagggagggtgtggcctcctggtatcgctttagagagagttgagccaagagaaaagttagcgtttcgagtttagtcaaaattttcgtgacgagtgatgttgttgccctttgtaaacacatagagaagtaataaagtttcaatctactttgagagatcttctatttgtgttttctcgggttcagcactccaagcggtgggacactagtggttagaccgacggcattgcaacggttagaccggcggggacacggcggttagaccggtggcggtgacaggtttcggcggttagaccggagaaactacctcggtcagaccggagatttctagacgatcagatgggtgcatatactctggttagaccgcatgtcatcaaaattgagggtaacttttaattccgttaaaaattttggttttttagtactacagccgatcaccctcctggttgggctagttcttgttgttcgatcttacaagtgggtattagagccttgttttcttctttggattttaaccgatctaaagttttagccatggttaacaagtttacaactaagccacatgttttcgatggattgaaactttcttattggtgtgacaagatgtaatcttacatgatggctgaagattatgatgtttggcaaaaggttgctcagccttatgtgattcctgatcaaattaatactgctgctttgaaaactgaatttaacaacaattgcaaagctcgcaatattttattgagtgggatttctcgtttgagacataccaagtaatgtcatcgatcatcatgagttcattaactgagaggaacttttcaagttgctgtattaaaccgcacccacattccaagttcttttatcagtgtttcaatttactcataagagaattacattatgtgacatgtaatgacagaaatggaattccatgagttaggaacactaaaagaaaggtccaactggagacattcttactattatggagctgaagatatatggagcaaagtgggaggctagagcacatatatatggagcagaagacacagggtacatttttacatgtcaacgtttggcttcgccaataactgcaagaaagacccgccaattgtaggcctgagaggaacggggaatctagtttattctgcgcgcttccaccatatcgaacattatctaccttaacctcaacttttttttttattacaaagtagtatcggatgcaactaaagagtgacgatgaacttatatttgccgaagtatccaaaattgcaatggtaagcgaaacggccccatcatttcgcttattctaatgaaaagtaattaatttatggataaaatttttatatacgtgttcttagcgatttaaaagaaaaaaactgaaaaataaacttcgataaaaaaaccttaaaatcaacttcaaatttaatgttgaaaaatcaaattttagttgaaaagtataagcataagcgaaaatatgagattcttagtcgagcatgagcagatcgctgctcaccaagattacatttggtgggtgagtgcaggtacgtccacacactcttatgttgcaaactcaaaacaagatgaagcaaggtcctcttatataggatcaaacataagtaaccaagtctactagaaaagggtgagtggtagattacgccagcgaaagtcaaataatcgaatcttgatagatcaaaacacaccccaacattaaaaaccaatggaatatacattcggtggtctatccgacctactatggtaggtctaaccaaagcctggccggtttgaccgcaggtcctctcgcgatctgaccgtcagcctaaaaacagcacgatagaggttcggtaaaaacacgctttctcttaaaccaaccgttggattgagttgcaaactttacagaataaactagacaaaccaaggaacaactccaccacagggatttgcaaattacaaaacggtttaagagaaaacaccatcgattagggctggacgaaaagctcgtgtctcattgactcactcagctcttatctagcttggctcatttggatttattaacaacccaagccagggttttagctcgtttgttataacgagccagatcaagctggcccgtgagctgttcgcgagccaaacgagccaagcacaacagctcaagtacctagttggccagcagcaatatgaagcgaccaagctggcccatcaagaaaaagcccatgaaggaaagaaaaatactaaccctagatggagagacacgtacatgacctgtctctcgcactttgaattcccgatcccctttctactctagcatcgctcgctctccacttctcacgcaccgacgaggtcgcgccgtcgattgctcgtaggcggtagtggcaccctcgccttggtaggccctcgcctcagtcggccccgaccgccggccctcgcggcatcacctttgtcggccccgctgccggcccttgcctctgtggcttcgtcggcaccagtgcatctacaccatcgatgaagaaggagctaggaaggtgaacgagtcaatgagaccagccaaaccaacatttgtacatctcttccaagatgattatctcttgcatgttttattgatggcaaaatttgctaggacatccaaagactgtgctctttgctagaggacactgaaagaatacgtttttgttagatgacactggtaattagctgctggacacctacggtattattttattatatctagagaaatatttattaaagacaagtttacccataggcccacttgtcaatcacacatatctagctttctctgttcatgttcttcttcctgctgctaccttctctctcatgcgtgtgcacagcagcggcaatggagagcatgtgcagttgctggctggggcagagcatgcggcagctggttggaggaggtaggcctggagcttggccacccgtcagcggcgccacgagagagccgcacagctagggtgtcggtgcgggagactgggttgcaaaggggaaatatagcgcagcttcaatttgaccaagcagtaagtacgacggggtgtctaggaactttgggaagtcgatttccaacgattgcaggacaaagcaatgtcggggttgtgtgcccatgatgagcttgacggcagcccaattgagtttggactggcaaggcatcttcgtctaatttttaaaattgattgggtgcagtgcctctatgggtagggaaaaaatttaggatgtaatggattgccggaaattggcgtgatggcgaatgatggcaacgacatcgtgctcgccatcaacgagctcctcggcagcttcaggtgcgtcgtcgctgtcggcggtgaacccggcgatgcgccgccgccccgccgtggccgagccgtcccggctcggcccggccgcgttggccacgcgcgtcacacctctcgggtcgggccggccgcgttggccgcgtgcgttgcacctctgctcggcagtagcaagcgcgaggaagaagggaaaagaaaagaagagagatctggagtattttggtacttacacaactctttctttctccatttaactgaaaataataaaataatgtgagaagtgtccaacagctagttatcacttttttacggtgtccacgaaaagattcacgatctttggatgtctcacagcaaagaccgtaatcttttgatgtcttatagcaatttttgtctttattgattcctcatttgcatttttagatctggaatgcccctgatttatgttgcagtactggtttaatcccgccactcaattacatttgctttgtagtgatcgatcagtgcaagctcgtgatgtatcatcatattcattttcttttccaatctgtttgtttgtgagcgtttgccctcttcctcctccccatcccatggcatatgccgctactcttttccttcttctgtctcacgagctaaacgagctagctcgagctgacacacgagccgagccgagccaacactttagctcgttaggataacgagccgagccgacccagctcgatatccacccctatccttgatacacatccatctcagatggtcaggtggagtgtcagtattattttcacacgccatgtcgattggtgtgacgaaaagtttcaaattttagaaataagttttgaaagggttcatttttttaaattaaaaataaggttaaaaataaaagaaaatccttttctagcactaaaacaatgtcaaccacatcaggtggtcaatgactaatctgaagcacatagttattgtgaagcacatcagtgtggagaagccctcccgtcgccgacagcaaggtgttggacgccaccgcctccaacgtcctcctcggtgcacccttcgcccaccgcagagcgccctcccgtgatgccgccagccgcctgagctcaccccgcctcgaccgctggccacccgagttctctctgcctctgcctccaccgcccgccgcctaagctttgcctccgctgtcggccactcgagtgagcgagagggagagagagagaacagggattagggagaggagagggatgacagctgggtccacgagttcttttaattttatttgctgactggattgccacgttagcgccacgtgtgcaagtttaagtcgaaaacaactcaaaacagtacttaggagggttatttgtccggtttgtatagttggggtgagatgtctggttttatgttttaagggggtaatttaatcgaccgtgatagttcgggagggggtaattaatttgtactttttcctattataatactccctccgtctcataaaaattacatttctagctaatttaggacaaaacagtaggattgaaaaatgaccacaatgaccttatttaatgaacccattgcatgcacatatttcatatatacaaatgattaaaagtaagtttagagaattaacccatataattagcatacctaaattacaagctgagagaacttaaggaaacttatctagatgaatcaatttgttgggacaaagccttagagctagaaatgcaattttttttcggacggaggtagtacaatgnaggagtgagggtnngagctagagtgtcntacctggggcgcg

SEQ ID NO: 61401 - DNA, 822 bp, Oryza sativa
  unsure (1)..(822): unsure at all n locations
tgcggaanaaagaaagagttgattaagaatcgatttcttctcgaaacataatgacctattatagattttttgtgttnnctgncanatacnccccccccccccagaggntttgatgtanatcgcctgctgccagcaggcgactctagaggatccccaaatatgatatatatatatatatatatatatatatatccatttttcaagtttgtaataatttaaactcaattaattacacgttattaccaccttttttgcgtgaaacacttacaaacaccacctaaaggtgtgttggagaatactacctccgtttcaggttataagactttctagcattgcccatatttatatagatgttatatatcgcggaggccgggggcgaggaaacggtggcggcgcgcgcttttccaacaaaccgcgccccacctgtcagctatgtggcaagattggacatgtggtggcagactgctggtacaggtatgatgaaaatttcattccagattcaaaaacagcagctgcggcttcctatggggtagatacaaattggtacatggacaccagagccactgaccacatcacaggagaactgggcaagctgacaacccatgagaagtacaacggcaaaaaacaaattcacacggcaagcggtgcaagtatggacattaagcatattggtcatttctattatttatacccccatacgcaaaaatcaggtgaaaaaaatcccttatggggcctaaaactaaaaaaaaaccttatctctggtcaatcgattaaccggtggtaatcaagcccttggtggaagacattcctttttcttttgca

SEQ ID NO: 61402 - DNA, 1270 bp, Oryza sativa
ctctgattgatacagtctgaatatgatgctaagagttatatactgatattcttacaaggttgctactcaactagctgcctttttataaagcactgtatctgtggaattgaaaagcccatttccttctcatgatagaatagattgattatagttgccacgtggaatacaagattagaatagcacaagtgcaaacaatgttgaactcatagtgctggtaaggttcaattagtgctggtaaggttcaattcagaaggttggggttgtactctagtgcagccattaaaagttgaacagaaaacaaatgtacctttccggtgatctttgtatagatggaaagaacatccatcacagtagactcaaagtgtgttgtggcatcataactctgaaaagcaaatcgaattaaatgtttatttcaaatgcagttttttggtcatatgtctaacctacatacacttgatatttctgcgatgacttactgttgagatgaaacaattgtctgaagatgggtcattagtaggttcaaatctgtcgtatgtatcaataaatagttcatccactggcccaagaaggtctatccctggtttcaattccgccgctggattttcactctctgcttgtgctgacacgaacgcgatgaacttcccttttgatgcaacattgtgagagtaggaacaacagaaaacatacctggcatgcaccagtgaacattcttttgttacaataatagaaatgacaagtagaccaagagtaatctataggtgtaatgcccagtaatggataaaaaccagaggtgatatacagaatacttgcatgtctgatttgcgtccaagttgcttttgtggtattatgatctgtacagagtgagaatctgcagtatttgggattggatggctcatgatagcgattgcccgaaaaacttttccaacttttctaacctgatataacagcagataattctaatcagtaccaacattttgtaaacttctacgtcctctaatcctaagcataagttgttttggacttgtgaataggaactaaggccccgttcaatgtggggttttgtagacagattttggttgcacgcaaaacgagaaacatcatccacacatgatttattaagtattaattattataaattttaaaaatagatttatttgtttttttaaataacttatatgtaaaaactttttgtcaaaaacacaccatttaacagtttgaaaagcgtgctaacggaaaacgaggggtaccgagctagaatatcaatccagcg

SEQ ID NO: 61403 - DNA, 19332 bp, Oryza sativa
tgaaaactagaattccgaatgggatctttgcaagttgttggtgaaaagacagttctctcagttgcatcattgccagcaacccaccacgctggtatttctcacttctacagtcctactgtttcatgttcacaatgcctaaccaaactaactgtatgaatgcacggtagtaccaatttccatgcaatttgtaacgcaggagttcccggtgcctcataggcctactatagcaacccaatggactgatttttatgatcactcttcattagcttgtggaacttgcagttggttcactcacctcatcttttatggagcagaaagtactccctccgtttcaaaatgtttgacaccattgactttttagcacatgtttgaccgttcgtcttattcaaaaaaattgcgaaatatgtaaaactatatgtgtacatgaaagtatatttaacaatgaatcaaatgatatgaaaagaataaataattacttaaattttttgaataagacgaatggtcaaacacgtactaaaaaatcaacggtgttaaacatttcgaaacggagggagtaccacacaatacatattgcttatctcatatatatcttttgtgatgtacacaatccattgcttggcaattatatattcaagtgctgtaggtgttcaatttgcagctacagctgcatgcttaatctcaaccatcaaatgctggactgtaagatttttgcagttgtccaatgaaactattagtgtttttctccgagcctgtagttatttggtgctctttgacaaaaagttttccctgcgaattatccaaaacctgcagttcagtataacatgcatacatgcacatgccagcaagttttgttcagttagttcattctagacctggaagtgtagacgacgctgcatgaggcagccattagattaagccatacaattctgagaacaatttagacggccaatctgaaaatgaaaaatattataataaattgttttccattcaaatgttacccaattagtagttgttagcatcatataaatttttaaccgtggtgtggctcaataactaaacgatgaaagaaaaaacatctcccaagaattcttgtatcatatgacacaaacatgaaacattaacttagtcgtacatattaaattcttaaaccatttttgtatgatgcatacaagatttgtatgagtatacaagacatgaatatcaaaggaaataaaaatgataattagtggttttctagaagggatccaagaggaaacagatgttgcaatggccccaacggtttcctttggttgcattctctctgcacaggtaaggactggtcactgatcagtggagtaacagttcccaatgcctccaaggcccaacaacaaccatgcatatcaaaataaacctgttgcatgattgatgtggccttgaccggcctccatgaagcattgtgtttcacctttctctctctctctctctctctctctatctctcatgctatggaattttcttgctccttgtgatctatcatgtataaagcatgcatttcatttgatgaatctattccaccattgtcattacagttggacgcagcaactacaacctgtatatatgggtaggggtgggcgtttggtttccccggtttaaccggttcagtttatcaaacattaagccaatcaacatctttaagcctggtaattaattaagccaagcaaggcaatcgtgtgtccagcctagagtgacttatctgcagcctctccatgatctttagtctgtacaacaatttattaatttgatgcaattattcaactcggttttacaatttaatgcactacctaccaaaccggttatatgggacaatcgtgcggtggggtacagatatgcaagtgggtagtcctgctacccgcaaaaaaaccccgcttgctaattcatttttcacatgttagtacaaaatttagaagaaaaaatgaactagaagtgagataagcgggccaaaaaaaacccgcttggccgccccgcttacatccctatactagaggtatcctctacttaattacttggatgttcaactcgcttaaagagtttcatcattatctatacatcaaccatcgtccccagctcagaatccttataattagtttagacaaactccatgccatatcgttttgttgccaattaacttcaagagggaggaggatgtggtgccgagtgcacccttgatcctgtgagcccgtgaggcgccaactatcattgccgtgcacggaggaggagatgtgattgaggataagcagggggcatgaatgaataatgcgtaatcacattggcagatcgagagcgagcctgacagtgaggaagacaaagacatggtgtcttgcacggctgaaattttataatttgccactgtagtcatatgagtggtaacccatttgctatattggtccaattccgatgatatagatggtccacatgtcagtggcaaggggaattgcacccgtttgaactaaaactaatatggggcttgtgtaaatgtagcaaaacgttgtgcccacctagttttacaggctgcatgtaaaccacaaacatttcctacccaccccatatatatgggctgcacgtagaccacgttatcatttcagcccaatggcctaaacatgcacatgaatcgcattggatacagataatatgggctgaaggcaacagtaccgttctggcccaactaacatggttcgcatgtcaaccgctgtcaccccaaaagctagccgttgaggcaaggggctcccctacttatatcttaggtcatttgcccttccacaactaatgtgggactattcaacaaagcgctttggcatgtaccacatcaattccgcttctacacctggagagcttagctagtgcattgattatgatgaaatagcccctgtcaggagctgtcgatgttaaagctgcttgtcaggagctattgatgtcaagccgttgttaagaaattatgatacaggaatccctttcacctagtttcagcacaactatcacaatcctctgcagtctgaatttgcaatagagacatctactttcaaagtccgctaatacatcattgatgaatacaagttccatgctgagcctaacattatatgggctcatcgagcctaacaatatattgatgtgcaagagctttgcacatcaatatattagtaagagagaaaaaaaaagtacaactgtgacctgatgtagcggtcatgggagtttacacgaggagaaaggagagcaaaggctgtgttagctaattaaaatcaggccccgaacaaacaataaggcaggaaaaagaaaaaaattcaggactatatgcgagaaggactcctagaggattaggcttcactcctacctagagcttcccctcctacacgatgagaccatgccaggtaacaaggaggatgagggagtcgaatcctttgctgaggttatcaggtggctgccggtgagagcagttccactggacttggagtgtggactgtcggttggatgaagaggaggctagtccgtttttaggcaacaaattggaatatatgcgaaatagcaaaatgcaaaatggaatgcagagtgtggatcgttatcaggcatatgcacaatggaattggtatggtatgtcattactttcatttcagaccaagtgacagtgacaacgccattcatcatgtctaaaatcatcagcgatagagccatacaattttgagaactgtataagaaaatatgatccagaaagtttctttccagatactcaatttttagaataaggctagcacagtgtcttaaactgctaaaccatctatctaccatatatcatgcttagcagaaatcttactttgatcagctgaaaggcaacccaatcatgctcctgccatagtggaccatcgataggaggaggaaaaacatatgaccggcttgacaggaacaggaagaagacatggatgaggctggtatcatcagaggcggcgccgcaagaagacataggcagtagtctgccatgccgccggtgcacggtttcggcccctatatggacccgaaagacggcgaggtccacctaactgctctcgccatgacgacaccgataactagcatggcatcttatcatcccaccgcgtgaatatcttctcacctagctgcgatgctcagtgtgctcactctcgtcaaggacagttgtgccgagtgcgagtgcttggctgtaggattgtctcaaccctgatgacattggagatgatgaagtaaaatgatgaatcccgatgcctcctaggccaaacagcctgcaggcactacaaagtgacctggtacatggcggtacatataatatacttggagtggcctgatctgccagaaagtattttcacatgaagtgttgtttgttcccactctgtgtttgtagagaattcgcttctttgctgatctgttgattgattcatacaacatttcattcgatgcaattatttatagagcctttatggtacaatgaaaggttctaagtcctaatgtatagattgattttccttccacttaaatagattaaagtataaaattaaaagcggtaaaattgtatttttgtgctactgctcggatgcaaatctataaatttgctttgtataatggaacaacgctaggtgttttcccccagacgagcccattcctcattccccatcatccactcgtccttcaccatagcgaggtgctactagctactgcaagtccatgcacaccgtgccactgcacagtgggcatgctgcgctaacactcattcttttcaattttgtggcaaatttgtagagcacctttacggtgctccatactaccatatactagtggattatactaccgatccagtggtttaaattttactagctcaataactaactaattactacaaatcttggtttgatcaattacatgcagagggccatcttggttttgaggcgaccggcttctgccgatgctccgcaagaagaagctcgtcggcggtagtctcccacgcttccagcgtgcagttttagccccaagagggaggcgaaagtcggtgaggtccatccatctaaccgctctccccgtgccggcgccaacacgcgtggcttctttagatcgcaccgcgtgagcatctcttctggaagctgccatgcgcagcatcgttgccttcctcaagtatagttgtgatggcggcaagcgctcagctgtaggtctatgatgagcctgatggccgtagggatgatggagaagcgaaatgacaaatcctgatgcctcctaggccaaatagcaaggcattgcaaagcacatggctgtgtgcctggagtggtctgatctgcaagaaaatttttttatatgaaatgttgtttgtttgccccccccctccttctttgatctggtatttgatttatacagcattttattcgatgcaattagttaactctatcgctgcagttgaatgcagcatctacctcgtaccggagatatctcagtacttaattttgaggataatatcgtttggctccaactcagttaaaaggttcaggaaaagaaatgttgatggctaataattgtgaaaccaagtgttgttttggtttatttgtaaaattggcaaggaaattggaaaccttctgttggtttaatttcttggaaatttggtttgaaatgttggcaattgtcaacgttagtgcgcgtgactaatgtgggtcaggttgctatatctatgactagaaacggttgtttggtctatatgtgtactatgtgattgaagtcaaccttggtccatggcgaggatcaggattatgcttagggagaagcagaggtctagcatattccagactatgctcacatagaagaagaaatttccaaaatttctgaattttgggtctatcagaccccctccccacccccgcgatgcaaaattattttgctcgaatatttttggattttttcaactttttgtgaattcaacaaaaaatatttgaatttgaccaaattttattaaaaattcaaattatttcagaccgaaataaccgaaatttcggccgtattgtcaacccctgatggaactaccgaaattgaaatattgaacatgtcacgcccggaatttctatccaaaatttcaaacgcttacatgcgtgtgaaccctcgtccaggaatcagccgaggcatacaataacaaattgataatagagtataattattactctaattaataagcgaataaatgtcattacagaggtagatagttcctctcaaccaataaagatctaagcagcagaaaaataagataaacggtgcagacgactccactccacaggcaacttgaccagggttacacctaatcctccataccatcagcatcactgtagaactcctcctctgatgaatgattgcaaggtgagtatatgacatactcagcaagccacgcagcaaatatgcaagtgcacaggataacaaaggatggcatagtagggtttcatttgcataaacaacatttaataaacatttcagaatttaataaaacggttaagtaataattaaacaatattaatccaacgctatacaacataccctgttgcataggcccaaccattctgaacaaccatcccagctgcagagttctatctccaaaccaggaatataccattccaaaccaggagctaatcaaattattaccagttatagcatcttttattatggtgagaaatgtgaaactaatcacgaaagacattattagacctgcccataaccgcaggcacggctattcgaatagttttactctggccagaggtgtaccactgtacccacaagacacagccccacaacgtcaccatgcgcctcaataccaccacggtacctcagaaaggagctgtgacagtacccctcgcacaacacaatccaccacagcgcaccgttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaactgaaactcgtgaaccggtccttaatcgtcgtgagcacgaccatcaaaaccatgtgctcacaacccaccattatcaaattttagttggcaatttaattaattaaccaatcacgattgaccatcgtgagctatcattaagccatcattaaataatagtgagtcataagtatcccatttatatggactagtgtttctaagcatggctaagcaatcatatctgatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcaaaaacggactctccggaaacgtcggaatctaaagagaaaagagcaaaatcaccaaaacagcacataaacaagcatgaacagtatatgttgatatttttaacatctagatctcaattttagaaaaatttagagacttgaaccaactaaatccgagctaagatgaattagttatgaatttttaaagattaaatcggattaaaacacttatatggattttaattgaattatgacgcaataatgaattatttttgaaaagtaaaagggaattattgcgtcagcggctagggttcgcggtgaaccgggtgcacggcggcggctcacggaaacgaacggccgagatcgattcatccaaaacggacggccaagatccatcggtccacgaccgggccacggggaatgacgacaatgacgtcagcggtgacgtcaccaccggcgacggctcgggcgtgcatgctcgccggcgaacgacagcacgacagcgcgaacggagggaaccaacacgtagagggcgacgcggcgaactcaccggtgaccaaaacaatggtggaagatcaacggacggcgacggcgtcgaggaagaagcggcggcgaccttcggcttgacgacggcgatggtgttacggttgtcgtcagcgacggcggaggggcagacgaggtcggcgacggcttggcgatcacgacggcggccttcccgagcgacgacgacgaccggagcggcggcggcgcacggctggacgaacggcggcgacggcggcgctaggctacacggtgctagggctctaccggcgacgagaggcgaaggcgagggtggcggcgggtagcggagacaccgggggtccttttatagggcttaggaggcggcgacgaaggcccacggcgaccggcgacgtgaaggaaagtctagggttcagaggagagagacgaatccgattcgagatcgaatccacggatttccaaacgaaattagccgacgattccataagagaaaagatagaggggatcccggggatcatttcccctctactaatttcatcggaaacgaaaaggggcggccggatttggaaggagatggcggcggcgcgactctagggctcgggcggcgggcggccggaggtagacgacgacctgacaggcgggccccacctgtcagcgtccaagggcgcacgcacgcggctgctgcgggcagactgggccggctttggccggggagagagagagagaaggttttgggccgactttcggcccaaagccaaaagaggacttttaaaaccttttccaatttaaattattcattaaatgcaattccatttattaaaaatacttccttagctcaaataaatcccagaaaaatctaggaattatagaattaagcaaagtatttaatgaaattttatctggccctattttatattgtaatttattatttaaaattagatcttctcttctaggcttttaaaataaattctaataattctaatttagacaacaatttatatatttgggatttttagggtgtgacagaacactagccctaatcctaccatagtgaaccatcaacgggaggttgaagaacatatggccggcttgacagtgatagtaagaagatatggcagaggatggtgccatcagaggcggcaccacaagaagacgcggtagtctgccacacattgccggtgtgctgtttttgcacaaagagggacatgaaagacagtgaggtccatctaactgctctactcgtgatggagccaatatgcgtgcatgacatcttatcatccccaccgtgtgaatgtctcctcggcaagctgccatgctcagcgcagcgtactccctccgtcccaataagaaccaattcctggctatgaatatggacatatgcacatatccatattcatagccaggaattggttcttttttggatggaaggagtactcgccatcaccagggaaaatcatgatgaaggacgagtgcttcactgtaggactgtttcaacactgatggctgttgagagcggcaatgctaggtcttttcctccatcgatccctttcatctttcctcaatatcgtccactcatcattcatcatagcatgtcgtcactacccaccacacaagtccgtgcaccaccgccttgcgcacgctgtgttgccatttgccctttctaattttctagcaaatttctaaggtacgcttgtttatactgatagtattaatatcagtatattgtactataaaattcctcattaattaactgtcgttgcagatgaatgtagcacctacttccacctgtgtatatatgggccaatcatcagatgtgttttggagatacctcaatgcttaattgtttggataatgttttgctccaactcaatcaaaagttcaggcaaagaaatatattaacggctaattaacggcatagtatgtgtacgtctccttaatgttctttctgatgttgaatagacacaagtagcaaacaaaaacatcctttagaatttataatgcaagagctgctttcaccttactttcatagtggttatatatccacattctctgaagtacgcattcgaccggagatacaacttcaaagtctgctcgtgcatttggtactagatttccatcttcaagggtctcattaaaatcaaatggcatatgatcaactcctaagaattgtccattggatgccaaaaagatggatgtacggtgtatgcacagaactaatgttatgggcagacaggttagttgttactagagccccactacagtgctctctactggtatagaaagaaatctgaaccattgatctcatttgataaaagggttcatatctatttatactaccatcccatttagcggtagtagaaacgtggagggacattattgtatcaaagaaatatgtgcggaggggcataatcatcattttgcagttactaaactttttttccttattttttggactttttcaaggaatactagtgatgccagtgcaatggataatcataaatcgatttagttggaaaagaacataaatgacagttacttctaattatggtattagtaaattactaatttgcccctaataattactggtagtataatattaccagtatagagcaccgaagcatcgctcggattactaaggttgcttctccgaacttattctccctcaattgtgtaacaaggactctgttagttggacagactcgagaccaggcctctagtgtaccactgctattgagttcatcattttacacgcagatggatgggcctgcctagactggcacggaaagacgaggtcaaactaaatatgtctaatctgaaaataccaaaagaaaaatttgtgacaaaaatgcgacttaagtcttttcgtcatgttctgattccagtggaaattcatctacaatagtagcgacaacgacagatgttatggcctttgtgagttgacttactgctaccgtcgacaaacaatgtatgcccctctgcaagatcaaactattgagtgcatgacaaagagaaactcctgagaagtcaacacaagggttaatttccgtatgtaatacatgagtttgtgtttgcttctcaggtgtaccctaccattgggccactagagaccagactggttctcatcctagtcttttgacctgtaattttggagtcattggctgtcgcttcttataagaaaatgccggaatgaattccattatcttataaaaataaacttcttactaattacagctggtatgtgttggcttcatgctactatcgaaagatggatgccggtttgctagaattgtcagaacaatagaaatgaagtaacacaggagcttctctggtgcctcccagccctaccataacaacccactgaatagtagactcgtcctcactaactcttcatttctctccatcagcttgtagcacttgggctcacccactgcctctatatttcatggaaaaaagggcagcacgataccatatatgaagatcctcgacgttactagctagcacattaactaacaaatgaaagaaagaacaagtcttaaacattcttgtatggtatcacacacttagtagaaacctcaatttgaataaccagacataggattaaggactaagaaaaggtaatatttgcatgcataaattaaaatatactatatatacaatctgaacaataagaatggggatatgtgccaaacttcaagggattcaagaagaaccaggcattgaaatcaactcagtggtttattcagtttgcattgtggaatcaagaaaactgagaaaaatcctttcccttgtcacttggctgttatcagaagtgggatttaccaaggatgagtcttgttttttccttttgtgtggataaggatgtgtcttggttctttgtgctttgatgattttttttttgcggggttgtgctttgataattcatacacttggtcaccagacatctgctttcgacactagtagcgaagccaggatttgatattaggggggtgtgggtgtggggataagccataagaccgatcgaccaatatcgatagctaagggtctcaaatagtcaccatcaataacaattaatgtgtaaactagtcctttaaaaaaacttgaattctagctctttaataatatcacagaaagtttggaactagtctttattgctaaatcctttcaatgtaaactactgaataatctcacaaataagtaacttctattttacttccaaaaaagatgagaaatcacaaactaaatatgaaagttgtagatcatgttcttgctaatgttttttttcagaactgatcttgtaagtacaaccatacaacaacaggttggttgtgggttggggggggggcgtccggataggtgggtgttgaccccctctagcaccccccacagttgtgccactgttcgacactgctggccaagaacttatttcacacatgcgtcttgttcctgccatagcaaagtggtgacatgaagaagaaaatgtcaatgacaaaccaaggttggttttctatgaggggcatcagtaagaagagtccccagtcttgtttgcctccttgatgtggctccatttcttaggtggagggaaaattaatcactctaagaatggttcgacattgtaggttcctatgttaacagtgataaggacaagcgcgctacctggctcaagggacccccaacgatggtttgagcttccctgagactgagagggctcaacatgcttcaagggaaccgttaagtctagctctagctctggctttgtttcattgtgctgccggcaacctgaccaaactagcagcacgtttcctcacttctgtcgaatgtcctgagctctgtataaaacagatgaactcctggtgcctcccaggcctaccacagcatgcaaccttattggccagtcctcataccgccattagctcttagcaaagtgctctttctcatcacaagttttatagagaaaaaaaggaagtacgatctgattacatatagttattcatcattttctgcagttcttttgatcattgtgcacctacaactgcatatatatttttccttttggagatatgacttcaagattagtcactcttcaggttatcattagaatgaccatacatttaagagcaaaatatatggccggttcttaaacatgacagaggtgccacttagctccataaactagaaaaatgcacatataggtccatcatcatggcttgatgaaccatggtcggtccaaaccttatttgactggagttgaccgctgacgtgacattccacgtgggcaagactttctcagccacccaccactccctcctcactatcccgccgatgtggcattccacattggcatcccaataccccgcactgatctgcactatcttattcaccaatgaagacataactctatagataattgatgtatcccaatcccaaaacttacaccctgatccatctttctacagaaaatccaagtaatgtcaaatcatctccctcatcgctacccaacacttcggcttggagtggtgggtggctacaaaaccaaatgaactcaactaataatcatcaggtgactaggcaagtttagaaaatattgccctgattagcatccgtcattgctgtgcacttcatgatggtctgatcattgcatgaggggcactgaatcaacggaacaactaacctcttccggcgactactaaatgaggacgagcttggaggagccatggcggcctgaagcgttgaaccctagttgtcatgggagaaggcgacagagcatggatttggggattttgtggctatccaagtggtactatagtttgaaggggctaactgcaaatatttctccacgcttcattgtggagggggctggctacaaaaatggatgcccacgtggaatgccacataggcggtcatccctggtcaaacgaggtttagaccggctatggctaattaaaccaagatgatggaccttgatgtgcaattttcaagtttatggaccatcaagtggtacccccctctcataagtttaagggcgggccatatattttattcgtatgagtaaattacacacaggggaaaggccaactccgtgtttaagtgccattaaaaagagaaactacattgaaaaaagcactacagaattcctgtctcttgccaaatcctccactcatgcacaactgtgcacacaccccagactcatggacgaggcgagattcctaattggcgcatacgcgccccgggcgcgcaattccggccctcggcccacgcggccaattaggaatctcgtgtaagccgcgtgccgcctcgaatctcgtgggcccttgacgttggtctctttgtacgcttcgtaattgatttttttacaagtggctttctttaaactaacgtaactaaatatgttagttaaggataatgatagtatttacggaattttttttggtagattttttttattaatagattgaaactttttaagttacatttgaaaacttttgacttaagatttaaactttgaagttaaattttaaaaactttcaactcatatttgaaaactttcaactcgagatttgaaatctttcaactttcatctcaagtttgaaaaaatttcaacttagatttgaaaacttttaacccagatttgaaaacttttaacttgagatttgaaaactttcaagtcgagatttgaaaactttcaactttcatctcaaatttgaaaaactttcaacttagatttgaaaactttcaacccagatttgaaaactttcaactcgagatttgaaaactttcaactcaaaattaaaaactttcaactcaaaatttaaaactttttaactcagatttgaaaactttcatgtcaatattttgacaactttcaaatcgtattttgaaaattttcaagtcaatatttgaaaacttttaactcaaaatttcaaaagcaattgtttttatttttattgagagattactgtagcatttcgctaattgccatgattagcgctgatcgttgggattagcgacgtagcgtcattttgtaaacgctacggacgaggaggccgcgtgcgcgcgacttaagatactcgcgcgtgcgcgcgagctagctatctcctggacgaggatccctggaaattccgtgcgttgcacaccttccaaattatgtggggaacgagaatcccacctgcatcaacatgtagggatattggtaggttatgctagacacaccaagtaaagtatcatgtatagttaccactcgacatgccaagcagtggatgaagattctgagcagaccgatccaacaaagcgtgtgtcaacgtagatggttagatagtgtttttatggatgatcgatggttcttaataattcctatatctcttttatttcagaacttatgggtgtgcttgtgatttgacagtgtatcctacctttgtagaggctaggagtgttctctgtgcagttgactcacctggactgttgtatccgtggagtattcggctcttcttttgtaaaagaaagaatattagtggttttcctctcgtagcctcagctgctgtatggcacaaagaattccctacaatttataaattaaaaaaccagcagttcggtttatatgcttccactgtggtccagttatagtttatcatttcagaaattcagcatctttcagaagcctactacgaaattgaccttttgccacaaaacaaattgttgcattattagagccaaattcatggcaatagctatgcattgccacaaatctaaagttatgagaaatgcccaggggttttccggctagctccacaaggtggtgcgatagacgacctgggttcaaagcctcacccctcctaattatttgatattaggtccttccctaatattgtagttttttttttcaaatctaaagttacagtagagttgctagctagccgtggtaacaaatcttaagctacgatagagttttcttgttgcaacgtttattttcatggtgctttctgatttatattgcaatgaattgctgaagtatcgccacaacgttatatcatggcaagaaagtcttatttattactacaaaaccaaaaattgtggtgaaagtataaactattgccacaactcatatgttgttgcaatatgttcgtggcaatagttaacttctcctgtagtgatccatgcaaccatggttcaggtggtcaaatctgaataaaaaaaaaacatatcacaagaaaacaatatatcctaccatatactaccccttactcaatttttaacagcttcttaatattactgaagctcctcaatgttactggcgcaaattatatcgcccctaataaagcagcaaatgtcaccttcaacgtaacacccttcttttgttcattgtgcgtgtcataaaaaataatccgccacaatttaaccagccaatcaagccacaatttttcatcaacaacggaaccgactcacggatataccattttaccatgaaggcctattttgccatggctcctactcccaccagagcctgtgcctttgctctctggcttaacaacaatccccattcggtgaagatgacccaaccacacaagcaggaaggctacgctgagctctgtttcgtgagaagcgcgcggcgtacatcagcaagtgaatttggttgacgttgccagaacaggagggttgatggtgccaggagtgttgaggatgatggctcaaagacaaccaggcagttcagggtgatacggtcaaatggcaaatcctgattcctcccaggccaaccagacaaccagtggctgatctgccttttaacatgtggtgtgttgttcatctctctttggttctgattttttttttatttatggaacatgtccagtgtttgatttatacatcatttgtattcaactctgttactgcagagtaatgcagcacctaccacctgtatatacgggacaataatggtctgatgggtgctggagatatatctcagtgcttatttacatggataattttcagctcggttaaaaagttcagacaatgaaatgtttatggcttattaagtactccttttgtgctcaatatgttaaagactcattaatgctctttctgatgttatgtagtagtaataagcacggaagcaaaacattattcaaaattcataatgcaagagctacttccaccttactagtcatacatattttctgaagtctgaattctcttcgagacaacatcaagtctacccatgccttttggtgattactactcgctccatgcatctcgtactggattagacatattccagtactataaatctggataggggcatgtccagatttgtagtacttgcgtatgtctaatccagtataaggttactatattttgtgatcaatgaagtacttggtagcaaccttgaaccgttacctggaatattaatatggtgccaaacatccatctttgagtgtatattcaaaaccaaatagcagttgatcaaccccaaagtgccatctgtttgtgtgtaaaagaaatataaaccaatcgatgtacacaattatgttttgggcaaaaaggatagatgttgtcgggatcaaactggattattgcagtggcctcgctaatcctattcattgttcgttcatggcgcgcatgtctctggccactggcaaggaacattaatttacgaataaacatcgagatcatatataggattggaagttacaagaatgcgaggactgcgcttgatgaattttccttaacataattcaatcaaggacctaataatgttgatttatagtgtaggagtacttttaagtcactccgggattgtttagatcgtccatttcatagatctaatgtttggtactcttattgattacctcctatgaggtaatagctcttaaaaaaagaccatctgtttttctgcattcgatatttacagcatggcgttctataaggtcagtactaagtgcaataatcttctcacatcctaaaatcccaattataatgtaccagtgtcttctaaggctggccgctaagttgagtgctgcaccttgcatgaatagaaagtacaatctggactcatatggaagtgtcagaaagaaaatggctcatgctaaatccatcctgacatacaaatagtctttcaaaattagcctcgatttttgcatagaaaaatgtcatgatgaatacatagtgattttctttatgggatagtgcgaggtatatttgggaacagagatagattcaagattgattcaagttggtgggcattggacaagtctcaactgtttatttttaaatttttattttgtggcaggtgtcccaactgataaattggtgaacaagtctcaggctctcagctggttgaagcagaacaacccagtaaaagttcagtttgacatatacacagcaggctaccagttttgtccagttcatcatgacaaatctgagaacatcactccatcaatataggtggtttaatctttaaaactaaaactagtaaggtagcccgcgcatacgcgtgggcatgttgtttaatcttgtttgaaattttattattatgaatgtttatgtgtggatgatatttttgaaatattttttactgtattttaaacatatgttcgttaataactgttgggcatattatttgaacctgtatatcctcaaatttattagaaaaaatatgtcacaataatggagttagttcatctatttatattgtgcgtgattctttttttaaaattattggagtttccaaactttatataacattttttgttttgtatgctatagatgactttaagtaatattttaattttattatatattaatgaaatatattttctattaaaaacatagctaatgacgctacttcatctaatcaaagatagacttatattacttatattccttccgtcacataaatcaaaggagttaaattttatcccaaaacaatagaagaatttatatgtaaccaagacagtgattttctaaatataccacgataatctccaaaataccttatcatattttgacaaatatctatattatagtgcatgttcgttcagtgcccggtttgttttccacacctattgtttctaatcacatgagacaccttcagtaatttggagaatacatatgtacatttaaattagtgttgtacatttggcatgtgtttttcacacctaaaatatgagtgaaattttatcataacattaattattacatgtcggctccatatttgtgatgtattttgggctatagatattagtagtttatttatttaaaggaatacaaccggatcacaaattggatatatgaaatttaaataattt

SEQ ID NO: 61404 - DNA, 19310 bp, Oryza sativa
  unsure (1)..(19310): unsure at all n locations
attatcatcatcagattcatcaacatcagaacttgcattacgagcaataaaagctagatcaacaacttgcttacctttgctctcatcttcatcttctggttcatcaaaaacttttatgagttcttggattaaccaacgcatacaatgcttcttcttctccttttccttcatgttcttcttcttgttcacgtcatcatctttgactcttccatcatcttccttctttcctcgcccaagcttaggacaatgcgagcgaagatgatcaagtgctccacactcaaaacaacgattcggttctcctcttttcctgttcctaacatttttcatagctcgagaaaatttgttagataacaaaaccaagtcctcctcctcgaactgttcgagttaatcatcgggcatggcattaaataaagcaagaacagaagacttcgatgaagaagcaccaacatccaaagaagtcaaggaaaaaaccaaagcagtagacttagaatcaactttatgagaaagaatattcatctcatgagttttcaattttgtgtaaagcgaatctaaagtcaaagtagacatgttcacagactcctgaatagatgtaactttcatatcccaaatagacatgtgaagaccattcaaaaagtggcgagaaatctcagattgtggataattagcatcataagaagaatcaacagatctaagatcactcaagattttattaaaccgagaaagatagtcatccaaagcttctccaggtttcatctcaaatttaatatactcctttttgaaaagatcacgacgaagttctttaatattatttgttccttgatgaaaattactcaaagcaatccaaatctcatgagaagtttgaagatgagcaacacgatcataatccgaatgagagatcccactcaataaaagttaccctcgaaatcgacggaagtcggtctgaccgagattgatctgccagtctgaccgactggatgccaccggtctgaccagtgttgaatcttcggtctgaccgccaaagttgcctaccgcgcctgtgatgtgagcgtgtgcataatgaaaactgatgcaacaccccttgattataaagatgtcagtagaacttggtgctataactgttgcatatgcttcacttagaggaaagtatatgttgttgttcaactcattgaatttgatatgagttgattggttgatgactccaaactcccagacatgtaagtttaatcttgacctactactctgaagcgaagaaaaaattgatgactcccagagttgactcgttagctgattaattgattgcttcatcttgacataaagcttgctgaattttgagccatgtatttgtgtagcccccgactctttggttagttgggaaacaactgaacatagagtcaagaattatagcttcttgtcgtcgagtagtcattgcttgattgaaggtatgtgttgaagatgtccaagtagaaatcctgaatattggagagccacttgttgtagtaaaataacaaggcatcatatttggtgacgcatgccgagatgtcgaaactcttgtagtcatcgtggttggtgaagtagcaaagcttgcgaagcagaggcaatagagtttgccggtgccgaagacaatgaagatgaagtagctccaccatggtgacaaagttgtatagccatgatgacgtgaacaggagtcggcggcaacagaaacaaaccggtggcgaagatgcgcagtgatgaagataaaaacaccagtcggtagtagaagaaccagtcggcgtcagacaaggcgaccggcggtgaagacgatgacgtccatcagtaatagtagcggcataaaccagccgtagaggcgagggcaccaatcagcagcagacgagacgaccggcggaaacaccagtcggcggcggcggaagcaagcctatggtgtagatgacgtagacgcccaacaacggtgatgtgaccaaccaaccgtataggcgaagacaccagtcggtggcggatgaggcggccggtcggtgaagacaacgacgcccaataacggcggtgtgaccacccaaccctataggcgaggacaccactcggcggcggcaacggcaagccggtggtgatgttctgactgatccattcctagagcgtaagagataagcttaaagccatgaatcccttttatgcatatctggatctggatcctgcagaacaaatatataggatgagtagtatctgatataatactcgaggaaaattcaagtatttttaaaatgtttataaatatgtatttctcctcttgtcaattttgatttccccgagcggatgactccttatgtttaaacactctgcccgactagtcatagcccccatgcaccgggagtcggcctaagcacttcccaaacatgcatatgagtgacatgaattcgtcattaatggaacaaagtttcacgaatcagaatttactactcgggtacttccgcaattgttaagagcagaaaataaatttatcttatctctatgcttttgatttattccgaataatacttagcaccttgcgttactcggtccatccaacgagcccccagctgctaggaatcggcccaaaggcaactatccatcgataaaccaaacggaaagcataggaagatagaactccataactcgataggtacttttgtacttagattatatcgcaagcaatcaagataaatattataaaaattgtttagaaaatataatataacatctgtagcccccgactcactagtcaacggcgaaccagttgacatagtgaggcagaggaaaaggaaaatgtcatataaagaatgaaataaatgatgacttagctttgtaatattccccttggtgatgacagaggtggccaatgtgggaacaaagtcgtccatcaataacaatgaagacaccggtcggcggcaacgaaggcggttgacggtgaaagcgaagatgcccaccaacggcggcataataggtcagccgtgtaggcagagacaccagtcggtggcgatggaggcaggccgagggtgaagtcgtaaacgcccaacaacggcggcataataggccagccgtgtagacagagacaccagtcagcggcgacggaggcaagccagtcagtgaaaatgtagacgcccaacaacggtggtgtgaccatccaatccgtgtaggcgagggcaccagtcggcatcggcgaacgccaaccgtgaaggcaaagaaatcagtcagcaacaacaaaggtggccgacacgggtacatgcaaaatagatcaatcaacatatgaatctgtttagtaccacgaaatataaatataaatataagcaatgtatgtacatgcaaaacatgcaggcaagctcaattaattaatcaattgatgcatgatcctggcgaggtgtcctgttagttgaatcgtgcatgtcgatagatcaacacatgcatgtgaattgctcttggctgctggtgatcccgtgtgcaagctgtaggcggcgctgcctatagtcccacagtgcatcggggaacacgaggcattgggcagacgcatcgagatgatagccattggtcttgatctcggtcggcatgcaaaaacaggagagtaacacgaggttaatctgtagttagaaaacaatctaactgccgggaagacaaacccaatgaagtttcggcggtgaaggctgccgggagatgacaaagatgcccaacaatagcggcggcgtccaccaacaaccgtggaagcaaagacagcagccggcaaaggcgaaggcgttcggcggccaaacggtgctgcgcagctccctcttgttcgctgtgtgagtttcggcaagaacagacgctaggtgacgtgagtggggccagcgcgatcagcagcaccacagccagaacctatcgcccagcagtagatagcttgcttgatcttgatcgctatcccgtgcacgtgaacaaccaaagctccagcatgcatgcaaaataaacaacacagcttaactcatctgttagtgtacaaataaatattctgtatatagaaggatgaatgatgcacggcatgattatcagttaatccatgcacgcagattggatcagcacgccgtgtgcatgttttattcctggaaaacgacgatgtccgcatggctttcctagtgggcggagcgtttcgtcttgcgcggcggcagcttggccttttgtcaatcggactcagcagcacgcttgattcaaaacaccaattaatctgctgatgtgatccgtcaactggccggatcaatgatcggcccaaaaactcgacatggaagccgaggatgtttacatgcatgcaaagatacagactaaccattgtgattagtactaaaagataaaattatctgaatttgatagattagaacggctaaccagtcgtcgatgaggatcggagctatcaaatttgtcgggactaatttccttgccccgaagggaaaacggatatggtaactcctgagatttgttccatcacacttatcgacgaggaactcgacacgcccctacctggcgcgccaactgtcgaaacataaattcggcaataataaaaggggtagtgcacgagacctaaaagtggatggatgcggagacaagagatttagacaggttcaggccctctcaatgagaggtaataccctactcctatttagggatttcaatccgccaggtgtattataagatctgacgatctagttatgtcctgccccctaaagggcctcctgcccaccttatataggatggggaggcaggattataagatagaaaccttaaccgatacggtatcggttttctaaatctactttacaatcttatcaaaccagaactttaggccattctataatatacaggaaaacgtaatacccaagtcatgatccattacatattccatagttataagttatcccctataaccagtcggataatcatgctgtgtggatatggggtacctataatctccacaatgtgggagtgagttttgtatgtagtgttggtgcgttctacaacaaactgatgtttcattcaatgcatggctttattctaatggcctcaaaaatgccgagtggcaacagcatctacttcctgctctagaggagatgattttttttttcctttcaaacgccgggaaagatgaattaactgaagcacagtgataacgtagcctggtaagtgcattttccaggtatatcaaaccgacctgcgcaggttttcgataaatttaaaggaatctttgcaattttgcatcactgttgattaagcatggaactcagctgggttaatcagagttcattaccactgcaactcatcagtttatgtatccaacaattcggctatttggttcaaaagtatggaattcactcatgagtagatcagagttaatcaagtatgcagttgtagtgggtgggcattaaactccactgcaaaacttgagtcactccaagttatatactcccttcgtcccaaaatataagagattttaaatggatggaacacttcctaatagtacgtgtcccattcgtccaaaatctgatgtctcacctttttctccatgaaagataagatgagagaggccaagttctccatgaattttccccgtgtcgatgaaggaactttagtcaaatttattaagaacgagtgccataagagatgatgtagaaaaatgaatagttacaaggaccaatccagttgggttgatatcgaagggttgggaggcatctgaagttcttgcgttaccaaagctttgctcgattcttcgagatattttagataaaggattatcaaacctgacctctttacatttgtgggggtgtacacagctaaatattcgaacacgagtacataagactttcccttaaaggggtacaaactgcagcaactaacctctcccattacatgagagataacaacacaaaagtcttaagaacaacaaaagaaggaaaagactaggcttcaaatcttccaccaaagttccagtgatacaccgagaagaactccaatacacacttctccagcaacttgcaagagctcttaactgtttcttcatcgactcctttaagaagcaaagaccaagttcttgcccaatgcattcccacaaaaaagacctgcaagaaagatgtagaattggcaccattaaagaccacatctctgttcctacataaccaaattgtccaaagaaatacagctatgcccacaaagcattattctcttgagcctaggttcaagacacaatctagctgtcacgccccgaactagtcccgaccggaactagcccgtgacgctccaatttaacctgttaatcgataccagtcccaggaaacagtgctggtatcacagggagacagaatatcacagcaacagaggtctctttattatagagtagaggtacagtcatgttaggctgcggacagatcccgagctcacaactgcattacaaaagggaaacggaagccaggacttggaccaaacacacaggcgcgacttgggaactaggccgaaaccctaaaactcatcgtagccggcttgctcctggaagaactcctcatcagcaggatctgcttcatcttcttcagcaactgggggggatatttatatagagcaagggtgagtacgggagtactcagcaagccatgggaattaagtgtttaatgcaggcttcaaggaaaggctgttgttttcgcaatttattttatttaaactcttttctaaaaacaactaagtgagtgcttctcaaacgacacggatgagatagtgcgtctcgtccggtcggagtatgtgcaatgtatcagtctttagaattaaaacaaggttggcacccggccaacagcttttcaaacggccacccgggccaacaacttttcaaacagccacccgggcctacaacttttcaaacagccacccgggcctagctaatcccaacagctgcagatttttcaaacatcgaaccccttttcacaacagcaatttcacaagcagtagtcaaacaaaactacgctaggaatcacctcacatccgcccatgaccatgggcacggctgttcgaacagtttgttaacctctgcagagggggtacactttacccacacgacattactaacccgggtcacccaacctgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccagaggtgtcccattccacccatgtggtcgtacttgtcttatgtttggatgaaattccaaggaaatcggtccttaagtgcaagagcgggaaaccgtacacccgatacgttccccggtccgtggttttggaaattcatttagttcgtaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaagtccgccaatctgtcttgcagacgggacaaaagattaagtgcgatcctatcaatgcataatatttttcaagcaacataattaaatttcaaatataggctcaagatgttcaaaggtggcttgccttgctcgagatctagagcttgatcctcgaaatcctcgcactgcgggtcttcgggctccgaaactacacgcgaaacgggacaactcaacaaacggcgaaaataaagccctattaatgacctctgagcatgccattagatagatctcgagatttgaggaattttggaagttgaacggagtcaaacggatttatggttgggaagatattgaatttctaagattattggatttttgatctaaaggaaaaaggatttaattaaatcctttttgaaaaagaaaagaaaagaaaagagggaggggaaatagacttttcctcgggcggctagggcgcggcccgagagaaaggacggcttggccgagcttaatgggccggccggcccaaggaggcggcccaagtgcgcgcgcgcgggaggggaggagagagagggccggtggaccgggctcaccgtgcgcggtcccggggtggacccgcttgtcagcggctcggctcaccgtgcggagggaacacgcgatgcatgcgcgcgggcgggggagggacgcggtgcatgcgcgcggtctgcggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgcgggccggcgggaggtagacgacgacgccggccggaacggacggcggacaacagcggcgagcggcggagcgaaccacggcgataccggcgaaagcgagcacaccgggtagttgcacgagacgaggggagacgagccaacggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcgaattgggcggaactacgccgagcgaggccggcgacgggcgggtgctacggagctcgggcggcgacagcggcgagcacacggcgagcaacggcaacggtccgggcggcgccggctaactatggggaggctactcaagctactaccgaaagctagggggaggagatggagcgaggaggaagaacggagagaggcatcaccgagaagaggaggggcgctgtgacgagaggccgacggcgcgggagtaatctctccggcctcgggccggggaagaggaaggagacgagtgcccggagtccccttccacgtccacgaacgcaccggctctcccggcgcttggcgatggacggcggaggcgagacagagcacgggagcggcggcaatggcgagggggtgaatgggagaggaaaggaagggagggggaggctgggggtttaaaggggcggcaatgtcggtttgggaaccgacttagggcggtcaagggcgcgagctggcgctcggcggtcgcggccaaagcggcgacagagaggatgacgccggcgaggaaaaaaaaggggaaaaggagggagaaaaaggggcttgcccctttgcccgattcgggaaaaaggaggggggagcgggccaacgcggcacagggaggagggatcctgcctccgtcccttggcggcttgcgcgcggagtgacggggtccgggcggtacggacgcgagcggtttggaccggcgcgacgacacgggcgacaggcgcgggcaggcgctgccgatgtcggcaaccagacggtcgcccactcggcatgcgcgcgcgggaaataacggccggcgtccgcgcgggcgcgcgcacgcgaacacggcgcgcgggaagcggctttgcgagcggggagctcgcgcgaggggagggggggcgctcggcgtgggcgactcccgcgcacgcgcgcgcggcgtgcgggcagagcggagggggagcggagagagagacgctcggcgcggctctcgcatgctcgagcatcgtgcgggcgaggctgagcggggctgagcggggggagagcgcgccggagaggggagggagcgagagagagagagagagagagagcgcgcccgggagagagaggagagggccgggggagagggggagatgggccgagcgagattcggcccatcgacctcgggggaggcaaaatagacttttgcggaggaattgattttggaaggatttggattcagaattgaactcgacgatagatcggggattgagatcttgagatggcacggacactagacaacaagcaaggaaacaaatttcgcaaatagggtttttaagagataattttcccgctaggcgccacgacggaacgggcgctacactagccaattcccaaacatttgagacatgttgtaagtttgtctaatcccaaatgtaaaaaggagagcattgtctaccaaatgaggaactacttcatttagagtctcaaggtctcacgccctaccgatgagaatggcaagcatatctgcgcccgatgcttcgagataacagtagtgttcttttcttgtcatgtattcgataatcacgtctcatggcaactgacaatggcagctactgaccgtaccatcaaactgtaattagttgaaaggaagtctattggtgttgttgatgaccattcactactataaaacatcaaataggtatcgccactataagtgccggaagtactaaaatcggcacctataggcattttcccaccttcgcgggttgaaatcgaaaaaaccggcacctttaagcaattacaggtgtcggttctaaataaaaaccgacacctattctatatgtatcggttttttaaaaaaaacagaacctttaatattaaaaacaggcacaggttttcttaaaaaaacggcacctacgaattgagccgaaccggtgggccccaccacgacgcgtggaggaaggtccgctcggcgctcgcacgaggagataaggtcttcgaactctctcgtctcatctcgatctctcttgttctctccgctttctctcgcgacaccctccaaacctctctctctctctctctctcatagcggcctggcggaggtagtggcggccgcggcgcctcccctccgacagatctggccaggagcggcgacccggtaggaggggaggcgggggcagcggcggggggggggggtggcgggagggaaggcgacagccggcgggaggggactcggcgatggctcatgtgttcttgtgtgttttgtggttttgtgtgctcatgtgttcttgtgtatgacttgtgtgttcatctcgtgttcttgatgtgttcttaatgtttatttttcgtgtgaaattgcttcatgcatcggctcaattcaaaccgatccatcgagctagctgtttttttttttgcgttcctgaggcctcaaaggtgccggtttgaaccggcaccgatgactttcagtcatcggtgccacctccgtggtgccggtttgcctaacgttggttcccaattaccggcactgattagcttctctgtagtagtgattcagtagattcttggaacatatgctggtaatcaacagtatcaggtgttgacatttgcaaaaaaaaaaattcttataatattttcatcattttttttgacggaaaacagcaggagaggataataatttcatcatcgacagcatagttcgaactgacgacgacaaaattaaatgccaacctcggcatgctcatgcatctccttgccagtatgactgaactgcagacactccttgcacactggcgctgaatttgttgcagggaattagctgacagtactatgtacatccacccgtagccttcatggtagaagccagatctagaagctgaagtcaatgacataaatgagaatttggcaccaaattttcctgataattttaacatactggtagttaatttctcgcacatttactactacataaatcattttaccatgtggccgaaagtgatatttgcatgtgggcccacctgcgttaaaagatctatgaaaattggatttgtgcatgtggctagcgcatccgcatgtgcatgcagtaatttataccgtcctcgtgcaaaataatttcggtgaaaaacaaaaaccaaatcggccgaaccgtaccctgccactggccgaaccctagcccaccctccgccgctggtcatcgtagtagtggcgccgctgccacccaccatcgtcatcgggcctctgaggcccccccgcccccgctctctcccgatgtttccgcctcagccgccggagtgggaaggggagaggaacaaaggagagggagtagaagaggaagagaagagaagagaaggagttggagtggataagaagagagagaggaaaggtttggtggagaggtgtaggagagaaaaggtgcagtaactattgtgtgaggcccatttgctctccgctttgcccacataatatggtctcttaagaggcctgtctaggaaaataagtctatttttacatgctggcctcttaagaggccacgtgcaaaaatacattatcacatataacccataaacctttttctgaaaaatgatttttgtaggcacgaccagttacagtccgcctgcaacctacagggatactcataaaaaaaatgtttctatagtagagattcgtgtctagtaggtcatattcgaatctaccatgcacatgctacctggttcaatggttggttggtgcattctattgatgagctagctgaagatttagttagacgtagttgcaattttgcatagtacagtgatttgaataactctgcacagaaagagatcctactgtccttttttatggataaaatacgacacaagcaagcccaactgtgctacagcctacaagcggaagcggaagggaagagatgatcgaactcctagaatagattatctcttgagaggtaatttttttttaaaaaaaacacagtgcaaacgaagtcgccacatgtctaggatttgaactcgggtgggctggttccaccacaaggaacctaaccagttgagctattctcacttcgcctcttaagaggtagttggtggtgcaccttaacacaactcataaataaaagctcgtaggaaattatataggctgataagacggggaacaatacttcatatgcatatatatatatatatatatatatatatatatagccagatcggttatgcagatcaggaaactccggaaatgcgacaggacacattgcacgtaggcataggaggcatcaggagttgtccttctttcgatccttcatcgccaaggccttagcgatggaattgtcgaaactgcggtatgcagaggagcactcgacgccggtcagacggtccttgacagtttccttctcgttgctaaacttacagtaagcttggctgcttgctgagaatatgctgatgactccatgggacgagaatgtgccatccgtgttcatcgccgtcacgtttaaccaactgctgtcgcttctccgggcactgcctcagcaaggaatagttcagggaggcctgcacactcagcaatccagtttgacctcagtatcttcttcttaagaatgatcctgtgcatggattagtttatcgtttgtatatacatacacagttcctggatggttctgaccgtattctatttcattggaaatcaagaaaactctcaattttgtgctgcttcgtagattagctagctcctaattaaggcttgaacattcaactgatgagatgaacagtttcctattgaagtggtgaattcgactattgtggtaaatttctggtagatgaggtgcatgtgttaactgaaccgcaccctttatgtcttacaactattgcaggagtcatacatgatacacagtgcactactgtttagtgctgaaattttcagttatatcagataattaattaatattgtcccatcttcctaaaggtcgacatgatttggtgtgaattaacggctctggatcaagttaccagatattcatcaacttttccttgtttctcaaccaaacttttcaatcgaattgaacattatatgatcaagcgctgagatatatccagtcccccatcgatgataattggcccatatatacaggtggtaggtgctgcattgaactgcaatgacagagttgagtaatatttcaatcgactgaaatgctgtgatcgagcaaaaaactcttacaggctgacagaaatgcaccgcatttcaagaacagagggcatgcagaccaggccattgccactcactgtgcagctcgggttgctttgcgatgcatatgcttttgtttggcctaggaggcatcaggagtagtcttttcactggtgtgccatcagagtggaaatgggcgtatatgtgcagcggatcgctcaccgcagatgggatgttgttgttgcattaccatgagtaagctgaaatcgttgccatgcagtggccggcgacaacggtggcaggcatatcaatggagtaactatgtgacaggcacaaattaactgtcctccttctgtataatgtcttgtgtgtatgcaaatcgtgtagtttgttagtctttaactcctctgagcagttgttcagattcaaggtgatatatgtttgtttaggacctgcgcttactgatcgagccagcacaattgaggaacaatagtaacattcggaagatgctagaaattgaggaacttcgttatattcaaatgatgctaaaaagtgggggtagattaatattttcttgtgatatactgatatttaatctttcagatttgaccacctaaactgatctcaattctgatggcgtgatggtttcaaatatttcccaaatgatgaactggacaaaaagtggtagccctgtggtcctgatgtgtgcagtcaaactgaactgcaggttttgcataaattgcaggcaatcaaatactgcagccatgttgagattatgacaatagctccagtgctacaaaggctaaaggggaaaactctttttcccttgccaaaaggagagatgaacaggccagttacttcattcaatggaaccgatcagtattgtagtgatgagacaggtgcagaggtgcatattggattcagcggcacaacttgaattactgcatcgatacagattttgcatctatatggattaattttatagtccacgagaagataccgggtgataccacatattatattatagtgtaaaatttgatcacctcagacaccaataggtgttaaaatttacattaaaaatttggtacttctcggtaccttaccaggacaatgaaaagtctcattcatatatattttcatccatgctgcccgttttgttccatatatagaatgatagagatgatcagtcagctcccaacttctatactacaagcctacagagagaatgaagtgttttgttgaagatcggtcttgtgaccctgcctcaagtgggttgctataataggcctgggaagaatcagaatgtccggaatttcccgtgttacgtagttcctccacttggctagtaagatagaaccaaggactaatttattttttctgtgtactcgagaatttcactttgcatggcggcatccatctactgacagtaacagccagtcaagttgtataggccataagttcttccggtgctgttgaactggttgtatgtgatgcttcccaggcgcctagtttggcatgctgaaaataaagacggtagtttggcatgattttacgttttgatattttcagaatatatagatatagtatagtttgatcttatctgtttatgacaatctaggcatgctcagacaactcttgtgtgatatatacccttcaaaaatccaggattttcttagcgggcacaaaccggtaatggatggctattgatgaatcttaaacatactgcacagacaacgccagttaattagccatcaacactccttcgtcttaattttaactgagcttaaaattatatgagtaattaactactgagatatctcaccccatctgatcaccggcccttatatacaggtggtaggtgttgcattccactcatcttctgcaatgacacggttgaataatttacatcgaatgaaaagttgtacaaatcaaagaccagatgaaggtgcaagacagcacatgtcatacaaaaatattttcttccagactgatcgggctacgctagggtgtaggcgtgcagcggggtgctttgacgcatggatgcttggtttaggaggcatcaggagttgacattacacatatagatccacacgctgtcaccatgacagtcgacatagtagatatgcggtgaagatatcgtcgccgccgcttggtgggggctaataattcagcttgccttaagcactcaaggatggtgtgcatgtcctcattgttgtcacgggattggtgaaactgagtcaaggctactaggtcggatgaatcttggtgtcctcaaccctcctgctgtgggcctgtggcaaccgaaaccaattggtggtggtgtgtcaggctagtggcgaattgtgctttccttacatcttttaattactgagctagaagagttgaaaacttcataacatttagaagatactaaaaattgaggaacttcattatatgaccatcatgaagataaaaatataagaacctcactgaaattcagaatttcaggtgatgctataaattgagtcaggagttaatattttggatggacattttttatggtatttcctttttcagattaaaccacctaaactgatggagtgatggtctcaagtaagtctgacatgatgaattggacaaaactggtagcctgctgtgtatatgtcaaactgaaatgttcntaaggtgttcttcttcaagcagttgatgttggaattaatgaatgggccttagcccactcgatattaattctttgaaaatcacaaaagcccacctcatgcgatggcatgcatgtggagtttagtaccaccttgcttattctagaagagggggacctccttaaaagggaggatgccttcctagccacttgaagcatgtgtggtggagagaagaggggaaacacacgcgccctgttcgttcgcgacggctcgccttcttcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttatgggatgcactgaatactaaattcggtgctactgatgctagcaatgatctgtatatcatggagcagtttcatgactacaaaatggctgacaaccattctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggagaaatacaaagctcagcagaccaccaacttcaagaagcagaagaagaacaacaacaatcctaatcaggatgagaggacttgctttgtgtgtggccaagttggtcatctggctaggaagtgtccacaccgcaaggggatgaaggcacctgcagggcagacttctaagtctgctaatgtgaccattggcaacactggagatggaagcgggtatggtaatttacctactgttttttcagttaatcaatctactaattggtaggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacatgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtatgtgaaccatatttgtggcagtgtggatgatgaggctaatgtttggcattcacgtttatgtcatattaattttggcttgatgtctcggctttccagcatgtgtttaattcctaagtttttcattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtcccggacatgcatgttggtacaattatggagtctcgtgatgctaccttccttgagagctttttcccaatgaaaaatacccatagtggttcg

SEQ ID NO: 61405 - DNA, 38089 bp, Oryza sativa
agtcggcgacggcttgatgctggccactccgtgcccctcgtcgccagatccggcataagggtcgccggatctggccttaggcggcagcgggacgacggcaaggacggtggcagtcgatgacggcggggcggcgacggtcgacgatgatggcggggacggcgacaagaggaccgttgcttcgcgttttaggacatggtctctccaacgcggtgccgcccctctcctcgcgtgtcacggggcttcctcctggcaagttctgacgaggctcggttggccaaatgatgctctgcgtacttcgcagggactcgctccacgtcgagttggctcggaatctccgcgctggcgaggtgaggccgaacaccacctcaccgcattgtgaatggccttggagagaccgtagtttttggtgcacctttgatgtagcaatagcttagcttgttgattttgaaagcttttgtctcagtggatgcatgacacccaatttcagagaaaatagttaaaactagctcattctgtcaattctacgtgcaatacactatgaagttcaaatagaacgaactgaagtatgcgtctattttgtttttaactatatttggtttctcttaaagttcaagaaaattcagatcaaaaggagagaaacaagtaggttttgctagcaaactctgaactgaagcagtttagtgcttgcttaaatagctaaaatcatgcatgacgcatagttaaatctggaccatatctttttgctgatggttggatgtttcgatactgccaaaattacagtcactgcacctgatccgaatcctcgagaatgttaattgatttttctagacgagtttgcagatagaccataactattcccgtgcatagtttaaggaccgcatacgaagacgagcctcttaacaagtctgcactattttctcatgcggacctcctaagagacccacatgcgaaaatacccctctcttcactcttttttctctcctttcctctccctctcccgttcactccccacactccctctccctccccactcctcaccctccctctccaactctcccactcctctccacactctctcccatccacactccctcacgacgacgatgctcttgggctaaggcggcagcagtaggcttgggcaacggcaggcgagggcgagagggatcccagcgacggcgacgacggaaggggtggatccagtcaccgctcccccccccccacgcatgtggatccaccggcggtggagatgggattggcggatccgatggtggcagcaacgggaggacaatgacaacggtgctgccaccggcagtgatgacgagaggatgaagatgatgacgacggtgacgagaggattcttgggttagggttagggtttcagagtaggttttcaatttttggaattttctattgcattttttcttttcgctccggaggagttaagtgtccgcatgtgaacaaaaatcgatttttgcatgcgggtgacatgtgatttctctatcgcatgcaaaatatgtttttcgtagacaactggatgcaggcgggtcaccggaaaaaatcgaatatatagtagtgactttccccatataatcatttatttcagcagcaagcagtttttgttgctgtcatgactcatgaaccttttttttttgccaaacactactatagaaaccttaattggtgcggttaggaaccccacaaaggtggcagatttgccaaccgacatatagcaggcggcactaatgtggaggggaaatagatgcttgtttaggaaccgacacatttgaggttctacgaataaaataaaacactagctcgccatcacccctgaaatcatccccaccacccagagtccacaaagaagaccaagttcatccacaaaaatccagtagaaacaaaatagcattaacatttgcatgctcatccgcaagttaacacatcgtatacaaccaatatcgacattcagacacaatcagcattggcacatgcacaagaaaattcccaatgcccaaactcaccgcaaactgggaacttcgctgttgcccgcaccatccgccgtcggaggccatggtgggcagatctggccacacccgagcttgggcaactgcatctgacagccgccgctcgtgagggagagggcactgctgccgtcggcgctcggggtggggaggagagggaggaaagggtcgcgagagagagagagagataagagagtcgcgcaagactgagaggaggaagagagtcgtgcaagagagagggagtggcatgtgctgcttaccctatccacaagtgcgacgttgtcgtgagtgttaaggacaacgcggtcggctcgtctctgatttttatacaggtgtcggttttttaattaaacgagattttagatgttccgtcacatgtagtgcccgctctctatgtatcttctgcagtggtgtcaatcaaatcaccaatttgaacggcacactagtaccagaacacattttaaccatggaaaaccacaaagagaaaatcattctgacgggcaagcatattagagagacaacaaccgatgatggtaaaacaatacgcagatagagtcattcagttctttatattaaggaacataaacgctacttaaacatactcccatccagactgcagtcaacagatacgcataacgacatactattacatacctaactagtaatacctatgctacgcaacatttcacaccccaaaggcttaaatataactcaaacggcagggttttttcttgccaaaggaagtagtaaatttagtcaggcggttaatcccacattacgtatatgacaatcaagatatattagcaaaatatatgaatgtgatatcaatatgtaacatctttttcatgttgggcttagcatagtttgttataaccaggggattaaatcaaaagaggaaaagaattagaacttgtaaaagccaaatgcactggtagaggaacaaaacttagtgattctgcgtagtaaaataaaaataataatgaagccatggttcttatcaacataatcacaattaaataatatttaaatataccatgtataatatattcaaagcttgctaaccaagaatatctaagacctcgacttctccttgaatagaacttgacaacctcgaatcggacaccacgaatatctcccacagcatggcccttatgcccaaatccagaaatcaacacctcatcccagataatgagcatgaagaaataagtataggtgacagagcaagcattttctaataaagtaacaggattaagaatgtacattttcaattcctcaatgatgttcaggaaactgtgctagcatgcatggccagaagtcatcaaaattcaggattaaaatagtaactggtctcaataattagaaatggactcgtttatcatggaatcagttgggcgtactgaattacaattatgatggtaacatgcttagctaccctgggcaacttgctaggtgaatcactacctgataaccatatgtcttctgaatggtagcaatcttttgaacaaagccaaatatattaaacaaattctgtaggtgcgagaacagcataaattatctactactgtaaataatctatattacgtacagtgtaatcatctattaatttgccgatgattcatgatccagttactccaccaagaaaaacgtttaatcaaacaaaaatatattggttcttatgattcatgtttcagttaatccaccaagaaaaatgccgcattgaaagaattgatgaatatagtcaggaattattctctaggtaaggagcatcaatgttgttgtcactggaaaatgcttaaactgatcgcacaggaatgggctgaaggagaaagtaccttgatttccttgaacatggcctttgtagcatatgataaactcgtcagttatccggatgaatggaataatgcaacagaatgaaaggagattgaatagcgcaagcagcaactgcgacgaacattttactttcacctgactactcgcacgaaggctgcctggaagaaatgcagggagcttcctcaattgatccaccatcaaggaaaagcactagaaaaatcattgcaggcacataaaaagtagcaccattaacttttcagcacaaaattatatagcctcgatatctcaatttttacagctcatccatagcagaaattttgtttatgctaatcttattatctaaagctggcggttatcgccgcaagctaattggttcattttaccccatttaattttacgccacgtgtccatgaagcattcggcaaaccatcgagtgtctcgtgcatgtattgctgtcttcgtgcggcagaaaacaaaaataacagcagcttctggatgtcgtctcacctcacgtccctgctatttgggatatactcctacaaaagaattcgtataacatattacctacattataattagtaatttggctctatattttatatatggagtgcatatatagtattaagctatctatctaaaatactgtgtctagcatatatgtctaccaattaatagacgtacgtatcctctctcctctcactcacctccacatcaaaaaatatactatgtggcattctctcctacacggtgatcctaccattattcatgcccttagtgctaagtgtgattggttaaaactggaaacatgtaacttaaccatgttaatatcctatattatagaaaagattaaacaatattttaacaaaaggtaaaacaatcgatagcaagaaataaaaaatattttattttaattttgctaattctaacagcttatatacaaaattttaaaattacaaacgtgagactaaattcaccgttttgtttgcgtatactgtcacgctataattctccgtaggaattatacaaacataaaaccaagtacatattgaatgatattttttcaatatatgatatttacatagattttattagtattaaagtaattactctaaaaggtatacatgtgccctaggggaaaaaatcacaggataaattatccagcgcgctaataggcgcgccgattttctagtataatgaaaaatatggacatgctttgttgttcaaagggcataaaagatttttactgccaaactatgaaaaggtttctattatgaactttatttaaatttgaagcatctaaactctatatatgtatacaggcagaaaaatgcactcaaattattcttgatcagaaagcatcacgtgagcaatagctctgctaaatatgccatcttactcgtaaacaactgaactgggggaggagcggcagcaccagccaagtggcgacggcaacaggtggtgacggcagggcagtgcgtagggaccttcagtaacctgtggcaaccaccacagatctcgtgcgtttgcagaggggatcgtgcatggaggaagttgatgatggcggcaggggcactgatttttactgaaaatttatgtctcttttaacaatttttgctgatcatctctcttgtgtataccagatctgctgcctagacagttagttattcatcttggtgcatctggccggatccttatattggtttaattaaaaaaactttcaggagaacatagggaacctatcagggttttttcatcatccgtgcatactgacgttgtcacgatcagagcaaacctcttgctattgtgcggtttgcatttatgagatataaacatgtatcaacacaatcaatgcagactaaattggagggtttttttgttgagaaattcctcatagaaattagttgacctaacacacttggtggcggccacttagaaccatcctaccatcaacaacaaaatgtttgacgaacagcattggcggttgtttatgcgggactcaatcgaacatatcatgtgcatgggcaaaatagtttgctcgttcatcgtagtcaaaatcaaatagtaggcaaaagaaacataatgaaccgggaggaagaagaaactgaaaccgaacagcagaagcaaacttgccgtagagctatggagaccggatgtgagggccggaggtgatagggatgtctgggtgaggcggcacgacagtgaaccgatgaagtcctggcggagagcggacggcgatgggatcgacgacaacttcatgcggtgcgacggagaccggcggggatggcactaggacgagttggcgcggtgagcagaggaggcagatggggcgaatcgggcaatgtgcggaggaatgttccgaaggaaaaggggatgcgatcgatttgcgtgtgcagaaggaaatcgacaatcaagcaatcacgtgtgtgattttccattagtgaccccgtgtgcgcgatttgagagagaggaggggagagggggactgtgggagccgatttttggtcgttggatttgatgaataaggtttctataggactgcagttgctcaaatagattaaacatatcccaagcttatggataagagattactaattttttttagagaagagtatttttctacctggcatctacatccaaccggatatgtgcaatatttttaaattaggaacttaacttgtcaaatagggaacttagtcctcatatggagattagaactcaggatcttaaggtgctacttaagtcactgcaaccacttaggctatatttcttttcacatcagagattattgataacaaacagaacctggtaatttattacgcgtccaccaattaataaaccctaattaaccaaacttaatctagaatatgtagatagggtattaataaaccctaattaaccaaacttaatctagaatacgtagatagggtagtataatgatcttctctccgcgcatgcaggcgcggttgccggcagcccgagagctcccgtccgtacgccgccggtggtcacgccctcagcggcgcggccgtgtatttgcctgcgcgacagtgacgttgcggccgccgatgtcctggccgttcatgccctggatggcggcgttcaccgactcgctgtcctcgaagttgacgaacccgaacccgcgtgacctccccatcacactgtcccaagcgatctgcaaccaaaaagccatcagataataatagatcatctactagttcactaagatttcacgattagttgtagatctgcaaatttgaaaaaacgaacagtgcatagcgatcgatcaaccaagtagtgtgtgtgtggagatcaatttgtgaagggatttgtgaacagatcgatggaatggatagccaatcaatataaaaaagatcaacgaaaacccagccaagatttacaaaaaactatatatccactgtagaggcgctaaacttgggatgaacaggcgagacaaaccgatcggaacgctcgatcgacagttcgacacacacacaaaaaaaagaaaagaaatccgtcaaacttagcgaagaacaaacgacaacacaacccacccggaacagaacggaaacggaagcaggagcggcgaggaaagggttggatacagcggagcaagagcaaacccacctcggcgctgatggcgccgtaattggcgaaggagtccttgagggagcggtcgttggcggagaacggcaggttgccgacgtacacgcggtactccagcggggagcggtccttgtagtcggagtccctccacggcgccgccatatccttcccttgccttcctctctaaaccctaattaactaaaccttcgagagagagaagctagagagcttggacttgacgaaacacgacaatgacaatcccaggtctatatagatctattctcatgggctcttgggtttccgctaccgtccggccgtccgggccgcgcatgccagatgaagaataagttcattttaggtctcctaactttacagtgactttgattttgattcttgaaacgaaataacagatacaaggatcccttaacttagcatagtactccaatgcacccgctcagagctccgtgcttcagcaaatacgttcgatgttagccgcattttattacgttgtaagacgttttgactttggtaaaactcaaactgttttaactttaacaaagtttatatacaaatatagtaataattataatattaaattagttttatcaaatcaataattaaatatatttttagaataaatttgtcttaggttgaaaatgttactacttttttctacaaatttggtcaaatttaaaacaatttgactttgaacaaagtcaaaacgtcttataacctaaaacggagggagtacctttcatagatcaacatatccagtggccatttttttttcccgagcttagaccctgcttagattggactaaaacttttaagtccctatcacatcggatgtttggacactaattataaatattaaacgtagactattaataaaacacatccataatcttggactaattcgcgagacgaatctattgagtctaattaatccatgattagcctatgtgatgctacaataaacattctctaattatggattaattaagcttaaaaaatttgtcttgcgaattagctttcatttatgtaattagttttgtaagtagtctatatttaatactctaaattagtgtctaaatacaaggactaaagttaagtccctgatccaaacaccacctaagacttacataaaccggcaatgagatcgagggcctatttgagggagcttctagcagctgcagcttctcttagaatctccagttgccagaagctctccaaacagtccagctttttacctagattttgagaatatgtagttatagaatctggaaaatgaactagaagccataagctgggtttcccagcttctccagattctcaacatctcagaatcttaagctccccaaacatgccccaaattaattttaggcttctaccattttttttcttgattttagttctagacttttactgctaacgataaaaaaaagagaagacaatgtaatacagtagttgttttgcttctcaaacttgccataaccccctcccccccccccaaaggtagataatgaaggtttagagggaaaaaaaaacttactacaaatgttttcgtaccgtttagactgctaataattggaacaaaccctcaacgttcatgcgtgcaacctcctcacttttaaggtcttgtttagttagagaaaataaaatttttggatgtcatatcagaagtttgaccggatgttagtaagggttttcggacacgaatgaaaaatttaatttcataactcgcttagaaaccacgagacaaatttattaagcctaattaatctgtcactagcatatatgggttattataacatttatggctaatcatatactaattaggcttgagatttatctcacgatttctatataaactctgcaattagtttttctttttatcttcttatttgccatcgataacacatacagtcggcatgagggtcacatgcaggccacagacgggcagacgaacagagattcgattctgcaggaggaagccaacctcctgggccttctggcaaaaagacgacgccgagctcggtgtgttggcacatctgcgtttgtaattgaaaacgtacatatgtcctccaatccttatccaacctgacacacagtaactatggagcggtctcaacatctaggggtgggcaaaataagaccgaacgaaaaaaccgaaccgaaaagaccgagaccgaaaccgaaaagaccgagaccgagaaatttgggtagtaattcggtctcagcatgtcaaagaccgaaagttgttcgggtaattcggttattgggatcggttaaccgaattaaccgagaaaaccgaattgtggcctaataggtccaggaggcccaataggcccaatacaccactaaaccctaaagacaacccgtaggctgcatccccatccatccagccatcgcgccaccctcccttccatccccatccccatcgcgccgccctcccttccatcccgcgtgagcacgcctcctccgcctccatcgcgtcgcgctgccgtcgccgcctccattgcaccgcgtcgcgccgcgccgccgcctccacatcgtcggcgccgtctgcgccctccgcctccacgccgcctcgccggtcgcgccgggccaccggattcatcacgccgcaccaccacctccgcccttcgccctccacatcgtcggcgccatgtcagccttcacgctgtctcgccggtcgcgcgggccgccggcagccagatccatcgcgccgcgccgcgccgccacctccgccctccgcctccacatcaccggcgacgtctccgccctccgcctccacgccagtcgcgtgggccgccggccgccggatccatcgggccgcaccgccacctccgccctccgcctccacatcgccggtgtcgtctccacccttcgcctccacgccgcctcgccggtcacgcgggccgccggatccatcagaccatcacgctatgccaccgcctccgccctccgcctcgacatcgccagcgtcgtctccgccctccggctcggctcctccaaattcagtctgaccgagaccgaaaaaaccgagaccgaatttatcggtcttgatttttttggatgaaattcggtcctgacttttcaaaaaccgaattgaccgaaaaaccgaagaccgagatcgaaattttcgggtagaccaaacgcccacccctatcaacatcaacaggttatggacttatggtatccagctgtacattgtacatatctcaggttgtatacgttcctgaataaaatttatttttaagtaatcattattttggagtttataaaagcaagaagaaacaattatatccgtactaaaaatgagatataattgtattgatttttgtattggtatgtacatacggagtagtatgtaattagtgaaaaacaaacttattttatttcggaaccgagggagtaaagctgccatcgtgagttcgacagcgaatcttccatatcgtcatgacgttcttcttttgcatgccaagccaatcagctcaccaatttgacgggcacactagtagtgccagtacacattttgaccatgggtccatggcatcgcaaaccgcaaagcaacaaccactctgacgtggcagcagatagagtcattcttaacataaacgctagccatcaaacttacacacactcaggtacgtgctgcagagtgcagactgcaattgatgattacaagcataaacacacacctaattaaacaacatatcctaataaggccctaagcttgcatatccaggagattaccaacagagactgattaattaattaagcatccaccgcttaaaccctaattaaccaaactaccaacacgacgaatgactaaaactagctagtagatctgcagcatagatagcttagggtaggtaggtaggtagagtcttctccgctcattcaggtcgacctcctcgccgccggccggccgtccgccggcggcgcggtcacgccctccagcggcgggggcgcatctgggcccgcgcgacggtgaccttgcggccgccgatgtcctggccgttcatgccgtggatggcggcgttcaccgactcgttgtcctcgaagttgacgaacccgaacccgcgtggcctccccatctcactgtcccaagcgatctgcaacccaaaacaattaacacaccaaatcaccagatcaattcataaagatttcacaattagttgcagatttacaaggacggacggccaaaacgttaaaacgtgcatatataatacagtgatgaaccaaaacagatggatagcaaatacacccatcaatataaaagaaatcaatggaaacccaacccccatccaaaatctctacaaagccgacggggaaacaacagcagcacaggtccatcagaaaagcttccaacttaattagcgaagcacaaacgacacaacccaattaaccggaagagaacggaaagggaagcaggagcaagagcaaggcacctcggcactgatggcgccgtagtcggcgaagtagtccatgagggtttgctcgtcgacggagtagggcaggttgccgacgtacacgcggtactccagcgaggagcggtccttgtactccgagtcccaccacggcgccgccatagcccttcccttcctttccctctctaaaccctagtaatcaacacctctctaaaccctagtaataacacctaattcttctttggatgccaaacgagagctgaggacttgacgaggtcacgaggaagacgaccggagtgcctgaccaaccgcatatatatgtataggtcctccctgggtttcggctgcgggccgggccgggccgggacgggtgccggacgaatgggttggtcaaaaggcgctttccgcgaaatgggccggtaaaagatcgggaaatgggaaccaagcttcagcaccgatcatgggaggaaaaactttttgtggctgtgtgcctgtgttttttagttggtggtgggagctatgcacacttaaaacggattatctcattaacgggttatctcattaatatcaatatgaatgaggaaaatgtcagaataacttatatagttatgttttaaaaaataaattaatatgatttctgaaagcaatttttttgtatttttttttaaaatgcaatgtttattagtttgcaaacttgtgtgcgaaaaagagaaaaaaaaaagagtctgagaaagtagagggaggaatacaacctatgactctctttctataaaaccgagtatatcgcttcctcgagtattaaaaccggtgtattttcagcggctttaaggagccctactttggcttcgatcacacattgtacaccaactttggtgtggagtgagccactcgtacgtgccaccgatcacgcatagaaatatactgtagcgtgcagacccacatgcaagggcacagactaacccacacatttctgcagaaacccaccatgccttctggcaaagaccacgcgagctcagcttgccgttttggcacatctgcaccgtacgtgaaaaagtaacaacgtgtccaccattcttagggtctgtttggtttacagagacttatttcaagtctctgtcatatcggatgtttagacactaatttagagtattaaacatacactaattacaaaactcattccataatcttagactaattcgcgagacgaatcttttgagtctaattacgccatgattttgacaatgtgatgctacagtaaacttttaataattatgaattaattaggcttaaaaaattcatctcgcggattagctctcatttataaaattagtttttttactagtctatgtttaatactccaaattagagtccaaacatccgatgtgacatgggctaaaaagttttagccccatctaaacacccctttatcctccaacctccaacactttgtactggagcgctcaactactactactcgactcgtgagcgaatctccttcgtacggaacacatcatacggaacacatctctcgtgctccgcttttggcaccacaccttcttcatattgaaagggtctttaattatgttaaaatataagtaaaaatcatcgaataaataaagccatgaagtcgaacttatagttttctaaattcactaaaaaaaattactcgagattggtataaatatgaaatcttaagtctaaacttaatttcgtttgggaggaaagaaagaaagaaaaagacaaatttcactagaatagagaatgtatttcatgcttataactatctctagtaaatttttttatgaatttataaaactttgaaattcggtttctacagattttcacttattggagcgttttcatcgcacgcgggagaagacagcacagcggtgtgctttctatgctgaggaggagtaggcgaaggcctggccagtgccgcactcttaagcaagcagagggagaagggagagagagtgtgtgtgggtgattgaggaaaacatgggagagagagagagagtgtgtagatgtgactatgtgaagggaaaaaagttgggtgagaatgggtctgactgatttttttttataaaaaactactaactgaattgtcatgtaggactaaaactactttgaattgagtcgggaagttatttgtcctatttaaatattcgagtttataggatacttcagtctaatgtggactttttccttttatgtgctttgtgcttcttaattactccctctgtttcatactatgagtcattttgattttttttcttagtcaaacatttctaagtttgactaagtttatatgaaaatatagtaacatctatcacaccaaattagtttcattaaatgtaacactgaatatattttggtacgtttgttttgcgttgagaatgttgcgttgaaaaaagtcagaacgacttataatatgaatatttaattacacataaactatttgtgttaagtgagttctttattagttagtgtttattattatgtttatatatgataaaatggtacaactgaaattataaattacgaaagtagtataaatatgtcaacgaacctaacgaacttaacaaatcacctcgagagtctagccgagctaggcctagctcgttagagttaacaagccgagttgtgttgttaagattacgagccgaggtcattatccacctataatttcatgattaacttcagtacttaaatatttcatcatattaaatcatcgtattaaatgaatttttattaagctattttagatggataaacctaaggtggaaagatgtaattaggaaaaaaaaaggtcaaataaacaatattcaggatgtgacatcttccccccttcctaaccctcatcccctaccttaatttggcgcaaaaaaaacctaacttgtcaggcttcccactcctacgacctaatccttaccttattgggttactggtgatcgtccgagctgaaggagtgcctcacgaattgtggttcaatccaatggtagaggattcgacggaaatccaccacaaatttacgtgtctcgtttaggtaggtaggaaatgttactcccttgtcctaaatataacaacttcttactttcaaaatttattaaaaatattacttcttcccctacatcttcttcttaaccaataagaaacttacaccattaaaaatttctacacactccatcgttttacttatcggtaggacaagcgaaacgtcatatttgcaaaccaaaaataattataaataaaacttttatatacgtgttgttagcgatcagctatacttatctactcttctcaacaaatcataccatttttccatttaatttcaccaactttttagtacatggcaatttaaatggtactaaattcaaaaactaaatttagtacatttgccgcttgcaacgctaggtactgtagagctgcgataatttcactagatacaaaagcttagatttaggggcgtaaagttttagcgtgtcacatcgggtataatatagggtgtcatggagggttcgagcactaataaaaaaactaattacagaatccgtgagtaaaccacgagacgaatttattaagcctaattaatctattattagcaaatgtttactgtagcaccacattgtcaaatcttggagcaattaggcttaaaatattcatttcgtaaattagtcacaacatgtacaattagttatttttaaacctatatttaatatttttatgtgttcaaacgttcaatgtgatagaataaaaaattttaaaatgagatctaaataaggccttgtttagtaacaagaaacacacccctgctcgtggcggacaggcgcgcggtggagtgggtggactcagccatcgatcgccacaaagcaggggggaccacatgcaaggcagagagacggggcaggtcaggtcgtcagagtcgattcttcatttgcagccttgcagcaagccaccaccatgttctgggccgtctggcaaagaccacgcgacctccctgttttggcacgtctgcattttgtacgtgagaaagtaacgctatactaccatatttctcgtgagcgaatccttatgcctacttggttctcaaaaacattatattgaatctttgcgcacatatatagagtattaaaatagataaaaagaaaaactaattacatagtttgcatgtaaatcgtgagataatcttttaagtatcctaattaggccataattagctacaagtgctacagtaaattacatgtgctaataacatattaattaggatcaaaagattagtatcgcgatttccaggcaagttacgaaacttcttccaacatcaagtcaaacgtcccatgtaacacccaaaattttcaccaccaaccaattacatggcacatcgtaaccaccgaagaaaaagcaccaagcaaaaaatcactcgcaccgtcgtacgtgccagccagtagaaacagagagagatcaatagttgatgagacagatagcaaacacgtctttaatttaaagatcatgcatatggtgctgccgactgccgtcgacgacaaaaggattcatatccaggaggttaccaacagagcctgacaattaaccatcccatccatctcttaaaccctagtacattgaccaaactaccaacgagagattaccaacagagcctgataattaaccacccatatctcttattaaacccaaactacgaaggagattaccaacagagcctcattggcatcaatctcttaaaccctactacattaattaaccaaactacgaacacgaacgcgactctgaaactgaaactgatagtagcacaactagtagcagtatctagataggtaggcttgagcgcgtagtcttcacgccggcggctggtccgccggcgccgtgcgctcagcggcgggagcgcggctgggcctcctggacgatgacgttgcggccgccgatgtcctggccgttcatgcccttgatggcgtcgctcgccgacttgctgtcctggaagctcacgaacccgaacccgcgggacctccccgtctcacggtccacagcgatctgcaacccaaaaccagcaacagcaagtcaccaaaccaatctatctatgtattggagtacgtactagctatagttcatgaagattaaagagatatttactgatctgcatatgaaaacgcacaaagatgaaccaagaaatgtgtgtataaattggcccggcgaattgggcaaatattagatgagatcccaagaaagtggcgaatcttccgaactaagaaaagaaaaagacgatgttgggaatatggaaatgggggcacttcagaacagatgtgacggataacgtgtatcaaatcggccaatcaaagctcgggaaagacgaacaaaaatcaacaaaaacgacgcgaaatggcactgatcatagatccatcacagaaaatcgtcaaacctgcagatgaacagaaaagacagaccgaccggaacgggcggaataatggagcaagcgcagacaaatccacacataccgaaaaaaaaaacgtcaagcttagcgacgaacaaccgagacgacccaaccggaacggaagcaggaggagcgaagaagaagggaaggggctatatatatactgacctcggagctgacggcgccgtagttggagaaggagtccttgagggagcgctcgtcggcgcggtacggcaggttgccgacgtacacgcggctctcctgcccttcgagtcggagccggtgcggccattgtagtcgttgtcccaccacggcgcagacatatccttccctttcccttaattccctctcgaaaccccaactcttccctttttcttcggatgcgaaacgagcgagagaggaagtggagagagatgatcttggacgaaaatggagagatgatcccgggtataaataggctgggaatgggatacatatccaacctgatctgatcaccacgtacggcgcaggtagattagagaggtagggccgaatcgatcggcttcttgttttgtgagatatggccgatcagttttggtagcattatcgagttcttgggctgggtcatatgggatgtttgctttgggccgtgaagaatatgtgaggcaaaggattaagttcactttgaatccctcattttgtcgccaagtccaaaattcatctatggactgcaaaaccggatccctcaacttacaaaattagtaacaaggtctcccgttttagctgttttcaacttacaaaattagtaacaaggtctcctgttttagctgacgtggctcttttgactatgttttcgtcccatgtagtattggcgtggcgtttacgtggcaattccatccgggaaaatctgtgggacccaaatgtaagttacacacaaaataataataaatgagatattagggggggtgagaataggggtggataggctcggctcggtctagctcgttaggataacgagctggctcggctcggctcgtttgaaagctcgagccagctcgttagactcgtgagccaatccaacaagacagcaagctccggaggaggggacatgtgagtgcgccttctccggcgatggcggtggcggcggctggcagcgacggcggcggcggccctagcgccggctggggaagtgcggctggcggcggcggcggcggccctagcgcctactggggaagtgcggctggcagcggcggcggctagggaggtgtgacggcaacggcggctctagcggcttgcagcggcggcggcggcccaagcgcctggcgaccacgtcggcgcggtctcgtacggcggagcgattccgatgtggatgtgcggtctcgactctcgtctcgtactctcgtgtggtgcggctgccgccaggactaggagtgaccaagccaggactagggttttgcttttgctgttgtattgggcttgggcctttgctattgtattgggctgggcctttacggttgtctgattaagtcctggctcgttaaggctcgcgagccagctcgagctggctcgttatccctaacgagctaaaatgccagctcggctcgttagcaaaatcaaacgagccgagccgagtcgagcctgtcacaagtcgagcgagctaatccacccctaggtgagaatctacatggaatggaaaaggccaaccaatgccacgcatagctatcatctttttcaatggaggaataatatttggtccactaggaagtgatagaaaaagccaaaacccccacaagaacgtgaataaatgacacaagcttagtctgtccagttcacaccaaaggaatctatgcaaagatcaataatttcttcttattttaaatgaatatactatccgctttaaaatataagtatttctacaacataaactttatagtacatatcaaattacaagcatttctaaacactcattttagtgcgtgtaaatccaagcattttcaatcaattggaagtttccaaatggaacctaagggttcattccgaacgctacattttcggaacatagggataggaaaatgttgtactcgagtgccttggcacctttaaattctattgaaaaaaaacacagaaaatacaagaataaccattttaatggagacaaagaaaactgtagaaatcagaaaagagcgatagtcatattaaaaatcatccaaaattcatatgatttgaggcaatcttctaaatttgaaaggaatttgggagatttacttccttgtttaaaggacaatatgaattctttccacacgaatccaattctttaaaattcctttgttttcttgactaggggtgacaatgggacaggctggggtcgggttggataggaatgtcgccctcgctccatgcattctcctctgcccccagcgccgcagagctaactgggtggaaaatgtcacccatcatgtcctcgcagttcaccccggtgcttgagggtgaattagcgaaattggctgctacgacggcttggggccagcaacgactagtcgattactgaaggcgcaaatgataggtcgacggttggaaagggcttcgatgatggctaggggcggtgataatgggtcaatggttggggatgaccgggtggggatttgacgatgaagacagcatttgtcacccccagaaattctcgaaccagaatttctaagctgaatgtgcattaaatccctgtccaggaccagccagggtacacaaacgacaattgttgacatacagacccacgtcttacaaaaatataaaagattacaaatgcagcgggaaagataaaagcgagctaaaccgggaagcttgacttcagcagcgggcgactccactccacaggcaaaccttgacggcagcgacgaaaccaacctctctgagacggctccaactgagaagaacttcaactctggtgtgggggaaaagagagcaagactgagtactacccactgtactcagcaagtcataccggaagagaaggtatgatgcaggatataaccaaaggaagctaggggttcttttgcataaagcaggcatttcaaagtagtagttgaaagcagtaaaacagctgtagtaattaatcaatattaaccaatcactgtccaacgctacaccacgttgcaacaggcccaaccaaccacctgtactacaccagttcaataagctaaactaggggtgagactaatcacggtgaatctggttgatcgcccataaccgcgggcacggctattcgaatagttttactctggccagagatgtacaactgtacccacaagacacgattccacacatgtcgccatgccccgaagtatcaccatgatactgcaaagggggaaatcgtgacaagaccttccacataaccctcccctaaccatccacaccacgctaaggtttcacccccacccctcaaaaggcagtgggcggtcccctcttgcgtcgcggtgaatccggcagctggacaaccgaacacctcggccgacccaactccatcacgcccaccctcgccaccggtgcctaggtaagggtcgagctgtacttcagatcaagcagttacccactcccgcttgtggtaagcacggtaagtctcccagggtttcccatgaaccggtccttaactgccatgggtgcaaccagcaaaaccatgcactcacagcccgccattcagaatattttaattaactgacacccttgcggtggcaccaatctaaagctatgccaatagtcagagtctatgtaataatgtgatccccatttgtgtcctagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatattggtaaattgggtacaatatgatcaaacgtattgcatgacttgccttgctctcgaactgatgagacctcaacaacgtcttcgagaaactgcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactatgtttttactaataaagaaaaagtccttaattaattattgcgcaataatacccagggctgacgtcatccgagggggggcggcgccgacaggcggggcccacgggtcagcggctcaaaggggagaggaagggggcgccggcatgtgggccccacgggcagtggctcaaggtggccggtctaccgtggaccgggaccacgcgggtggtccaccgccggtccacgggaccgacggtccggatcggccgggaggccgatcggacggcacggcggcggctaggcacggctcggctcagcttcaaaaccggccggccggccatggcaaccggcggcgacgcgcacggtcgccggcgacggcaatcggcggcgcgggaagcgacggcggacggggtacaggacggcggcgtcgaccgtaggcgacggcgagcgtgtggagagaggcggcgcaaacgagagagaggggaagagggaggaggggggatcctcaccggcgagtatggcggccggagcggaggatgaaggtggcggcgacgacctggcgacgaggaggggcggacgggcggcggcggcacctatggagggagttgagaaggattaggagtagagagagtgaccacggcggccaccattgttggccggagacgaaggagaatggatagctcaccggtgtgcgaggagaaccggctccggtggggtttagcggaaaccgagcggcggccgaggtggctcacgcggcggcaatgctaatggcggcggcggcttggcgcggcggcggctctagcggctgcggcgcgcgaccggaggtggcggcaagcggcggcgctagtggcgagcggcgcggcggcggtaggaggcacggaagagcgcggcgaaaaggggaaaagggagagggagatgcggggaagctttataggggctcgagaggggcggacatggccgggaaaccccccgatttggccggcgacgtgggggggagagagagagagtgggggggattcaaatcgaatcccgcccatttgcgggcgcgcgtgcaggcgggaatggcggggagggcggcgacgtggggacgcggagtgggggcgcggcgtggagcggagaaggcggcggcgcggacggtttcggcggcggttgccgtcgtggggcgggcgactagaggaaggggacgacctgacaggtgggccccacctgtcagcgttccggagagaagggataggggaacgggccggcccaaaggaaggaggccgagcgcgggagggagtgggccgacggcccaatagagaaaaaagaatgaaaagaaaaagaaaaagaagaaaggatttttcctgggatttaaaattgcactttggtgatttttaattggttaaaattatttccaaggctctgaaaattccactaaaaatcttgttaatgcattggagcatggggaactcaagaaaaattccaccacgctatttctgattattaattgcatttattaactagggatttagctctaggttaattaagataatttcttcgggcaatttatttaaccaatttttaaagcaagaaaaggggggaaacttcatggtgtgacagcattgcagacgaacgatgaggcagcgcggtgagggtcgttgacgatgagagatgaggttgtgtgtggttgattgatgagtagcgtggcggcacagcaaggagcagcgaggtggcccagagaagcagccgtcagcggtgtccttgctagcgttacatgcctaccgagagctgcggcggctgcggggttaggtgagagacctgaaccccgctaggtcacgcgtagcttagttagaatccatgctcccacctctatccccataaattaatttgcggggtcatgccccactcacccacgagtgagaattccccatggccctagccctagcttcgtaggtaggtcctagctccaatggaagaagtgatgcaaaactagaagtgcatactgcagagtaaggccgtgtttagttcatgtgccaaaatatttttgaagtatacagacacacatttgaagtattaaatgtagactaataacaaaacaaattataaattccacctgtaaactgcgagacgaatttattaagcctaattaatccgtcattagcaaatgtttactatagcatcacattgtcaaatcatgggataattaggctcaaaagatcacaattagtaactcgtaataattttggagagttttatcaatttaattaattgttgcttagtggcgtttatattttcttctgaatctgattttattagcatcgagaatgcttgttgataggttttaacgctgaaactgaaggcgaggatcttgacaatgaggttgatgatggggttgatgatgaggatggagaagttgccaatgtaattggtgcaggttcggtgaaggtaaaagaaagtttaggtcaaaggcttggcgggagtatgtgtcaatttatgaagatggagaaattacagaaggagagtgaatgcattgcactacttaattggtgccaatagcggagcaggaactagcgttttgcggaatcatttaaagagatgcaaaataaggattgagaaggttagagtggtggatcagctcattgctactcttatgtcgcctaattgagttagtatggggaagtggacttttgaccaagaagtatcacgaagagagttggtaagaatgattgtgctgcatgagctaccttttagcactgtggagtatgatggctttcaaaagtttgtctcaagcttaaatccactctttaggatgatatcaacaagtacaatgagaaatgattatatgaaaatgtttgaggaccaaaagaatgttctcaaggaagaactcaaaatgttcaaaatcaaggatgtcccttaccatggatttatggacatccaaccatactttgagatacatgtgcatcacatgtcattacattgatgctgattgaaagctgtaaaaaaagattatcaagttctctgtcttggagacgccacacactggtgtagtgattttcaatgctgttctcaaatgcattcaagagtggaacttggaaaacaaactatttgcaataacattggacaatgttagcaactatggttcgatggcaaaggtactgagagagaatttgctagctaagggagtaatagttggtcaagggaagtttttgcatcaacgttgtgcagcacatattctaaatctcatatgtcaagctggattgaagttcattaaaggcactgttactaagatacgggagagtgctaaatacgtccgtagttcgtacggtcaaaaagaggagttcaatgagattgttacatagcagggtattacttgcagcaaacatcgatgttgtgatcagatggaattcgacatatctaatacttgacgtaacacagcaatacataacaacatttgatgctctagctttggaagatctgttgtacaaatttaggcctacacctcaagaatgggaaaaagtagatctagtttgtagattattgaaggtgttctatgatgctactaacgtgatatcagccacaaagtaccctacctcaaatctatacttccataaaatttggcaagtcatgcagaccttggaaaatgaattatcagaagaaaaaaaatgaaggatatgcttactgacatgaaggacaaattcgataaatactggaaattatcatggatggcactatgtattcctatcatcttgtacccacggttcacgttatcctttcttgagtttcactttggccctgcctttgggaaacgtgctaaacctaggcttgaaagattaaagacaaccctcgagggcatgttcaatgaatatgctcagcaaacgatcaaccttggttctgcgcaacaatggggtggtaatgttgagataggtagttgtgatgaattggcttattgggatcaacacgtgagcctcactgccccaccaaggattgtggcatcatcaaaattaaagaattatctgttaaagcctccactccctcgaggtgaaccctttaatatcttaaaatggtggcaagcaaattttattgagttccccgtacttggtcggatggctcgagacattttagctgtacctgctaaacttgagagactatactaaactctagagactatactaaacttgagagaatgtatgaagcttcttgcttgaggtgtgtcttgaaatggaggatgagagctcctttttatagcttcccaatgacggttgtggtggttggaatggtcggaaataccctccaatagtcattgggatgcaatcctggacgtccatgccgaaccctggcctcaaccgtggagatgggggttcagccgaaccagggggttcggccgaaccatgggctggcccaatccagcccattttcagctggcgacctcttattcttcttttctacgtagacttgtgaatgttggctgttttggtcgtgtcaattcgatgtttcgaacccacttgtccgtaagtctgattctcgatagcgttcgattgattgatcgtccgtgttgctgtcgattcttctccattttgtgtttatgctttgcaagaggttagaatcctagtgctagtggaatatatgttattttgacacatatgcattgtaagcataacttgttctccttaattttagtaatattgacaggtgaaactgatcactaatggccgtcaacagtgatcttactgcaactctgctcttttatggtgaattggctgtgtaattagccatgtgatgtgatgtactcctttgcatatacgtagccctaggattccttgcgttttatatgtgtggccccatgaatctgtgaattaactattatctgctaggttcaataggttaaccttttgctccattggataacctatttatttaatggaatcattaagggatgccctaattgaaccatggatcagcatgatcacgtgaaatggtttaggttcaatccagaacctaaccattcccatcctgagtggagagggagccatcccatagcagcgctgtgatgggactgtagcactgccagagaaaggatgcgtaggtggcagcgacgcgtcaattcagcattgacgccgaggaggaggcactagagctgggctggaaggtcgtgccgagggagctcatggcggaagtgctacgccgactggggccaggggcgtcatggctgacaccgcggtcagccatggctagctcaaatgaggggaagggggggtggcgcgcagtggaggagctacgtctccgcgccactagcatcagcctcattggcgctgctaccacggtgacccatgctctcgcgtctgaggggggtggagagagagagagagcaatcccgttggaacgatatcccgtcccatagcatttctaaaaaatgtgaatggcttggtgactatatagcaagctgcatcttcagccatgagatcgcgggtttgatccctgcatcacatgatcgttgctgaattttttaattcttccgcaccttgcacaaatatcaatatcaatatgatggctgataaatgaaattttttttggaaaaatgccatcgacaattatatactccctccgtccgtaaatataagcgaccttatatttagggacggagggagtaggaatcctgatttttatttttattttttttaaaaaaaccctcaaaccagcggcccagcgttacagcgtgatccaaaattccacgttaattttatataaaaaagaaatccccaccaatcagctgttggctgttccgtctcgtccatgcgatcccaacgcggttcagaccgcgtgaacagatctgtcactctctcatgcacaaccaatggacgcaaccaccacccacaagtgatacggtcggcgcacacctttcgtctccgtctccccaccacgcaaccccccatctaatcaccccgtacacaataccctgacgtggtggtcctgcccccgccgagccgatccttctgggccccacgtatcagtcgcccccgcctccccccccccccccccggggtgcggcctgcgacgatttttcggtcgcttccgatgcttccgtcacgagacgggggtttccccggtgctacgtgcgcaccacccgttgttctactcgcaccaggtaacctatcactgacttgtgagccccaccggtctgtagctctgtaaaccccgcgtgtcggtgtcggtgggcggggattcgcggtagtggtggaatcacgcgtagcttcgccgctacgtggcctcgcgcacgttacgcggaataaaaaggtggaggaggaagacgacggagacgggagaccgaggcgagagggaagagcacatggcgagcggcgaggaggagggggtggggtggcgtcgccgacgccggcgaaggtggagggcggcggaggaggaggaggaggggggccggggatgccgatggcggagctggagcaggtgttccggcggtacgacgcgaacggcgacgggaagatctcggcggaggagctggcgtccgtgctgcgggcactgggggcgcccctcggtcccggcgaggtgcggcgcatgatggacgagatggactccgaccgcgacggcttcgtcgacctctccgagttcgccgccttccactgcggccccacgccggcgcacggcggcaagggcggcgacgccaaggaccaggaggccgcgtcggaggcggagctgagggaggcgttccggatgtacgacgccgacagcaacgggaagatctcggcgcgggagctccaccgcgtgctccgccagctcggcgacaagtgctccgtcgccgactgctcccggatgatccggtccgtcgacgccgacggcgatggctgcgtcaacttcgacgagttcaagaagatgatgggcggcggcggcggccggcggtaggctggaggggactgactccgtatggttgcccggtcaaagttttatctgttcttgcatggtttccgtaattagaagcttataaatcaagcctaatatttagcatgtgaacaactttttaagtagattttaaaaaagccccccactgatttgatgggtagtgatgtaatcatgcaaaggtagtggagtgacatgctgtattactgtttctgatatatactgtacaacttgactaatgttcaaactgatgggtgtataaacaagcttgggcaaagggattgccgtccagcctgggcaaagaatgtcgagttttatagcattgtttgtttaatatttgtaacaccagtaaaaactcggcaaaaattctaggatatattttgaatggacgactcctaatttatgggacaatgtttggaagatgaaaatgaaatctttgtttcactttcaacagaaatggtatctttattaggtgctcagaataagcttaactttttttcaatgataagtttgttttttttctgcttcggttttttcaaaatatgtttattttttcatattcattgcatcggagtttatgaaaataaatacgatatagatatgttacgagtagataaaagaggtttaataattatactgatatttgataaagtaaggatattttaattttttttaaataaaagtaaacttatttcgaactagaggttcaccaaatgttacacacaacctcaccaaagtgccattacaaccataaaagacatgtcaacatttattcctgatatagtatgcagttagtggctttactctatgatcaatcacatgtcacatgttcgacaagtgtcaaatcttacatgtgctactctctaaaaaaagcacatgctaaggctgtgtttagtttctgaaattggagagaagtttggggaaagttggtagtttcgataaaaagttgggagtttatgtgtgggaaagttttaaatgtgatgtgatggaaagttggaagtttacgggaagtttggtgtgaactaaacaggtctaaggccgagtttaattccaaactttttcttcaaacttccaacttttccatcacatcaaaacttttctacacatgcaaactactaacttttccgtcacatcgttccaatttcaaccaaacttccaattttagtgtgaactaaacacatccatagtgttggaattaatagatgggctaaggcccattcgaagattaattctttggaaaatcacaaaagcccacctcatgggatggcatgcatgtgaagtttagtaccatcttgcttattctagaagagggggacctccttaaaagggaggatgccctcctagccacttgaagcatgtgtggtggagagaagaggggaaacacagtaaccgaaccggataagtcgcgtgcacgacgtacgcgtcgaatggttcgcaaaattggttcctcacccttgcacagatgcagcctccttttgcagttttgttttgctgcgggaaattcggatttgttttgttttggaaacattccgaaaaatccggtgcgtgaaaacggcgtggagtccggataagttacgcgcgacttatccggttcggttacgcgaagtggagatcatgcgggcaccctgatcaagcgacctatctctatataaaccgagccgccgccatcatgcaccacaagcgaaatcaatcttgggtttgcctcctactctgtactacgccgtcgctcatagactactcaatcccacttgccggcatgcaccggcgatcgggagagcaggtctccggaacctctgccttcgacgtcctgcaccgggagaaggcggcaataaggtttttgggaagcgcttcgcgcgactactccctgttcgcccgcgacggctcgtcttcctctccactcgcgtgctgcgcgccttcgtcgacgcccgcaaccgcgagtagtttctgccgagcaaccggtctttccgccacctcggtacgtgttcgatatgttacgtatatttgatctgttcatgttttactgcttagtttacatgtgtagatctaatgatgtgttcatgctagtttacatctgcaatgtcatgatttatttatgtaataaattaaatcattatgtgcttataatttcaacaatccaagaaccttattataggcgctatgattttactatggctggttttgccgatgcactgaggccggataaattcaccggtgtgcactttaagagatggcagatcagggtcactctgtggctgacagatatgaaatgcttctgggtgagtactagcaaacctgaaggaattcttactgctgatcagtagaagcaattcgaggaagctcctcgaaggagtaagagacaaaggacggctaagtcctttggcgatgatttcgctgtgtacctcgtggatgacactccttagtcaatttcagaagcatatgcatctcctaatacagactactggaaggaggctgtccgtagtgaaatggattccattatcactaacgggacttgggaggtgacagagctaccctatgggtgtaaacctgtggggtgcaagtgggtgttcaagaagaagcttaggcctgacggtactattgaaaagtacaaggttcggcttgttgctaagggctatactcagaaagaagtgaaaatttctttgacacttactcaccagttgctagattgaccacaattcatgtgctactttccctagcagcctcacatggtcttctcgttcatcaaatggacgttaagacagcttttcttaatagagagctggatgaggagatatatatggatcaacctgatgggtttgtagttgaaggtcaagaaggcaaagtgtgcaaattgttgaagtctttgtatggtttgaaacaagctcctaagcaatggcatgagaaatttgacaaaacgttgacatctacaggctttgcagtcaatgaggtagataaatgtgtgtactatcgtcatggtgggggtgagggagttattctgtgcttgtatgttgatgacatactgatatttggaacaaaccttgaggtgataaatgaggtcaaatcattcttgtctcaaaattttgatatgaaggatttgggagtagctgatgttatcttaaacattaagctaattagatttgagaatgagattacactcttgcagtcccattatatggagaagatcttgaatcgctttggctacattgatagtaagccttctccaacaccttatgatcctagcttgttgcttcgcaagaacaagagaattgctaggaatgcaccggaatactcccaaatcattggctcgctgatgtacctggctagtgcaactaggcctgatatctcctttgctgtgagcaagttgagccggtttacctctaatccgggagatgatcattggcgtgcgcttgagcgagtaatgcgctatctgaaaggtactatggaattggggcttcactattctgggtatcatgcggtactggagggatatagtgattctaactggatctctgatgtggatgagatcaaagccactagttgatatgttttcacactaggtggtggtgctgtttcgtggagatcttgcaaacagaccattttgacgaggtcaaccatggaagcagagttgacggcactgaatactgctactgttgaggcagaatggctgcgtgatctattaatggatgtgcctattgttgaaaaaccaatgctggctatccttataaactgtgacaatcaaacggtaattgtcaaagcgaatagttctaaggataatatgaaatcatctagacatgtgaaaagactattgaagtctgtcaggaaattgagaaactccggagttataacattggattacatccaaatagctagaaacctggcagatcccttcacgaagggcctatcacgaaatgtgatagacaatgcatcgaaggatatgggtttgagacccatgtgagttttactatggtggtaacctaatctatatgatcggagatcccgtgaattagaatctgggaagaacaaaccattagtaaactagaggagagtgccaatctataccctctctaagtgaagatgcatgtactctcgtgagctgcaaggcaggttggctatgccttaatgagttctgttggctttaattagcgaagatgctgtcctgcagagcattcttgaaagaacccacctttgtgagcttgactgttggtcgcagtctatggagattttgggtgaatcttctaggaagcttactaaagacctaggagtatgacttatacgctccacccgaggggtagtctacagacggtctagtatcagataagactcttagtgaaacttgcttgcataaaacttgcaattcaaggcagagtccattgttcaagttgtgagtaagtgtagcttggagttctaggtggatgttcaaccttaatatgtctccatcgaaccattggtatataaacagtacattggaaaaggcaaatctcagtgggattttaagatttggtgggggattgttggaattaatagatgggctatggcccattcgaagattaattctttggaaaatcacaaaagcccacctcatgggatggcatgcatgtggagtttagtaccaccttgcttattctaggagagggggacctccttaaaagggaggatgccgtcctagcctcttgaagcatgtgtggtaaagagaagaggggaaatacacgcgagcgctcgctcgcctcgcctggcctggcctggcaggcggcgcgcgcacgatgtacgcgtcgaatggtccgcaaaattggctcctcacccttgcgcagatgcagcctccttttgcagttttgttttgctgcgagaaatacattccgaaaaatccggtgcgtgaaaacggcgtggagtccggataagttactgttgacagaaaacacgaggcctgggagatctgcttaactccagtgcaggtccaaaactcgccttcggatgtgtgagcgtgccagttgatttgatcctgcaatcaacaagaaataaagacaaaagaaccgtggttaaacttataaatgatagccgatcggccagaggccgatgacacatcatttatatctaagccgatgtcatctgtgcatcgatcggcagtcatgaataagtaaagaatgactaaatctacttgatcagctatagatattaacgatatataccccttatatcgatatatacttaaatcaagtgattgggatagatcggtcatcatgccgagacagtataaaccacttagatcaaaatatatatcaataacaggactatatatgttgatagcgtagccgatcagatagatctagtatgtatcggctaatactctgatactactctatgttaggatattaaagcaagaataatatatcgaacaagagcctaatatacttagactcagcaatatcttgatataaagggcagatttaacgtatcaatgaagcacatagaacaaataaagttaaatcagatatgatcggctgaaaccccgatgctattctaatcggcaactagatagcagggtagaaatcaatattctaagtacgacttaatagatcaaactcaattgatgcagcattaagtatgaaaagaagaacaatatctagacaatcaagccgctagaagattcatagaatggtagatatcttatataatctggatcaacatcaagatctaacctaatcggctgccttctgcacacagatgttggccggtagtagattagataacaatattgctgaagattatataagatatatgataacttgacgaattatataaataagattagagtgtcataaagatgtaagcactaatcctaagaacacgattcgtgatgacgaattttacctcttgttgaagatcgaaaccgatgcagctcaacccgaaagtaagaactcgtcgaaataaaagcaaaaggtggcgatgcgccggaattgtattgaatgtgtctcttttttttgttacatagggctcggggtctatttatacccgaggattacaagatatgcccataccggacacgaccattatctctaacaaactctaaaatatcacaagtctttgcggcagacttttgcccacacttatctataaggaatttacataaaatttcctaattaatagatacaatttccttcccaggactctatccatgcgtggcaatcatattgaagtatatcaacttgagcctgacgtcgtgcacaagtcgtattgtcagaatcggctatatcggcttatttagctcaactcaatctcagccgatcctagccgtagccgatccggactccagccgattcctgctctgttccagaactcgatctccgcctccaactcttctttgatcaaatcccctttcctgatacaaatgttaccaaatttggttgttaacacttacgcgcgacttatccggttcagttatgtggagtggagatcatgcgggcgccctgatcaagcgacctatctctatataaaccgagccgccgccttcacgcaacacacgcgaaatcaatctagggtttgcctcctactctgtactgcgccgtcgctcgtagactactccatcccgctcgccagcgtgcaccggcgatcgggaaagcaggtctccggaacctctgccttcgacgtcctgcaccgggagaaggcggcaataaggtttttgggaagcgcttcgcatgactgctccctgttcgtccgcgacggctcgccttcctctctgctcacgtgctgcgcgccttcgtcgacgcccgcaaccgcgagtagttcctgccgagcaaccggtctttccgccacctcggtacgtgttcgatatgttacgcatatttgatctgttcatgttttactgcttagtttacatgtgtagatctaatgatgcgttcatgctactttacatttgcaatgttatgatttacttatggaataaattaaatcattacgtgcttataatttcaacacatagagcttgattatcaatcctagtacaagagattaggtgttttttttacctaggggatccaagatgtctttaaatttgatgtatgtatgtatgtatgtatgtattattacattcatcctaaaatataataaatttgaagcatgtatgtggatcctaaaatataaacttttaagcatgtatgtagatccgtgcctatctaaatgtatgtaaatattatatatttaggtgtcgtattttttttaaaaaaagaacaaataaaggagtaccacatcaatatcttcattagcagcgaacatttaatgtaaagctcatcgagcaaaagggctgcagctacacaccatgtgaccatgtggagataaagggcaacagtaacgcgaaagaatgtaggtgtcaccgcgggagaacaaggcagcatggcgtggccgaatgggccataaatacgtaggttttcattgaatccagggttataattggattgaggggatatttggttgatatctaaccttaccataactaagtttaggctagttatgctatagtggcacaagtatggcttacaaatagttggccacaagtgtggtcactactatagaaaagtccaaagtaccggttcctaaaggctcataggtgccggtttttcatccgacactaaattggtcggcaccaataatagcaaccgacacctataacaaaaatagaaccggcacctttaccattgctcgagccaaaaaaaaaaacgagagccggctcaaatccgagccgaactcaccaagcggcgccgtcaccgggcatgcgccccaaaccccaaaatcatccacaaatcatcaccaaaataaaataaatcacataatgaacatatttaacaataaattcacacaaacatcaacaaattctgccacccgctgccttccccccgtcgggcaccatcgcaacccgtcgcccgccgcccgccgcctcccctcccgccggatctggcggaggggagaccgccgccgccgccggtcgcccgccgcctctcctcctgccggatccggcggaagggaggccgccgcctgtcgcccgccacgatgcgccgccgcctgccgcacctcccctcccgccggaggagaggccgccactacccgccgccgcccgccgccgtcgccacccctcgcacgctgtcgcccgccacaatgcgccgccgcctgccgcgcctcccctccgacggatctgggagaggggaggccgccgtcaccgcccgttgctcgccgcctccccttcagccaccgcctcgcgctgagatttttttgagagagccgaaagcgagagagagaggcaagagagagacagacaagagagatgggagaggggataaggctctcatataggccgatgtgtcactcactcgtccgtcggctagattggctcggcggctcggcttggtttggataggtgttggtttttcaaaaaaaacacctataatttattataggtgtcggttaactaaaaccggtacctataatatattaaaggtgcctatattatctatactataggtgtcggtttttctttagaactaacacctatagttgcttaaaggtgtcagttttatatgttctcagcctgtggacgtggtaaaatcactatagatgccggttagttgttccggcacctatagtgccgatctttatgggctttttttttagtagtggacaagcttagctctaaatttgagagcatgacgtgggtcccaaagttaaaaaagtgtggcataacacaattatagcaacgaaccaaacagacgcctaagaaactgtggcatgactaaagtgtggtatgacaaagtgtggcaactaaccaaacaacccctgaatgcgtctgagtagttcatctgtaatctttattttgtgatgcaggggagtacatactaaagagtactgtaatctttgagcgagcaattttgtgattttatcttgattattaaaatgtgcaaatggtgaactaattagaacttacagggttcctttagaatagaggaaaaacataggataaatgcccctttaatttgtaggattttaatcctacatgaaaagttcgtaagaaggcttctgaaacataggattgaatcctatagtttccttttaaaggacattccagatttctatgaaagttaacagtaactccaaagttttgacaaattttcttggagtatatatctctcattaccatagaaaaagtttgcctagatgatacataagctatttacacgtgttttccgctttgcctgcaaccaagggcctatggaaatcgtggatttttgcgggtgcatcaagaactgccggagaaaatatatttacgcagtcggacatcttcagtctttgcctatgaaatacgttttgtacgggctgttactgaagtctgaagacatttaacagtggaaacacttttcaccaggcggatctaaacgcttgcattgttgtattataacaaaaataaaaaaataaaaatctagctgctatggagcaattcatgcccatgcaaaactagcatatttcttttcagtatgtggggacacaaattagtagccacattcacgttcactgaacattcaaatagataaagagatagtacttctaattaagttggtcatacacattatattatacacatcaatacttggaagcaagatatatattgacatagacagttttaagtcatactccctccgtttcaaaatgtttgacactg

SEQ ID NO: 61406 - DNA, 18795 bp, Oryza sativa
acagtagttcatcacaaaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgaaggagttattttgtgcttgtatgttgacgacatactgatatttgggacaaaccttcaggtgataaatgaggttaaatcattcttgtctcaaaattttgatatgaaagatttgggagtagctgatgttatcttaaacattaagctaattagaggtgagaatgggattaatctcttgcagtcccattatgtggagaagatcttgaatcgctttggctacattgatagtaagccttctccaacaccttatgatcctagcttgttgcttcgcaagaacaagagaattgctaggaatcaactggaatactctcaaatcattggctcgttgatgtacctggctagtgcaactaggcctgatatctcctttgctgtgagcaagttgagccgatttacttctaatccgggagatgatcactggcgtgcgcttgagcgagtaatacgctatctgaaaagtactgtggaattggggcttcactatactgggtatcctgcggtactggagggtcatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatcagcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcagggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgtagtagagatcgtgcgggcgccctgatcaagcgacccttctctatataaaccgacccgccgtcttcacgcaatatttgcgagatcaatctagggtttgtctcctactctgtactgcgccgtcgctcgtagactactccatcccgctcgccggcgtgcaccggcgatcgggagagcaggtctccggaacctctgtcttcgacgttctgcaccgggagaaggcggcaataaggtttttgggaagcgcttcgcgcgactgctccctgctcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacagttgagacctatttaccaatttatcagttgggacgcctggcaaaaaaaaataaaaataaaaactaaacatttgagacttgcttactgcccaccaacttgaatctatctttgtgccaaaattttgaaagagtacttgtatgtcaagattgtttttagcacgagtctttttctttctgacacttcattgtatagtttccaaacatgtaaggtacagcacacaacttaccagccagcctctgaatacattggtacattataattggaattttaggacgtggcaagtgagattatttcccttattacttaccttatagaatgccatgctataaatattaaatgcagagaaatatttgtttcttttttaagatctattacctcatagtttcatggctgatattctgattttaaattttggaattttggatttttggtcccctggcaggacactctttcaccccaatatttattttttttaatatatagaaaaatgtattatacttcaggtaaaaatgttaaaatttcaattttttccagccaaaatattctgaaatttctccaattgggatcaatcttccagacccaccctcccccccccctaagctttgcataatatagaacacaacctaccgtacaaagtcaaactgaaaaccttggtgttgtataaaagttacaggaattcaaggtactgcatccatatgtcagattttttgaaggctcagagggaaaacactaatactttataaattgtgccaaaaggaaataattgacaacaacccagctacttggtcaaagatatgtgcattgcactgttgagtgttgaatatatagttgattaatcctggagttttaggtgcacattgaactcagctacagaacttaaatagctgcactggtatcagattttgcatttatatatgatatcattttgcccatcttcgtccataaaagatagagatgatcagtgattccaaacatgcgtgcggataaagagaaatgaacagttttagtgaggactggcgcggtctccaaatggttgctatgctaggcctgggaagcatcggaatctcgagtgttacaacagctcacttgttaacttgaaggactgtgtactgatgagtttctttctgttctgtactcaagaatttcattttgtttagtggcaaccatcattcgaccctagtagccagtcaactcacataggccgtaacgttcaccattattgctatatggctgtagagatgaacttccattagatcaagaacgtgctgaagaatgaacctacggttttgcacaaatcgacttttatttctacatttccagattagacaacacattcttatcttagtttgttttattaaaatctaggcatgctcaacttttgttgagtgaaatgataaaatgaagagcagtggcagccagcagcctgctagctgcacgtccaaaactaagctgctggtccctccatccaccggcgaggcggcggtcttcaccaaaagcttcgttcacaccatcccaagaacatattgcctgctacataacactggaaaatgaataggtttagcaaggccatgctaataatctagtttcatcccaacttctatcctaccatgcccaaaacataattgtgtacattgattaattagtttacatttgttatatacaacagatggctcttttgagtttatcatctgctttttgattttgacatacactcaaagatggcaaattagttttctaaataactgttcagagtcgctacctaaaagtattaatcacctaaaaggcatgaccttgaagttctctctctctctcttgcaaattcagatttcagaaattaccgatgactagtaaggtgaaagtatttcttgcattataaattctgaataatgttttgcttcagtacttgttactacttacaattaataatagaaagaacattaatgggtgttcaacaaactgtacggagacagatatattagtgagccatcgacatttgtttatctaaaccttttaactgaactgaaattttccgagtaattaagcactgacatatcttcaggacataactattggctcatatatataggtggtaggtgctacttctgcattccactgtagtgacatataaaatgatgtataaataaaatagaatcagatgaaggaccaaaagagagatgaactacaccgcatgcatagagacagatcagggacactgagattcaggttggcctcggaggtatcaggatttgccatttcaccatcaccacccttactagtagcccttcttgatgatcggtccgtacatacaaggcttcttcatcttcttcatttgtttcctcattttctaattcgacatcagttgtgggtggcggttgctcgtcgggttgatcgtagtcttcttcatcaacgatattctccattccaacaatatttagcttgcctacgaatacaacatgatgtggtctggcagatttcgcaagtgatgggtccttgacatataatatctgcttaaaggatttcgcgagcatgaacggctcatctttgtagccaacatcattcaggtcaacgatgatcatcccgtgcttatcaaccttcaaccctcttggaattcttacccacttgcatcggagtagagggactttgaggactctgtaatctagctcccaaattgactctatgaaaccgtaataagtctgcttcttgccatcatcatcataggtgtcaatgctacgccactgttttgatttgtacttttgttgtcctgggccttggtgtcgtaaaaagtatacccgttcatgtcagccttggtacgtgtggattatgttggatggcccccgagataaagagaacagttggtcactatcgatgtctgcagttgtcaggtactccatcaaccatttcccaaattgaagtttatgcttcttcacaagccatgcctcggattcctaggattgtctctgcagatttcatccaagtgcatgtccacgtatggagccaccaaagccgattgccgtaacactgcaaaatgggcttgtcttatgttttgtcgattggggttgacaattctcttgtggcctaatgttctttttccaaacatcctaccctagtgacggtgcacaattacaccaataggttgcagatccatgtaatctatacataattcaaccataaccattgacgatgctgtttttttaaaatatctattacctcatactttcatggctgatattttgattttaaaatttgggaaatttgggatttttggtccactggcaggacatctttcaccccgatatttatttttaatatagaaaaagtattctactttaggtaaaaacgttaaattttcaattttttccagccaaaatattctgaaatttctccaattggaatcaatcttccacacccaccgtcctcccctcttaagcttttcgtaatatagaacccaacctaccgtgcaagtcaaactgaagtgcttggttttgcatacaagttacaggaattcaaggtaatgcatccatatgtcagattttttttgaaggcttggagggaaaacactaatattttttaaattgtgccaaaaggaaataattgtcaacaacccagcaacttggtcaaaggtatgtgcattgaactattgggtgttgaatatatagttgatatcatggagttttgggtgcacattgaactcagctacagaacttaaatacctgcactggtatcagatttcgcatttatatatgatatcatttagcccatcttggtctataaaagatagagatgatcagtgatcccaaacatgcgtgcggataaagagaaatgaagagttttagtgagcattggcccggtctccaaatggtttgctacgctcggcctgggatgcatcggaagctcaagtgttacaacagctcacttgttaacttgaaggattgtgtaccgatgagtttctttttctgttctgtactcaagaatttcattttgtttagtggcaaccatcattcgaccctagcagccagtcaactcacataggctgtaacgttcaccattattgctatatggctgtcgatgaacttccaatagatcaagaacatgctgaagaatgatccaacagtttgccacagattgacctttattttgatattttcagattagacaacagattctgatcttagatttttttttttatcaaaatctaggcatcctcaacatctgttgagtgaaatgataaaatgaagagcagtggcagcgagcagcctgctagctgcacgtccaactgagctgctagtccgtccatccaccggcgaggcagtgaccttcaccacaagcttcgtccacaccatccaaaaacatgttgccagagccggcaaaatccctctctgatggccactgctacaaaacacaggcagatgaataggttttgagaggccatcgtaataatccagtttgatcacaacaaaatctatcctatcatgcccaaaacataactgcgtacgtcgattagtttatatttattatctacaacagatggctctttggagtttataatctgctgtttgattttgaacatacactcagatagaaatttggtaccaaattaagttttgaaataactgtttagagtcgctacctagtagtaatcaccaaaaaggcttgggcataccatgaagctctctctcttgcaaattcagacttcagaaattacccttgactagtaaggtgaaagaatttcttgcactacaaattctggataatattttgcttccgtaattattactacttacaattaataattagaaataacattaatgggtctttaacatactgtgaagacaaccaggagcggacccaagtctcgagccacctgggccgtggcccgaggcctagtactggaggcccaaggggatagtttattttccaccatgtattaatcatgttgggccatattctccatgggctggcctgagccttgggccagtcttgggtccgtccctaaagacgatgatatagttaatgagccatcgatatttgtttgtcttaactttttaagtgaactaaaactatccgagtaattaagcactgaaatatcttcaggacaaaaccattggcccatatatacaggtggtaggtggctgctacttctgcattccactgtagtgaccgataaaatgatgtataaataaaacaaatcagatgaaagatcaaagagagatgaactacactgcatacatagaggcatacagggacactgattcagcttggcctaggaggtatcaggatttgccatttcacaaccaccaccctgacctacccggtccagacgtacgcatgcagttgatcagtcaccacaggtgctactgtccttgaccagggctcaagcttaaccctcctgcaaggcgtcctcaaacctcctgttgtggcaatgaaaaccaaataccgatggtgtgttcgactaccaccatattgccatgctgacgccacctctcatgaaaccaagctctgtctagtatttataattgtgtggcgggttcaccatagctggccggggaatcgtgttacgccggtggtcaggcacaggttaccggggataggagcaatgactaagtagccccgtgtggcaaatgacagatccgtcagtcggcgccgttgttgaggtgaagttcagaagttgtagaaaattgagtaaggtggtaatattttgtacagtggcaaccatcattcgaccctagtagccagtcaactcacacgagccgtaacatttaccattattgctctatggctgtagatgaacttccattagatcaagaacatgctgaagaatgatccaacagtttgccacgaatcgactttcatttcaatatttccagattagacagcacattctgatcttagataaattttttttatcaaaatctaggcatgcgcaacatctgttgtgtgaatgataaaatgaagagcagtggcagtcaacagcctttgctagctacacgtccaactgagctgctgatccctcaccaaaagatttgtccacacaatccaaaaacatattgccggcgccagcaagtcccctctctgatggtcactggtacataacacaggcaaatgaatatgtttggcgacgccaccgtaatactcaagtttgatcctaacgacatctatccgaacctatcatgaccaaaacataattgtgtacatcgattagtttatatttatcctatctttctataaagttaaggcccactacatcgtaaagctcaacatacaaagatgccacatcatccactaacatttactatatctcaaatctcatgcaagcatgctaatttattaagttttagagttttaaaatgcaagcattaattaaattatcatcccacgtaatctatctatctattatatactaaaagtccattaaacttcctacaaacgctctcaagttaccacatgacactctaataaattagagaaaatcctgtaaattctaagaaaaaagcaaaacatctacctcttgattttcacttaaattggtgggtccaatattatacaccgttagataaaattgatcctaaaataaaccaaatactatgggtcccacctaactcacgtacgtacatgggtatgcagtacgtacgcctccttccaattattttcgtatgtagtatgtacgcctccctccaattatttcttcctttttctctcttcttttttccatttatataattgatatatatattttaaataaacataatttacaaacaaagaatataccatcatataattctttataaacacagttaactaaattagctctacaatctttgaaaataaaatttacaccattatatgtttacccattaaatcaatataatttccaattaaaccagtgtactcattattatttgtactatttttttcaaataatacactattttaaaataaagtttacacaattataatgtgtacttatcaaataaataatttaagatctatattaactaattatacgtgcacttaaacagatggacccattatttaaatcatggtatctattttttttattaatttagactattattctcaaataatgtactattttaaaataaattctacaccatcatattgtgtacccattaaattaacaatttaaaatatatattaactaatttacatttacactagaaccggtggacccattatttaaatcaacagatctattgttaataactaaagtgtccaaagttctctttttggtccgctgcacaatgcacgtctacacctttgcctttcgcacgtgtgacaaagtatcgtgtctgaggcatcttaggtgatcacgatcgctgcaacgctaccgcttttgttaataaaaaatcttaagccaccacatatatatcaactgttaaagatttttagaatgagaaaacaacgagttctcacctacattatttagaaacattagaaaaacaatgtcccctccacctccctctccaatcacatgtgcataacactgttacactgccaacccatctctggctcgagttgtatgctattcattcctctccaatctcctccctattttcagcataatattaacacatattaatagaattcgtactaggataagagtaataagggagttttaaggccctatttttttattgattccatcttttgcattttcgtttgcacgctccacgctttttcaagtttataaatggtgcttttcttaaacgactttttaactatttagaagttaattcatttgtttataatctcaaatagctatcacataaatcagataattcatcaatttcagttgtcctaaaccctaagtagtacatatttttttcgtacgaatcatggtgatcaacgaataatcaaagtggtaacatgaatcttaagagctactatgaacaattgcaaatatgtgtcaaaattatttgctattaattagacatctaatggtttgctagcaacatatttaatttctctctacatgtatataaacatagacaaagctagaatgaatattaacatatatcccatacatatatattacatgttaatattctcattacatgtggtaagtccattaaaatttcaaataccctcaagctaccacttggtgctctaataaattagagaaaatattagaaattctaagaaaaaaagcaaattatctattacttgattttcacttaaatcggtgggttcaatattataaaccattagattaaattgatcttagaagaaactaaatactacaaggtcccacctctccaccttcgatacgcacctacgtacgcgtgggtacgtatgcttcccctcccttttatcatttttccctttcttcttttcttcatgtatacgcttctctctctttcttactatatcatgcgccttcatgagacgatttaatcacaagaattttgagtatcttgctctcacatttttaatttgtagccatactataagcaatatatagtttattatttactcaagaaaataacatgattcaaaagtcgtaagtacttaatccatctcctacttaaaagtttgtgaatggatttttaagataccttaagaaaaatagaaaccttaaattattataaaataacattatccgaactttagttttcccttaatctatgagacaaaatctttgaacaaacaataaaaatcttacctttcaataatataagtgcccgcgcatacgcgcgggccatcttcctagttcacataatatttcaatatatctctacatcactttttataatatcctatacacctatatagttcatcctcatttaaattttagagcttaaaaaatccaagcattttaaatcatcattacacataattctcaaaatatttcaatatatctcaccatcattttatataatatctatatacctatacaatttattcccatttagttaattttatttctcttctctctcattaagccatatcacctcaattatttctaacccttaaatgattaatctatgggtggaattatctccctcattttcttctctcataaagccacatcatattacttttaaatttggctcatcattctatatactatttaaattatgataaatcacatgaacttatgtaagtttctatcatctagctatcttacacattatttatatttattattatcataccaaactcccgcagcaacgtgcggggtttcacctagttatatacaacagagatggctctttggagtttatcatctactatttgattttgaacatacactcaaagatggaaatttggcaccaaattaatttttcaaataactgttcagagtagctacctagtagtaatcaccaaaaatgcatggtaagaccttgaagttctctcattttcaaatgcagacttcagaaattaccgatgactagtaaggtgaaagcaactcttgcattataaattctgaattatgttttgcttcctacttattacgactaaaaattaagagatttgctccggtccagcaaaaagtatctcgagctaccggtatctcatggtaccaaatcatttccgatcgtcggatctatctgggcaggattggtattgttagatgcaacgatcgaaaacgatttggtaccgtaacgtaccggtaccttgagctactttttgttggaccggagcaaatcttaaaaattaatatcagaaagaacattaatgggtctttaacatactgtgcagacgatgatatatatagttaatgagccatcaacatatatatatatatatatatatatatatatatatatatatatatatctgggtgtacgtactcctgcttgtatcagccgtccatctgtgcacccccgatcgagttatcgaatccacctatgacctatcggacccgttttcatttttgtggagaaaagaataatcctagtaaatctgcaattatcccacagggatcggaactatctcttttaaaactctgttgtttaccaaactaaaccacaaatcgataaatcggatctgagggcgaggtcgcaatctacgggagattctggggcgacggcacaatcaatcggcgactcgacgtcctcggcggcgattcgctgccgtacgtccacaacgtggatccgtcgactaccatccacggtgcagtccatcagcaagccggagtcgacgatgagatcgacgacaactcggtgtcaacggaggcgaagagttcaacgtccacggcgaagctgcgatccgtcgcgacagcccatctgcaagccgaaggcgacggcgccatctccatccgcacgaagaaagcgaatcccctccaaccgaagatcagggcagcctgcctacccaacgaatgccaggagttgcctggtagatacgggcagttctgttctttctgattatctgatatgttttgagattatcgatctggttgccgcatacatataccaccatctcttcttaactacacactccattgaatctcttcttaattatactaaagtaagagatcgtattatgtcaggcaataagaaaatcgttccaaaattcagtatgtttcttttcattcttgctcatcgtattgcatgcttgcagcaactgctatccagttctttacgtctaagctgaaataaatccatgttagaaccaggtgcataggacgctgccaaaaaaacactggcaatctcatgcatacgtacgttctggtcttctgaaattaaactagaatcacctttttgttttgtttttttttcgacgaaactggaatcacttggttctgaattttgtgaacacggctgatatacctctgtatctcctttttttttcaatgtatggactacttctgaagtcagcagtgtaccacttctgtgaaaagcatatgctacttccaattttccaaattcatgcatatttcaggaaaggacccatgcaacatttttagtcacgccacagcatgcatgcatgtatcggccaagcctcaaggatgtactgctgcttaaaaaaatagtatgtattccaaaaggtagcatatacttctctataataaaaatgatagtatatactaatataaagtagtatatacttctctttaaaataaagaagtatgtggcagcacatacttctctacgtaaaaaagtagtagaaaagaagtatatggcagcatgtacttctctaggtaaaaaaaacaagtgtgtggctgtggcagcatatacttctctacgtaaaaaaacaagtatgtggctgtggcagcatatacttctctatgtaaaaagcaggtatgtggcatatgtacgtatctagctaattaaaagaagcagcacgaacctcttaaaaatgcagtatatgcttataatcctcgtgattaactattaatattaatcatgaatatactagttggaaagaaaagaagtatgtactaacatactacttttaaaaagtacatacttatactgcaaaacaagtatatatacttctacaacaagtagctaagtatatacttttaatgagaaaaaaaggtatatacttccaacgagctaccattaaattttttgaacctagtcgtacgtacgcaccggccggtgcatgcagataatttgaaaaaaaaacaggaatggtgttttctttttttatctaattattcattatgaactaatggatatccattaagaagagggagtacatacacctgggagtataaaagagagatcctatatatatatatatatatatatagacacacacacaggtggaaggtgctgcttctgcattccactttagtgacagataaaatgatgtataaataaaaacaatatgagatgaaggaccaaagagagatgaactacaacacatgcatagaggcagatcagggacactgattcaggttggcctaggaggtatcaagatttgccatttcaccactacaaccctgaccttccgggtccgaacatacacatgcagtttgtcaatcatctaacgtgcaattgtcctttaccagggctcaagctcaaccctactggcatcctcaaacctcctattgtggcaacgaaaaccaaatgctgatggcatgtccaactaccagctagcgtattgccatgttgacgccgcctctcatgaaaccaagatctgcatagtgttcctgcgtgtgtggcgggttcaccatagctggacggctaattgtgttaagccggcgggcaggtacaacttgccgtgggggtaggagcaatggctaagcagcatcgcggggcaaatgacagatccgtcagtcggtgccattgttgaggtgaagttcagaagatgttaaaaattgagtaggggggtaatatctggatgtgtaattcatttcttgtggcatgttcttttttcagctttgtgaaccatttttctatggctccattctcaaaaatgctgaatgtctgaaatgatgaactacaacttaacacattggtaacgtagcctggtaagtgcatatcaaccgaactgcaggtttttgaaaaattatagggaatcaatccttcaagccagagagcagtagactatgagaggacaacgactaatattatttctgtgagaaaaggagagctaaattctccactggtccaacaatcgaccacttggttattattgagagaaattttacggtcctggagaaaatacttcgaggtacctaaattttacacttaaattttttgttgtctagaatgcaggtcgtgaggaagatggcgatagaaaaggcgactagcgtggtggcagcagcgacggcggcgtcacgaggcggcaccgcctcgccgaagagcggactttcctcaacggcgaccccgtggatgggaggtgttctgaacgtctcaactagcgggaggcggggctgggatacccagggtgttcgagcccaaggtaagcccaacactgctcatgcggtttggcgggttcatggtggagggatccgacatgggtggtccatgcgggatttgcttctgaatccgattgaggaggttgctatccccgcaaggtgggtctgggtcccgaaggggaggtctctaagtccgcagctagggtttccagctaccaagcgtgaaatagggcgatttggggagaaggcgacgccaatttggaggatcccggcgaagttggttgacgggagttccttccttgaagttgctaaggggagtggagagatggatcgaaagcctcagcctcagcgtccggagcaatgggtgcccaacaagaggagggcttttgaggaggaggggggggaattgggggaatcgaaactttcaagatagggaggagtgagagttgcggtctcgtttgatggggcaacaacagcagcgcgagggaggaggatggcagcaagttgacaggaggggggggggacagatcttggcaaggggagaggaacagagatggagatgcctgggaaggtggtgacagatgatttttcagaggaaaggagaaggttggagaagtggggagagcaggagcgatgcagaaggaagagatcaaatgtttcaattgtggggaaagtggtcatcatcaggtgaattgtcagaaaccccctctatgctatgtgtgtaagaatccgggacatatctcatctcattgtcctgctcatggtggggggagtagttctagtgatgggaatagagtggctgttaagttgaagggttttggtattcctgagcagggttttttcagcttgaaagtcgatattcctgatatggaaaaagtggctcagtttagagggattcttactgttgaaaaaggcaatgggtctgttcagaaggtggctactgaaatgtcccatttgttcaaggaaaagaaatgggattggaatgtaaaacaaatcagtagcaatgatttcctgattgatttctctagtgaggatgaaaggaggcaagtgaccaaattcgggggttttgtgtttaagacttcatccattaaggctagtgtgatagattcaaaaatgacagacagtgcagtggatgagctgtttgtagtctgggttaaagtgattggtctaccaagctttgctaagaaacatgatattgttagggccatctctgacattgtgggggagtttaaagagattgatgaagaatctctaaaaggggaaggagctgtaagggtaaaggtggggtgtttggatcctaatgccatcaattactcagtgattatctacataaatgatattggatacaagattaaataggaggcagaggttgaccatgatggtactggctcagtagaagggggtgatgaggatgatgataatgcagatgatctagatgatgactaccctcctgggatggggggtaaaaaggatggtaaagagaaaaaggatagtcccaagaaggagtcacctaaaggtacagatagtaaagggaaagggggtggcaaggttcaatctgctccccctgctctaaggagagccacagagaccatgcagaaagcctttaccttgccggtatcaattgagcctgctgaaaaggatgttggtaacactgtcattgaggtagggaaagagggggaagacaaagcagtagtgctatggaagtcagaagatttctctcaaccagatatttttgacaaagatgtctcaggaggacgacaaaagtaatgatttgttgaaaagaatggatgtggacttaaaacttgggggtgtgaaactatttactgatgaagaggaggagaaatgtgcaataccaactgattcagacattgagatgatgagggctgaagaggatgaagacaatgagaagtttgtactagatagtgggatgggggaacagaacaagggagagattttctaggaagtcaagaagaagaagaagaagaagcaagtcttgcaaacacagagacaaagctctagagttaaagataaggaagtccccgtccatctgaaagctgaactcaggaagtcgtatatcaactcatcttcaggtttggtttctaaaaatccttatgcaatctttcattctgttagtcaagatttccttctaaaaattgccaatgttgggagggtaaatcttggtaatagtagtgatgaagttaattctaatcttgatgctataagggccagagaattagcacaagctactttatttgaagctgaaaagagaatgtagcaactggccgaaaaggataagggtgagggtgagaagggacaggagttttcagatgaggcttgcatggtgcatcaagaggttttggtagacaatgtggaagagaatctgagtattccaggtttggaaagggggattggctctatgatagatgagagtgaaaaggggtgttctgatatttgtgaggtatcagatctttctgagccagcaggggggagaaagaaggaaaagagaggtaagcaatgtggtcaaaagggtgttgacagaaaacatgtggcctgggagatcgcttaactccagtgcaggtccaaagctcgccttcggatgttgttagtgtgtcagttgatttgatcctgtaatcaacaagaaatagaagcaaagaaaccgtggttaaatctataaatgatagccgatcggctaggtgccgatgacatatcatttatctttgagccgatgtcatctgtgtatcgatcggcagtcatgaataagtaaagaagaactaaatctactcgatcggctgtagatattaacgatatatactccttatatcgatgtatacttaaatcaagtgattgggatagatcggtcaccatgccaagacagtataaataacttagatcga

SEQ ID NO: 61407 - DNA, 5335 bp, Oryza sativa
ccgtcgctgtgacctggaattcgcagtgggtgactttgtgtatcttcgagtcacttttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaacaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgcagaataacatgaacatatcaaatatgcgcaacatattgaacacgtaccgaggtgatgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgtaccgtatttttcggaacgtttccaaaacaaaaacgaatccgaatttgcagcaaaacaaaactgcaaaaggaggctgcatctgcgcaagggtgctgcatctgcgcaagggtgaggagccaatttttcggaccattcgacgcgtacgtcgtgcacgcgcgccgcctgccctgccctgccaggccaggcgagcgagcgcgcgcgtgtgtttcccctcttctctccaccacacatgcttcaagtggctaggagagcatcctcccttttaaggaggtccccctctcctagaataagcaaggtggtactaaactccacatgcatgccatctcatgaggtgggcttttgtgattttccaaagaattaatcttcgagtgggctaaggcccattcattaattccaacacacttcccagagtctttccaccgtgcatcttcggagacgtcctagcgacagctgcaaaaacaaaggtttgatcctcttttccctcaacggttcaaacgaaataacaactcccagtgggcatagtcgacggtgaacatggaagatagacgcgatatcaatgcattccgagtgatgagaaggaactaaaggtaccctttctaaaccaacacctttgatgttccacatatccaaaaagtcgagaagccccccatcacccttgagatcggtcaacaacaaaaaacacagaatcaacattcaagaacaaaatcaacatccacatatcaaaaataaaatccaagaacacagaggggaggacaccgaaggagagaaggccactgccactactgctcattgtgggtgaagtccactcttgagcgccgcatgatgggagggcagcaccattcgttgagggagtcgccgtgccagggacaattgagggagccgctgccggcatcaagtggtccgtccctgagctcacagcgatggatccaaccgcccccgtgctcgtggcggcagatttggccacccccttgctcacaacaacaaacccagcggagaggaggagggacggcgtttgtggcagagatgaggggcggtggtggcaacgtagataggagtggtggcagtaaccaagagagagacggagaggctcagagagagtggcgagagagagagagagagggagagagaggctggactctagagacagagtcatccatatataaaaatccaggtcggctcgattgtcggcttgactacctgaggagtgttggttttctaaaagattacccggttgaagcattagcttgctttagatggtatacgggcggcaatggaatgggttcacatgcccattatagcggataccagattaccggtaatataatccagatgtggcagttagccttgtgaaggactgctccggccagatatattcacaggcaacggtgattactgaagtaattaataagcacaatgcagtgttaaattttactaaataaagagcgaaccaaatagagttggcggatccagcatgggggcggcggggtctcgagccctccattactggcgtgaagactatgagagaccccacaaagaccccactaaaattttttaccatgggagggggactgtaactctatctagtttgcttagaccccactactatttatttctagatccgccactcttcatatttttgctcagcaatgtgcacggcaacatatatggaatggcgtttctgtgctcccgaaggaaccccattctcttccaaactgttcagattcttacccagaagataaattttgctacggaacacctcaaattttagataatttgctgatagatatggtaaaaacgtgttatggctgaaagacaccataaaaaactgataatttgctagagaatactttcgattcaattgaagagagaattcttttcaaagacgagaatgcccctagggccaaaagcttctgagttgaggctggagtgaaaatggaatatgatgtacgcttgcgatgtacttaaggtgatcacaaatttaaagttgcataatttctaaactttcactctaacatcatgtgttaaagcatgtggtcctaagggtattcttgtttttcttaagaatttatctccagcaaagtgttctacaagaatttatgtgcagcaaattgttctccaacaaattactattttttgggtttttttttcagctatcacatatttttgtgatgtctacaagcatattatagaaatttcgggcatcatgtaacaaaatttgcctacccaaaatataagaaaaggaaatatcctggggaaatgagctatgtgttgaaaactcatgaaaaccatactttaatattttgtaaattcatgaaaaaatattagagataggtgtaaataagaaataaattctcactaaatgttaagtccaaactcaacttcatttgagagaaagaaatgacaaacttcatatgaatataactcacaaaataaattagaagctagaaattaagaaacctaacttccccaaactttatatgagtagaactcacaaaataaactagaagctagaaattaagaaacctaacttccccagatttttatgagctgtttatcataatcgcaacttctcaaacaagatcttaagctcaactaagatagattttttaagagtgaattcagaaaactattgatacatcgaccaaactatatatcatgaaactatagttttaagaggtatatcacaaaactatagatttaataatcaatttgttacaaatttacaatttattttaaggtgatgttctaaggtagatttatgtgctataatatcggtgcagaaaaactgaaaacgaggagagagcgagagaagagctgggggcagctataaaaaaaatgtatatttaacttgtactcatatataactattcaaaaaaatgtgcacgacatagttggctagcgccacgagcgagactgcaatcaataggttgcgaggctgattctttctttagctagtgcatgtgttagacaatttcttttaccaaccccggacgaatgtcaatgcaatccgactgttagaagggaaattcactgtttaatttctagcgattccagaagagtttggtgctgcaaaattcgcagcttttctgatcttctttctcctttatttattgatctcctcaagtgggagtttgttacatactacaaacttttcttctttttcttttttgtttcatattacacacaaacatgaccgattaaaacgcacgatgcaacaaacgcgctatcccacgtcgtggcacatccgacttcggtcagaaaacgagctgaagaaacgcttaattcttggcttcactgaatataattccggtaaccccggattatatccaattaaccactacatgaaacaaaattaattaacttaattcacatgagaggtggcgtgcaacagcatcgcatcaacggtcatccccgggccgaacgccatcatcactcccaactccggccattcacccgccgccgccgcctccttgcgctgccggcgcagctcgtccagcgcgaagatcaccgtagcgccagacatgttcccgtagtcgctgagcacacggcggctcgccgccagcttgccgggctcgaggccgagcgccgcgtcgacctggtccatgatcgtcgacgagcccgggtgcaccgcccagaacaggtcgttccacccgccgccgccgtcgccgccgagaagtgggccgaacatgtccaggaggcaccgctcgacgttgtccccgatgagccccgggacctgccgcccgaggacgccgtccaagcggcgctccgtgaaccgcatgttcagggcgtggtccgactccgggatgatcgtctgcgccgccgacactatctcgaacagcgggcgctcgacgtcgtcggcgtcggcgccgacaatgacggcggccgcgccgtcgccgaacaggccctggacgaggagcgtcctgaagcagccctcgtcgggcccggtgaagtacatgaaggtgagctcggcggcgacgacgaggacgcgcgcgccgcggctgttctcggcgaggtccttggcgaggcggagcgcggcgcaaccggcgaagcagccgttgaggtggagcatggtgcggcgcacggaggggcggaggccgaggagcgggacgaggcggaagtcgacacccgggacgtgggcgccggagttggtggtgacgacaaggtgggtgatgtcggcggccgggcggccccactcggcgatcgccttcttggcggcctccgccgccagctccggcacggcgtccgcggcgatgtccagccgcgcgtcgagcgacggcgcgtcgcggtccacgaactccgggtgtgcggacagcatcttctc

SEQ ID NO: 61408 - DNA, 29501 bp, Oryza sativa
  unsure (1)..(29501): unsure at all n locations
atttttttttataatttgtagtttgtaagagttctaatttgtatatattttttataatttgtaatttgtaaaagttgaattttaacatgtatatttatcgactgatacatcacatgctaatacatctttttttttgcaaatttattttgtaaccatttgggtgatatatgtaaacaacgagtggacgtgtgaacgttttctcgagggtttaaaatccattctcggtggaggttgtatatgcaaaattaatatatcgactgagaagagttggatagtagaaggagagaggctgtcgtgtgtttacacgtacagatacgcttgaacttgtccttgagggcagtgaggtggtcgctgttggtgacgcggaagtagaagtcggggaactcctcctgggtaacgcagttgggagggttggcggtgccgatggcgagcacggcggcgagcccgtcggcgcgctgcgaccgccgcatttcgccgagcgggtataaggcgcttcccatggtcgtcgtcggtgccatgcaaacaattaaatcactgcaactaattcttcgatctcgatcgatctccgcccgccttgcttggcacgtctcgcacttttgttttgcagaccacctcacacacttatggtgtttatatagcagtgcgctggatatatgacccactgcttgtttgtcagttgccagatttttcaaaacatctacgtgtgctgttttgtgtatctatctattatctatatatctatctatctataagatatatcttaaggctgcgttcggcagctgccgattaagagaagacttatctcttcactttccgagtaattaaacggtgtgtttaattttcttcaaaaattttcaataagagttgctttaacaaatcatatcaatctatttttaaattttaaaatagttaatactcaattgatcatatgttaatggctcacctcattttgtatatctcaatcttctcttttcatctcctttcaaacacattaaagtccattaaacatcctataaacgctccacgtgacacttctacaaacgctttcagaccatcatgtgacgctctaataaattagagaaaatcatatatattctgagaaaaaaatctatccatttagttccactcaaattagtggatccgttattttgaaccactagattacgtctattaaaaattaattccgtcctaattgatttcccgtgtaagtaagagataaaatacctacgcatagcttcacatgaaaataaacctaaaacacattaccccttgaacttcttagtattaaaaatcaaccaaatctaaatagatagccacatataatgtcaaattacccgtagcaaagcatgtgcattcaactagtttacatttacatttatatgctcctaattgtcttataattaagtgccttatatatgtcgccttccactttggcgtgcagtgtaaagtttagttctgacttgattaattaggcaatttcaatattaccaatcaataattgtatgttatacttgcattggtttaaaaccgcataaattttagtgaaattcaaagttcatcttggagtcctcgtttagtttttttatttaataactcaaattcaaaattaacgattctagctagatgtacactagatgtagattgaattgttatgattcgattagggcacattatttttctagttacgttgtttaaattatcaaatgtttctcttttagaacattagtatcaaataactacgacatgttctttcttagcagataatggataatccggctttgacttaagaacaagctacccccacttcctatgaagttttcaactgaatcaacagtaaatatgcatactaatgaaaaagatgacaagaaggagaaacattattaggaggcttcctattggtgaatcttcatccaatgttagtgaagatttgcatgaccattttctccaaactctggcgtacaatacatatatgagttccttgtttttatcacacttttatagttgggcccaaaactgcagccaataaatataaaagtacttgcatataagatttaaaagtagctctgtcaaacaccatatcactcatggtaaaccaaagaacctaacataaaatatatggatctactaaaataagctttatggttcttacgtcaacggcactaagctaactcccccaaaatgtgaaacattatttggtggattcaagccaaaataaatacggaccaatctccaaagaaatttagcaaagtgacaatcaaagaatatatgttggacagtttcaatatgcatacaaaagcaacatttttttagtactagcccaatttagtcttgctaaattatccctgtttaagatatcccctttaattaagcaaatatcacataaatatttttattttaagaggaatcccattttgttcttctcaatatatataaccattgttgattgcagctaagtacataggatggatagagaacataccattttgatgaagattccatcaaaatatatctttatcctcatttagattaatatcccaaatcattggttcattgatgtacttggctagtgcaacgaggcctgatatctcatttgctgtaagtaagctgagccggtttgtctcaaattcgggagatgatcattggcaggctctggaaagagtaatgcgctatttaaagggcactatgagctatggaattcactataccgggtactcaaaaatactggaagggtatagtgactcaaactggatatctgatgctgatgagataaaggccacaagtggatatatgttcacacttggaggtggcgctgtttgctagaaatcttgcaagcagaccatcttaacgaggtcaacaatggaagtagaacttacaacactagatactacgacaattcaggccgagtagcttcgtaaactcctgatggatttgccggtggttgaaaaaccagtgccagctatcctaatgaactgtgataatcaaacaatagttattaaagtgaacagtttaaatgacaacatgaagtcatctaggcatatcaaaagaagactgaaatctgtcagaaagcagaaaaactccggagtgatagcattggactatgtccaaacggctaaaaatctggcagatcagtttaccaaggggctaccatgtaatgtgatagacagtgcattgagggaaatgggcttgatacccacctaaggtcacacaatagtggaaacctgtccattgtgatcggaaatcccgtgaatttggatggcgaaacaaactattgtgtggctgagagaagagacccttaaaaatggctcattttcatgatgtacttctcttctattctgcatggtaggatggcttatgccttaatgtggtccaagtggcttttctaagcagagatgttgacctgcagaacatctcaaaaggaacacacctatatgagttcgactgctagccacagtctatgagatttgggcgatctctagatactcatgaaagggccttgagtttgacttatatgctccaaaaagaggggatgcaaacggcaacccagtaccaatcaagggtttgagtgaaacctgatcacacaagactaacaattcaaggcatagtccattgtttagttgtggtctgatgtagctcattttctaggtggaagttcaacttaacagtctctaccaaaacattggtatatcaaacaggttcaactttgagaacatttcttatgagccatgaaatttggtggggattattagaataaatgggctaggccctaattttctattaaatctcaaggccccataataaatgttaaggataataataccaccctgagaattaaaagaggagtatctcaacttaaatagggagttattggaggctcgctgttgaccggttgaggtggggattagaaagccacacgcgcacgcgcgcgcgccgagccaagccgagccaaccggggcgaggctgtgggcgaggcgtggcgtggcatgcgttgcgtctctctctctctcctttttgcaacggaccggaatccaatcccgcgagattgcctctgtaatggatagttgattcaatgcgattgattgcatcgttactgcggcaacgggcggattcctctcctgcgctattaggaaatagagcaccccgatcagatctcaaggcttagtttccaaacgctggttcttcctcctcgcgcctgtgctgcttctgtttttcccggttctgatcgcttgcgcacacgagagatcgggacgaggagggcctctaaaaccacacattcgcctaagatctgcaccgggtaggcgggtgatcaggtttgcacgactgctcttcttctgttcgtcgtctgttcatctgcatcaccatgtctggagttgtcgcacctagagatggcacacctggagcgggagccggagctggcgccccgatcgacaataccaacggaggcagttctgccacataatccagcggagggactttcacagtgtataactctctaccgctatttctgtttttgttacttctgttagtcgcaatgctattgcgttctctacatgatgatgatgcttattctatcttaagcacgctcctggttatgtttaattttatcactagatcacctcacattgttcatgccatgattattgtcttaatattttggattaaaatatgccgatatatgactatatttccaacagttacatgattacatccttacaaaatataagaatttacatgttattaagcagatattaaggttttaaaaacactttaacactccttatatggatggttaggggtgggaaaatggtaaagatatatatatatatatatataggtcatggttaatgggaccctttactctaaacaatgccacatgcaatcagttatattttaatatgttttaaatgctataagtgcttacctttagcatcaagcatgtggtttccccgccgtcgtgcagctaaagatatatacacatgcatgacgccatcgtgcgtgaaatttcttggtacagactcgcggtggcggatttatgaatttttttttagcctgcacaaacctaatgatagaaaataaattaacaagcaaatacaaatacatatagcattttatcatgaatagaagtaaattggctatcatcatttatatactaaaagtccattaaacttcctacaaacgctctcaagccgccacatggcctcctacaaacactcctatgtcgccacgtggcattttataatctcaccgtcgattttcttttaaattggtggacccgttaattttaagcgttagatctcccttagagaaaaatcatccccactatttttgagaaaaattaccgtatttgctttaactaatagatagaaaaaaaaagagaatcccataataggacaagaggccagtgaggatcgggcagggtacatacgttctttttttttctttttctggtggcatacgttctattttttttcctggtggcatacatacgttactacgttagtatttttttcgcctttttttttggcaaacaatactttttttgctttacacattcggcaaacagtactattactacgatacgatacgtacatgtacgggagtttaggggggaagtgttaatagatataaaatcacatgttaccaatttaagggaaaatcgatggtttgattttttttctcataatttttaatatttattttaatttagagatatgacatgtagtgacctacaagcatttatacgagcgccacgtgccggtttaaaagcgttcgtgggaagttcaatggacttatatatactaaaagacaattaaacttcatatagacgctcatataaacgctcatacatcgtcacgtgacattctataatcacaccgtcaattttcttttaaattggtggacccgttaattttaaccattagatctccatctcaaagaaaataaatctggtatccccactactaacaccttacatacatgaggtaaaaaaaagctgtacatactctttccaccctccgaatctcccctcctctcctattttctagctaacttatcctattttataattaacactcaatatatcaaaaaaataattcagacatctaaataatcataaccctcaagttacaattttattctcattttttgttaattgttgtgttatttataattaaatataaaattcaaaatccatattgatcatattttgttatctaaatattagatcatgcaaccattctaactacaaatgtctaggcctaatggtacacctataaacgcttctaagtcatttgccacatgacactattaaattaaaaaaaatctataagtgtgacaaatgaaaacaaaacatctaaccatcagtttacacttgaatcaatggatgcactatcttatatggttagatctatctttaaaaggaaatcccaaaactccgtcccaaccgtttgtcccgttcctctctccctaccattcattatctgttatttttatctccatagcaactaaatcgaaaattatctttacgagaaaaaaaacacacccacaaatggactccgtctaacaagtctagcgagcttttcctttgccatgtgcttctcttctctttctccttaagctagcacttatagaaacaacctaattagaatttaaaataatcgtaaatttttaaatcttatattcaatttatgacatttttaaactattgtaagtttcaattaaatcaataatttaatacattgtggacccatctattcaccttgaaacctccaataaataaaataaaataccaaaatttctaattaaaaattaaaatatcccaccttatgtttttaatagcagtcaacccattatttataccatgctaaatagctaatggccttcttccaactccttctgttttagattacaagtcattttaaattttgtctatgtcaaattacttgaattagtttataaaaacatagtaacattttcaacacaaaacaattatattataaaaaacatattcaattttgaattcaataaaaataatttggtgttgtaaatattgatatatttttcgtcaacaatggaagtagttaatttctcttaacattcaaataggggctatttacagatacttagatgcgcttttatgaataaatgatcttttttagagataaatagacgttcctaagatcatcatcacatctaaattatacatattatatctgatgtcactaatagattagagtaaaagcttttaattatatcttttttcttgtcataacgtgtaccctgtctaggatctatttgtcatagacaatagattgaaaacaatcaagggatacttttatcccatgccaagttgtatggccttaacccacttatatttccataccaaattgcagagatcaaaacatttaagggatgcttgatggaatggaaatctagaaaaaaaatagaaaaataacatgataaaaataattgaacactgaactttttttttcttctaaatttaactttttttgaatttgaaacccattctaaatagcaatgttcaaatattttaggagtactgatacaatgaaaataactaaaattttaaataacatataatagaaaatagaatttttggcattatgttggaaacaaaatctaacataatttcagttcgaagtatacaactctaaactacaacttgagagcgataaaagtctcattttttaatatattttctgatttagaaaaacttttactgctaaaccatagtttcatactgcaatactatataattacaattaaatcattatttcaacatattcagctcatttaattagatcatgtaatcgtattagccatatttttaatagaaaatatcttcaattgatatatcctaaaattcaaaaaaacatatatagtgcaaaaaaagatgctaaatattaaaaaaataaatgcattatgtacaaatgcattatgtagaagtgatatatagtttcatatatatatttcttataaaaccaaatttgcacagttttaagtaattttagtttagaatttatacgccagcgatgtttactagcattcaaaaaaacaccacacaaattattgaaaaattaaacatgtttacaatagagtaatcataaaaattcctaatcaaatttctaacccagttaaataagatgcccgcgcatatgcgcgggctaccttcctagttatatactaaaagtccattaaactttctacaaacgctcttaagccaccacgtggcactcctacaaacgctcttaagccaccacgtggcactatctaatctcaccgtcgattttcacttaaattagtagactcgttattttacaccattagattagatctattatttaaaaataataacttcctcatatattatataacatagaaacgttaatataacatagaaacgttactgttcagccatagagtttatatacgatacagaacgttacgtacgtattgaaaataaaacaataaaactttcccaatgttacggtatttatttaaaatatgattttctacagtataaagataaaatatatttacttcacaaatataaatatatttagtcaaattaagatctattataaatatccaatcaatgttctttaaaacatcttataaatctatctattatctatcaactatatatatactaaaagtacgttaaacatacgacgaatgcatttacgctgctacgtgtctctctaataaattagagaaatcctagaaatttatttatatactaaaagtgcattaaacatcctgcaaaaactattacgccgtcacgccgtgctataataaattagagaaatcctagaaattcagagaaaaaagaaaggcatatgatcctttaatttttacttaaattggaggacccgttatttaaaatattagtttagatctattaaaaatcccatgctgctaatctctatctggaaaaaaaacataatgtgcgtacgtcgtacgatcgtctccatcctaaaaaaataaaacttaaatacctacaccatatacgataaataaaacagataaagccaaataaataaaagaaaacatgcacacgtacatagaatcggaaagaaatactaatcgtgaaaaatcacactgatgtgttgtcaacatcctttaaactattattttattaaaaataacactacacagatatgcacattaaacttaatctctgatagataaaatgtcaaagcaaccgtctgacaaaacctaacattgtgttttaagtacatctgttttgggttatttaattttggagatcagattctcaaaatatttggatttgttcaaaacttttttattcttatttgatgagtgagaagcacaaataatagatagatgagaaaaattaaattaaattttagacagtggttttgcgataataaaactacagaatttagctttggtttttaagtggatcattttatgtttattttgggtgacattgagattttaagtatctgaaattttttttattgctatttgaggagagagaagcatacatcatagatagatgtaaataaacaaataaacaaataagaattaggcagttattttgctacaatacaatccttaattcatcatgagaattatgattatccatgtatgttttttctttgccaagtagtattggcaaacatgaacaatccagtaaaacacgtataaaactataaattctatatactgagtataattgatggacgaatgttatacacctctgaacccaattttgtcaattctttacctcaaatcaactcaaaacttaaaaataatactgtttttgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttaccaatgcaatcatttgtgagtgtgccaatagtgaattgagtgttaaaattgtactttaagatggtctttaggggcacagttacatcgatgcgaaacccgtgtttcaaggcattatgtaagaaagccttagttggctgctacggtcgacttcatctgttagaaaatcattcatgaatatttttaacggtgttatcgtattatctggtagatatgatatttttagacaatttatacatagatgtgaaaataagttatgcacactgggttatgcagtgtagatgatatttttagcgtataaataatgtatcatttattttagtggtacaaatacagtttcttttattaaaagtgcacctaactttcaaaaacaatgatagtaagtagtggtgacaaaagacgagtttatatatgaccaggacaaagggatttttacttaaatctaataaacattctatcacatttagtaatctataccatctattttacggcaaatatatttgttttttttatttagggtaatctatattcccttacaggatatatgtattaatgtatatactaagatatgatttattttagcattctttttcttgaacaacaaataagatgcccgtgtatatgtgggggtttcttttccgatttatattctgaaaatatcctccattttatattttgtccttacattggttgaaacatagcctatgatacatgcatgcgcgcgcgaatgcgcgggctaccttcctagttagtataataattagtgctaatctaaatggtgcatgtatggagctcatggttagtttctaatgtatggatacatacggtggagcccggatgcctatccgtgctggctgggccttggctccgtcgctggtacagagaatgaggttcaaattagttactactttcgtcccctaaaatatagtaatcagaatatttcctaatacgacaatatatagacaggagatctaccccgattcataatattaagatgtgtcatattctacaaatggagaaaacaactcatgggacatgtatgtgatgacaataaataaactatggccatgtttactttatgtgccaaaatatttttgaagtatatggacacacatttaagtattaaacgtagactaataacaaaataaattacagatttcacctataaactgtaagacaaatttattaagcctaattaatccgtcattatagcaaatgtttactatagtatcacattgtcaaatcatggtgtaattaggctcaaaagattcgtctcacaatttacatgcaaactgcgcaattagtttttttttcatatttaatgctccatacatatgtctaaacatttgatgtgatggaatttttgaaagtcggaaggaaacactgcctatgatgtaggcccccacctagctaggttaagagctgatgtgaaagggatcgatccctaggttaagagctaatgtgaaagggatcggagtgaggttgaacctgccgacatctctgccaatatggtcactctcagtgagagagtttcattctcactaaatagtgtcatgtcaatatttatatgacgtctcttaaaaaaatatttatatgacgtggcaagtaattaataaaaaagagatgaaatgaatttcatctcgatgaaactatttatacaccgttttcaatgtgacttgtttctacatgtgttgcctatgaaacaacaaaaataaaacagtatattgtgttagctatttcaaccatcaattaaatgtcttactacctccgtcccaaaataagtgcagccgtagatatccgtgtccaacgtttgaccgtccgtcttatttgaaaaatttatgaaaaatttaaaaatatttagtcacacataaagtactattcatgttttatcatgtaatagcaacaaaaatactaatcataaaaaaattttaaataagacaaacggtcaaatgttaaacgtgaatagtgcaaaactgcacttattttgggacggatggagtattctttatatgacactcttttttttttactgaactttatatgacactcttagaaacataaaaataaaacgtcccactaggaatgacgttaggccatttttcacatagagttccaagagtgacacgtgcatcaaacaaagaggttcggattaataaataaaacaaacgcttctaacgcatttcgtgatttcatatgctactcataacatttagttgttgaattgtgttgttaaaagagttgataccagtacgatttcatttttaatttcaaggcacgaaatgaaatgattctgttgctgtgggttttattttgtttctaagcattcctaatggataaatgcatatatatgtagtttcatttcttgatttttaggttgagattcctaacagattcaagttgatgaacaaaactaatatatccaatgcacaattttatttcgtggtttgatatgtcgtccatagtattttattattgaattgtatcatgaaactatttggttataataggggtttatttctgttttcaagacacatgagataaaatgaatagggttccattctgtttcgaaggcataggtaagtatgtaaaacaagttttttaaaataaaactcatttcttctcacttgtaaatttcttggcatgtcattagtttagcctatgtgatatcttatttaataacatcgaaactcttgttaaacatgcattggaaatgacctaggtattaaaatttcacctaaatgaaactcattcattttctttatattttttcagtttagccttatcgtttaataagattgaaactcttacgcaacctgtcctgaaactggccttaggttaggtgctaaggagactattagagagagaaagttgagagttcttttaagactatagagaggagagttgacgttgtccttcaataaacatccatgtggacaggagtctgactttctccatagctgtgccaattttatatgttcggtgtacgtgaatatagaagagagggaagcgagagaggacacttgacttcgcccaatgagaaacatcggcatgccgattttgtgacgaggttcggtgttgacgagaataggagggagggagaaaaaagaaacacacatgtagatggatcggactttttatatcttacccttttttaaaaaaatcttattttacaaatatactcttaaaaaaattgttctagaaatgaacatttttctcgatgctagaattattggtctgagattcaatgtctcggtgccaataacattgacatcgatatcctcgcttcttgctaaagctaagtcaccgatacgaaggatcggtgcaaatgacattagtgctaaagatctatttgtaagaaaaaatatttgaattttaaccttttctgaaattcttttataaataaatccttagtgtcagttagtagcagagccaagcctgatcagcatgggctagtggcctagtgcccagtctccgccaaacgaacgcgtgactttccagttagaacattaggcaaaacagtgattacccttgctagattatttggcaaaccagtaaagaatgcatgacagcatgagtgctcgaactagattatctaggcaaactatcgaagcaattaagggcaaagcatcacaattcatgtattaacatatagcccactaattaagtaatacataattattgtccaatcaatctaatctattgatcaaaatggtttttctcttctaaaccacaatttgatagcgttaacttggctttcattaatgatggatagcccatagagttgtatgaatatgtgtgttcattagaattgcccagattttagaaaatatatagatccgccactgctgccagtgttattgtaactaaaaaggattaaaatataaaaaatgcagggtaagtgaagataattaaacaattaactgttagtgtgtagtgttgtttccaaagggcgatttttgttgaaataagacatttatctcaaagttgatacaactatcattagattgcacagccaaagcaaagtttttgggtgaatacacactaataactatcagtttgcatactagattgtgttagattaaataagctggaccaatttaatcctaataaattctatgtgcccataattaatgttaaggaattaatatcacgttgaaaatcaacgtggagggatctcaacttaaatagactgctattggagagcaattgttgagcggttaaggtggtggtggggctgccacacgcatgcgcgcgagccgggccagggcaagggctggctgctctatttcccaaacattatgttttaactaaagatgtaactgatggatgcactcgttactccaacaacgaaacgttatggtttgattgaagacataaccaatggaggtgctcgttactctagcaacagatggggaattcaatcggattgattcgggcgctctcattactccagcaacggacatttcaatctcgacttgattcctcctggaacattactctcttgtacactatataactcccaccttctcgttactccagcaacggaacgttatgttttgattgaagatataaccgacggaggcgcttgttactgcaacaatagacggagaattcaatcagattgattcgagcactcccgttactccaccaacagacagagaattcaatctcgatttgattcctcccggaatattactctctcatgcactacataactcccacctctagaatagacatagtacacacaaatgcccagtacatcttctctctcgaactctgattctcttgttgggaaaatcttgttttctctgttcctacgcttcttgtgtgtctctggttccgatcacctacgcacacaggacaatcaattttttggggagcgcattctagagcgactgctctcatcctcttcctcttcatctactctgcactgctagttcttcttcctatcaaaaggcagcaatggtggaggtggcggcatcgggaccgggcaccggcacatgcgagaacagcaacaccaacgtagacaacaacaccaacaatgcctcatctagtaccggagcattctccaagtaaccatgttaaccatgttattagatgatacttattttgttattgccatgttctgtttagcactatcactagatcattctacacatatgtcatgtcatgttcagtatgatgtttttctgaaaattaaaatatactgactaaatttccaccacatgcgcttgagtgaaacaacctctagctaccttctccgatattgctaacttgccgctgcaaccaaaaacctgtaaacccgatttttttggaggatagcccaaagtatggacccggtagcaaaatattacggctgccactagcaggactagcaggttttcgaattcctccctgacacatgacgaggttgaaccatatgatatggagaacattgcgtgagcagaccggcatagccctatgtatgtacctgatcacgtgacctagaacttgaattaattattctttttcaaccatatattcaacttaatgacacgaaatactattaggccaactatatggaaggtggttgattccaccggacagtgaaattctaccatgacaaactgattacgtttagctttgacggccattaatttttcagcccccaacctgattacagaaataacgattcatctagtgtcagctaaccgacgtgagagacttacgcttagttcacaatcgctatgttttttcaaacaaatttgtcaatactctgaccataaaagttctttataacttaataaattataagtggaaaattgctaatagtacaacagagtcaataatctgaaaagagaaaggtattacgtcgtttgctctgttcaactaaaaccaaatcatactaaggtacgtcgttcggagcgtcacattttcacgtccagttgtctgccaatatcgagcagcaggcacggagcaaattttcgacaagttgaataaaactgcgggtgcaaaacagcggccggccttatgctgaattatttgacgttattgcaacgacagatttttttttaatttagtcattattgccggccggtctaactcaatataggttattttatatattcaagttggtttcattattactgtccctgatgctacaagtgtagaagaaaactgtgcacagtgaaattacactcttagaaccaaagccaagtatcttttattttactttcgataacatagttcctatagattttaacaaagttcatttatattatcgtgtagaatattttctatttcgtattttagttggataccataaaaaaagtggtggagacttgtgccatacatcaattcttttatttatcattttagactgtccataggtggaagatgttataaataaaagaaaagcagtggcgagcagattgcctgaagccttaaaactgagtataagcacattgcgcttcaaacaagagtttacaaaaataaatttcagaagactcgggtacatctaaggtgcaaaagactataggtattttagcatgtgccatataatcccgaggattataatactagtgttttataaaaaccacataatttacgtgtactgtgtgacataacttattggttattttatatatcttagatcataatattgatggttttctgcaatttacttttttttgaaatgattatattgctcctcgcacattcgtaactgctggcttattattgaaaacaaaattattaagctaaaaaaattccatctataaaaatttgaatcagacaaaattgtttgacacaaaattggaaaaccaaatttaaaattgaaattggaggggaaattacacaaatcagtacttctccgcttcttagaatacaaaaagtagtattcttttaataattaacttcaaccaaattgagatgaacataccttttagaatttcatcgaatttgtttaagattcatttcaggatttattaattttttgtttcaaattttggggccaaataattgtacacccttctatttatacccaaaacatgattgtccataatcacgaatccaacaagcattacagaatcctaattacttaggaaatctctcaaactagggaatttctatacaactccaaactccaatattttcaaacatgaactccaattttcatgccgtgacaaattcatcccaaattaaaaaccattatctaaatggaaaaaagaatttattaaaaactaaaaagaaattagaaacaacaaaatacgtacaagaaaattttaaaatttaaatgtagcttgcagtattttcattaaattatccatagtccaatacgtcctcgtgttttacttgaatttttattccaatacgtcctcgtgttttacttgaatttttagagcaccaaaaataattattacacaataaaaacaacgtacagagttttctaagcatagaaactgaaaataaatcatccctcctccttgtgccatgtctagcccagtcttccatcttccctcctttcatgcggcctgcttcggcctccctttctctgggcctcctccacatcatggcccatcccgcctctcgtccccagcccacctgcactgcctccctccctccgcgcctgggccgcctcgcctcccggcccagccgccggtcgtcttcctcctctggccgaccgttcctctctcgctccttccttccttcctcctccattgaagccgccgccaatccgccccttcctgtggccggctctcctccccgacctataaaacggagcctcctccctcccctcgctccattttgccacctcccaaattcctagctgcctccctgtctccaccgcgccacccgagctccggcaacccctgccgccatgctcgttcgccgtcagacgttgtcggttccttccccggcaccgggacgtcaacctcctcgccggcctctctgcctccctgcccgaagctcgttggatccgcgccctcgccggctcccgtgcctccaaccctctgccaggccattgctcctcgccggagtaccgcccggcctcgccgccactcccgtttgcggttgcatgttcctccttggctgccacctcccgagcccttttgggcgccggaacactgtcgacgccaagttcgtccatccttcaccgtgtcagctgtcctagtagcctaccaaagatccctgatgcgtccataatggactctagcatgatacttggcccaacgggcctaaagatggtgacataacacccggacagattctggatgcccattgtttcgatgattttcattgacttcaaaggggttttaatatgagactagattcattagaaaggcggtctagttagctttccatacttgtacagaacgtcgaaaatagagttcagatgagataagggtgatgattttagtgcgggctgctccagtatttttgagatggacttgaatttgatatgagatagacctccatcttgacttgaacgcccatcttgaccttctccatctcctagtctctagttctctccatagttcctaatcatatttaaatcattatgtaataattagtcctcaaaatcatataaaagaaatacctaggaacgagctcacatgtaatttcaattgttgggcatgagctctagtgattagatcttgcatagcaacttgaggaatattgtgtgtatccaaattgttgatgtctccatcatcatccccctcatgaagtagagtcgtcctcgacccaagcttatcttcttctctcaaatatagctccaaatcgaaaatgttaaatgtgggactaacctcaaactttagaggcaattcaagtttatatgtattatcatttatcttttccgatattctaaaaggcccactggctctagacgccaagtacaggaccgctggttagataactctacattgaaatgtcatttttgggagttaaattgctaatagtgttgaatgatgaatatattaatttgaaagcacgtaaagtttttatgagagcttcggaagttagagaagcatgttgattgaaacaatacaagcaatatgattttacatgccaatttgacctccctttatagtatgtctgattgtggcaacatttatttaactgtaaaattattgtagtgaaccagcgccgctacggctgggaaggaaaccagaggtgcatcgctgtcagcactggcgtcctgtccctgcatcatttgtccgcatcgcgtgcctgcagcctgttagagatagaggtttgttacatagagttgttacgtgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatggtatcagagccaatcatgcacgcgtgagatcgcatctaccaaaaatggcgagttcctccaattccaccaccaatccactctccggccaagttgtcccagagaagctcacaaggaataatttccttctatggaagacacagatccttcccatcattcgcggtgcccgcatggaggggtacctcaccggcgcgactcgcgctccgtcggcagcgatcgacgtcaaggaaggcgacaaggtcatcaccaagatcaatccagcctatgaggaatgggttgtcgtcgatcaacaggtgcttggatttctccttgcatctgtatcaaaggacatactcacccaagtcgtcaatctggaaacggcggctgcgacatggagagtgatcacaacgatgctctcctcacaatcccgtgcgcgtgctctgaacacgcagcttgcactgttgacgacccgcaagggcgatctcagtgtcacggagtacatcggcaagatgaagacgctagctgacgagatgtcatccgccggcaagcccctcgatgacgaggagatgatgtcgtacatcctcgccggactcgacgacgattatgagcccgtcgtctccactcttgtcggcaaggcggaggctgtaccagtcgccgaaatctacacccagctcctgagttttgagagccgagccaagctgcgacagcaggctaatggttcctccgtcaacagcgcacgacgaggaggcaagggaggcggcggcggcttcagcaacaacgtcaacaccggcaacaccagcacgtttcgcggccgtggcggtggtcgcggcgatcgcggaggccgggggcgaggaaacggtggcggcgcgcgcttctccaacaaaccgcgccccacctgtcagctatgtggcaagattggacatgtggtggcagactgctggtacaggtatgatgaaaatttcattccagattcaaaaacagcagctgcggcttcctatggtgtagatacaaattggtacatggacaccagagccactgaccacatcacaggagaactggacaagctgacaacccatgagaagtacaacggcaaagaacagattcacacggcaagcggtgcaggtatggacattaagcatattggtcattctattattcatacccccatacgcaatattcagttgaaaaatatccttcatgttcctaaagctaaaaagaaccttatctctgctcatcgtttagccgttgataatcatgcctttgttgaagttcatcctcgtttctttgccattaaggatcaggtcacgaagaatcttcttcttagaggaccgtgccgcaatggactgtacccgttgccaacatcttcattcgccacatccaagcaagtccttggagccatcaagcccacaatgtcaaggtggcatagccgtctaggtcatccttctctagctattgttcaaaaagttgttagtaggaataatctcccatgtttaggagatgtcaatgagtcaggagtctgtaatgcctgtcaacaggccaagagtcaccagctaccctatccaaaatcctttagtgtgtcaaataatcctctagaacttgtgttttcagatgtgtggggacctgctcctacttctattgggggcagaaagtactatgtcagttttatagatgatttcagtaaatttacttggatctatttgcttaagagtaaagctgaagtttttcttaagtttcaagaatttcaacaacgagttgagcgccttttcaatcgcaaaatcatctctatgcaaactgactgggggggagagtatgaaaaattgcactctttcttcactaagattggtatctcacatcatgtttcatgtccctatgcacatcaacagaatggttctgcagaacgcaaacatagacacatagtagaggttgggttggctctcctttctcatgcttcaatgcctctgaaattttgggatgaggcgttcctagctgctgcctatctcataaaccgcacacctagtaaggtcattcagtatactactcctttagagcgcctccttgatcaaaagcctaactattctgctcttagaacctttggttgtgcttgttggcccaatctccgtccttacaacaaacacaaacttcagtttcgctccaaacaatgcgcttttcttgggtatagcaacatccacaaaggttttcagtgtcttgatatatcaactggcagagtttacatctctagagatgttgtatttgatgaaaatatttttccctttgaaaggttacatgcaaacgctggagcaaggctgagatccgaaattcttttgcttccttcctccttatatcaaaatattgcaactaatggggttgaacataatgaccgcatgcctaatgtccctgagcaatctaatgtgcctgttgagcatgtgacagatcaggagatacaattcggagaaggttcagaaaatacagcacaaaatgatcacagttctgcagcaaatattgaaggagatgcaccggatctggatgccacagaagatcctgaggacatttttcctggcagcagcgatcccgagggaggatttcagccctcacctgtgcacacgcctgcactgtcttttcccgacgatgaagaaatcggcgaaaccggtggcttgacgtctctgcagcagggggagcagtcgcatgcagccacgtcgtcaagcagccatcatgatggggggagcggcagccctctgaccggcggatcgtctgcacccgacacagccgtggctgagcccgcacggccggtcactcgtcttcagcgaggtataagaaaacagaaggtttataccgatggtactgtaaggtatggcatgctgacaactacaggagaacctcaaaacctagatgaagctttgactgataaaaactggaaagatgctatggatgctgagtttactgctttattagaaaataaaacttggcacctaattccacctagtcatggtaaaaatgttatagactgcaagtgggtctacaaaattaagagaaagtctgatggtagtctggatagatataaagctcgtctagtagccaaggggtttaaacaacgctatggtattgattatgaggacactttcagtcctgtggttaaagcagctactatcagaactgtcttgtctattgctgtttccaggggatggtgccttcgccaactagatgtgcaaaatgcttttctgcatggataccttgaagaagaggtatatatgaggcaacctcctggttatgaaaataagagtaagcccaactacatttgcaagttagacaaagcactttatgggttgaagcaagctcctcgagcttggtattcaaggttaagtactaagttgattagccttggcttccaagcttccaaagctgatacatcattgttcttttataacaaaggaggtgttacaatttttgtacttatctatgttgatgatataattgtggctagttctagacagaaggcagtatctgctttgctggcagatttgagtcaagaatttgcactcaaagatttgggggatctgcattacttccttggaatagaggtcagtacggcaggtgatgatattttactgaaacaagaaaaatatgcctatgatttgttgaaaagagcaagtatgctagattgtaaacctgttagtactcctctgtctgtatcagaaaaactgtcagctcatagtggaactgctctaggagaaacagatgcaactagatatagaagtatagttggagctcttcagtatctgactttgactaggcctgatatttcatttgcagtaaataaggtctgtcagtttttacatagtccaactatagatcattggatggcagtgaagaggattttaagatatgtgaaattctcagttgatcttggtcttaagataagtcgttcatcatccactcttgttagtgctttttcagatgctgattgggcaggatcaattgatgacagaagatcaactggaggttttgctgtgtttctggggtcgaatttggtttcctggagtgcaagaaaacaggctacagtatcaagatcaagtacagaagctgaatacaaagctgttgcaaatgcaacggcagaggtaatgtgggttcaggctctacttaaagagctaggaatagattcacctgaaactgcatgtatgtggtgtgataatctgggagctacttacttggctgttaatcctgtgtttcatgcacgaactaaacatattgagatagactatcattttgtcagagaaagggttgccagaaagcaattagaaatcaagtttatatcttcaggtgatcaagttacagatgggtttactaaacctctcggtgctccacaacttaggaatttcagatacaatcttaacttagataagttatgattgagggggagtgttagagatagaggtttgttacatagagttgttacatgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatacagccatcccagtaagatcccgttaatcatgattcacttggggggaggcaaagcaggaggaagatgatgccaaatttgcattcattttaatagatgttgataatttgtttcacctctctgctggaaaagtttaagaagcattcaatgtttaagaattaattttcttttgaaaagaatcagataattaactacgagcaaagaattcagcaaacttcatgtcttcatcttaacaagccagcccaaagtttttagatttaattgatcaagatttcattctgtttttgtttttaaattcactgaaatatttgtttttggttgtatgcatatatattaggttcagtttagtagaacaatcctatatgcctggagtttcgaactttcgatggcgacatggcgtgtttgcagtccacaagctttcctgcttctgcttgtatggtttgcttttgattgtaacgattttggagcaaatagagcactgaccatcgtgtacagtactgagatccgcggaacgaaccaatgaggcgcgcatcggcaatggacctctcgccctcttcaacaccatcgccgccgtcaaggtactgcaatatccacgatccaacaggatggcagtgagttgggcttgctggatgggatcatgtgaagcttcccccacacatgtttttcctacatctctattcattgcaaaaaaaaaaaaagtgggctaccttggcattgaattagcaattactagatgttattatgagaatcagagagcgagaaatgaaattatccttagcaatattgccagttgactgacaattctaattgtgaatgaaggaagtaataactgaggcgtacgtgctgccatgtatatgaatattcatgtagtacatttccatttagtttatattttttgaaattttgatatactgcatttggaaccaagcttcttgttttatttaacaaagagattcaagaacagtttctgttttatttttgacataacactcagtaatattttgaagaacagttatatcactgtcgttatgaattggaccttatcaaagtaacaacaatactcggttatttgcctcggtataagtgagccgtaacactgttgaatctttcctagttcagtagatttctctcagttcctgtaaaacttttgattgaatactctggtgatgttcactgggcaaagagctaacttccccataacctaccttggaatgcccctcacgatccacagactcagaaaggtccacgtgcagtacctcctagacaggattaaggcaaggctcgcttgatggaagaaaaaattactctcagcagggggagaagagaattagtcatagcagtcttaagttcaatgccgatctatatcatcacagcgctcaagatccacaagcagctcatccaagaaattgacaaagctaggagaaaatttctttgggacagaggcgatgagatccatggaggcaaaggcaaggtgaactagaaaagggtctgcaggccaatcaagtatggtggacttggaatacctgatttgcaaaaaaaacaggacacgcaccctggctgcgatgtctatggtacgagcggaccagcccgaacaaaccatggataggcacgcccacaccctagatgaacaagataaggagctctttgctgcctccaccgaggtcctcgtgggggacggccgaaaggcactcttttgggaatcaacctagacctcgagcaccccccccctaagaacaattgcctcaaatctatacaagcactcaagaaggaagaagcgaatagtggcagaggccctaggaggagataaatggatggatgatatcagacacaacctgaccacaacactcgtcactgaattcttcaaagtgtttgaatgtctgtggaccacaaacaccatactaactcaagggactgaagacaacatccgctggaagtggacagaatcaggggaatactctgccaaatcggcataccagatgcaattcctcgacggagttccctcgatcacgacaaatgtggtgtagaaatgttgggcaccaactgcaaaatgcaagtccttcacatggctgctccttcaaaacaggatccggacgacagataggctccaacaaagagaatagcccaatgaatatttttgtcaactttgcttgagaaaccttgaaacggtgcaacaccttttcaacgaatgcccgatgaccaggaaaatctgggatgtggtggcaacgcggatgacctcccacagctgaaaaccgcaaaactggttcgacacgtcatccctcgaggaatggtggtgccagagtgtcaaggctgcaacaaaggagaaaagaggggggggcatcaattagatcctcatctcctaggaaatatggagagagcggaatagtcgcgtcttcagaaaagaagaactgtcgctgcaacaaataattgaacggatcacggatgagatctggttatggccggcagctggtgcaaagggcatcaagtgtctgatcccaaacacccaagacgctatcagtagcctgtaacaaaacatatgtaattttaggcatgctaggcatcccgtggtcgcccttccctcctccctcctctttttctttccttccttcttttaatgtaaccttctagcccttggctattgtacagtttttccccctaccttaatacaaaatacaagtacaccccgacggggtttaaaaaaaataccctggtgatggtagtaagattatgccctttctattttggattgagatgaacatatgcttgatcatgttcacttcaatcaaaacaggtgaaatgtgtgggatattgtgtgagaaacaactttgaatgtgtacataacttagctttccttgaatttaactttattgagttttactatggtgctcaaatctcttttttcatgccatcagtggttgtggacatatattatgattaaatatgtattgaagtgattacacataattgtgatattaaataaactttttcaaacaaaaatatgatatgttttacttttccttaaatatatttcatattatcatatatgacccaaatcaagtaaagctcatttggactgattagagaaaaattaatttgactaacatgcaaattaatagtataatttattagccaaaatattattgtgtgtagtgttagcacagtatattaatagtcacaatgtaaaatgtgacgacgctagcatagttttaattttgtacgaatttgaatatcatgtacatgaatagatgaataataatgacgctatataaatgacatatttgtaattgcatggattaaatgacatatggaccatccctattttttaatcacccaggtagacatccacacatttattcagtggcggagctagaaccaaattgagggtggtgcactgcttcactatatagatggtggcaattactctaaataatggtttttgaccatttatagatatctattgacaccaaatcattgagtagcaagtaaaagtgtttacagaaatttaagatgaaagaaaccacgaatggaaacataaagaaagatatacatcctcgacattaaagttgtcaatgtcaatatcatcgatagttcatagcctacaataataccagaacataagttagaaacatcttaattttgaactaaaaatttatatccaatgaacatgtaaaaaacataaaaataaatatgtttagggtttagggtttatgttccaatgaacacaaaaagatattgggactatcgggcgctttcctcttgagatacttgtccataacatgtcaattaaataattttattatgttagactatacgtgcactgtacaatagaacaatgtacgcttcaaaagcaatgatagtttgataatagcatagtgtcacagtgtgcttacaattttactagtgatggtcccttcaagagagatgatcaattaaaactgaaacatccagttcttcaaactttaaacggtttaaacactagcttatataaatctggacaattgaaaaggcagtatatgtcaacaggttacaaatctaactaatcaacaagttacaagagaggaggataaattcaaagtttagaactaatcaagagaattagagaatgaataatgataaataccttcatcaatttcaatttggctgtgctgctgtgcattgctcggctgccctagtgccctgctttgcagtccagctgctactgcctgctgcgagcctccgctgctccctgtctccctgttgtctgtcgatgcacgcagccacgcagccactgcgatggcgcgatgcacattcacccgccactacctgcggcgctgctgcctgtcgatggtgcagctggctagagagactaggtgggcgacggcgatgctgcctgctagtgcggcggaatacggatgacgaacagacggggtatcgtggagacgcggaatcgcggtgggaaaaagaaaggaaaaatataaaagaaaaacgggagacgaggagttcagaggtgcggtgatcgagcgagcctcgcgggtcgcggcgcgtcgctcctgggtgcgtgaggtgcgccgtgcgcctcccagctttcctcatgggcctaaggccttcacttgttcgctcatgggccatgggtggtgcacgatcttgagctaagaggttagtccacttagactcccttaaatgtcggccgaatctaaatcgtaacccttaaccaaccggataaaatgactctccgacctattgaaaccggtgcaatttgactccctgggtggttttgcaagcggttttggctgacgtggcgcatacgtgacggtgttgacccggtcttcgtcccacatgtcgtcgacgtgtcgcttacgtggaattagagtaaaaataaaaaaacaaaattctgtaggccccacatgtcattcacacaaaaaaagtgggacgctcgtcggcaccaccatctcctcctcgtcgtcgtcgagcaacacctccgaactccggccaaggagagctcttccagagcaagagtcgacgacgacaccatgcgcgtgctccatcgccgcctccattggtgacgatgtcctgctgcttcatcgccgcctccagcgcccacgccgtcgggccgctgcggggagtcttggcggcatagccagcggacgaaggaggcggcctcgcgagcgcggcagcgcaagaggaggtggccaccgccgctctagcgcccacccccctgcccgtcgcagttgccgccacgcccgacccctctcttcctcttgcagactcgcacgcaacaccggccccggaaggtaaagagaggggggccactgccgccgtcatcaccaccactccgcccggccttcgccaccaccgncgctagcactggatcttgaagttgcggggctacggccgcgccaccgggaccaggaaaactgcggcggccaggggccgcnccgagaagaccttgccacccgccggtctagcggccaccccccctgcccgttgccggccggtggcacccccaaccccttttttcctttttgaaaactggaccgcacaccaacccccgggaggaaaagagaga

SEQ ID NO: 61409 - DNA, 13746 bp, Oryza sativa
cattttgaaacggagggagtactaatttagggtctgtttggggaagtttctagctgctgcaacttctcccagaatcagaagatctccgaatagtcaaggttttggtacatattctgagaagttatagttgtagaatctagaaaatgaactagaagtcagaagctaagaaatccagcttttctaaattcttagaagctggctacgaaccagctgcttctccgaatcttaagctcctcaaatagaccctcaatctgcatccctgaatcgtataagatataaagtgtaattactatctacgatgtcaacttaaaaaatgtcctcaacagttagtaatatgcatgtatgagagcaacttttgcttcaacataccgatcctttacatctctgaaaactgtaaattggtggtaatccaaattaaaatagatttacgactagagcttgtagtcaaccaaatagggataagctagagtgaatatagccaagctcattcatcacctgacatgagatgtattgcaagctagtttctgttagcaccttaagagcttcaccctagctacacataggacaaatacaattactagtactatcaatacaattcgaaagaatgcaacacgtattcctcatcaattaagatgtcggccattctaaaaagtaagcaaaaacaaatagtatgaagcaattttgttagtgcatcgtactctacaatatgtgataatttgataattaatcaactaacattgtcaaaaaaaataacgtaattctaggtcaacgacatcttctaaaactatatcgtccaaaccacgtggagatgttcgtgactactattatgtcataatttgaaaaaaaaaaccctcatattgtatgcatgctcctatgtagtgaacataaacttcctgagtgaaccccgctctaccaaaaattaacacaattccagttcaacatgatcttgttgcatcttagttggttagtataggcactaaaccgtccaagtttgacaaaataatcaactaataatgtatacaagccattgcatgtcaaaactctaaaccttaggaaacaaaccgagtagatctattggcaccccatatactgacagcggaaaccctaaacactgaggaaaaaagagtatcgaaacccaaagaaccatcctcatacaatctagagaggtccactctatcacagtgtaggtcaaaaccttaccttagacaagaaaccaagtagatttgttgccaaacaatatatcctgccatcggaaaccctaaaccttgaactaaaaaccaagtagatctactgccacaccctacacacatgctgctagccaaaccctacaacagtcactatagaccgagttgatgtactaagaccccaaaatgaactacaaagcaactaaaccggatggtgtaagcgggacgatgtacctggataatgagccggtggagggcactaacgacgatggttgtctcaaatctgtgcatgggtgctggagacccacatggagcctaggggcatgggggcaacgacgagtttggcctcccctctgacgaaggtcgggtgagctcgagctcggatgggctcgctagccgcctcccccttcctctcccgccttcctcgcgtggaggccgggcaaagctcgagtttagatgggcttgttggctgcctccccctccctccaaggctcgccggctgcctctccctccctctctcgcctccaccttcctagaggccgggcgagctcaagcttgtacatgctcgctatccgcctccctcgttgacaacacctgagctgcgtgcgtggttcgaaagaaaaggaaagaaagaagtgggcgctaacacacgggccctgcatattttttcttctcacttgcacatgggccccatattttttttattttctttttactaactaggatgccatatcaacaaaaatagatatccatgctaccatgggacccaatttaacttggttttataagttaaggggttataaaatttctagtattgtgctttaggaatgtcgattaaactcggtgtaaagataaggaagggcaagtagacttatctccttacaggtgtaaccaacaatttagtactgtatagtccaaacggccgattgctacagctgacatataaacaggggctagcccaaaacgagtccatctacacatgaaaacctgtggcaaccgaacggtatatgtctgtaggaaaaagtacaccgaagatacctcaacttgtcatcgaattacaaaatcatccttgaaccgtgaaaccggatacaacgcttccctcaacttacaaaaccagtataaactaggtccctcggcggttttgactccggttttatccgacgtggtagctgactcagcgtgggacccacgtgggccccacactcagggtgaccacatcatcatgtctttcctttcttctctcttagttttctcctcatcccggccgcctggtggggcgatgtgggacagggaggccagcgacgggcggtgcggtggcgtggcgacgcggcggcggcgggccgggagcaggcgggggaagagctgtgcgtgggcgacgggcgacggaggaggagcggcagaaggcggagcgtaccccggcctgtgctgctgcttgtctctccctcttgaccgcatttctctctggctcacggtgtcgctgctgttgcaggtggcggagcagctacgggcggtgactgcgcatcgccggaagacggagcgtgccgagggggaggtgctcgccatcctggagtcctagggcctcgcccacttctccgacgccgcggattccggttcaggttccgacgatgaggacgacttctagtctgccgagagcggcggcaaggctcgcggggaagcggaggatggatgccggggtctgaacttggaagcagtgctactgcggaggcggcggccagggggctgtcgtggaagggccgcgccgcgagccacgagtcgcagaggcggcagcagcagcaactgcgtcgataatgatgccgccaccacgagaaagggcatggtctcggcttcatttccggtttgtccgtctagctaagaagctcatcaacggctgcaacggtgcgctcacttgcgcccagctgcaacggtgcgtccatcgcctgtagccactgcgccaaactcatagtgttgtcacggtgcgtccacctctgcgtagtgcctacccaattattgatgcaaaaagtacacactggcctaggagatctgcttagctccaatgcaggtccaaaggttgatgagatgcgggcgtgccagtcagtttgatcctgcaactgacaagatatacaaacaacagatcaataagccgattagctgtcaagccgatagagtaattccaaccgataccgataccagccgatagcaataggatttcgagctatcgaccatatgtccaatgtatattccgacacttgatgtaaataccaataaaaaggcaatcggctgatgataatataatataacaacaatataatccagtagaaaccaatcggctaaaaatgacatgatagaataagcactgatccgaaggttaaagcatacatcggctagaggtccgatgtcataaaatccacaagattagattaaacagtaaaatctttattgccattggctaaatccaatttgtatgtaatccttgtaagccgatgcaatatccagataacttatcggctgaaaccccaatgaaacctttattagcagtcaagaagcaggctagagattatggttctaaacacgacttagtatatcaaacttaactgatgtaacactaagtatgaaaagaaacacaatatctagacaattaagccgttgactaattttcagggtggtagataccttatctaatttaatctagtaaaacaaattagtcgataccagcagaaaccctaaagcaagaggcaaccgatagagctaaattgagatactaagactagattaactaaaacatatgataaataggcagacaaatatatcatccaaactagagcaatccaagaggtcgaatgtactgatgcagccttgaacgacggcaacatagactatacaattgcctgggccggcggaacattggacttacccttcgtcggagatcgaaaagcgatgcagccccgcgtcaggtgccaagtcccgtcggacgataaaataaagtagaaaaggtaaaacatagcgatgcgccgaattgtattgatcgtggagatatatatcgtttacaatgaacccgtgtgtacatatttatacccatggagagatactagtccttgtaggacaagaaagaaactttcctaaagacaaaaggaaaacataaagtctttataggacactaaacacactttgctaaagataaaaggaaactaataaactattcctaattaatagataacttgccatgccgcatccttcttgaactcggccacttctagataagctttctttaatagattaatttccttcaccgaatatagcaggaacccgactattgacgatgtgataattctcttaggggcttatcaaatttcactgttaacaccaatcccaaagtaatacgacgattaagcaattcgttgtctgcgtggtcaaaagctcgggctttatgagcatacacgaacttgtggatagtccatcaaattgaattaatcggaggaagggggaagaaaaattaggggcggaaggagaaagagagagagagcgagctatactcgactatggagaggagcggcgatgatgcggtcggtggaggtcgggatccagtgcagcgcggacggccacgccctcccccacctcgaccccgccccgggcgtcgcctccgctaacgccgtggcggtggcggcggctgtggatatcctcgtcttcgccgtcacggccgcggcggctgctcggtgcatgcaagattctcgaattttccctccctcactccctcgatcggtctctcacccttcttctcgcggagttcttggtggctttgccgccggcagaatcgagcctcgccagccgcccagtggctcccccgccgctcgcgcgctgcgcctcctcccgccgcgcaccgcccgcctgctcctggcccgccgccgctgtgtcgccccttctcccgcgtcgccgcgccaccacaccgccgggcggcatgaggagaaaactgagaaagagaagagaaacagagagaagagaagaggggaaagagatgatgactaggtctgacgtatggggtccacgctgagtcagctgccacgtcaaataaaaccggagtcaaaaccgctaaggaatctagtttgtactagttttgtaagttgggggatgccttgttagttttgtaagttgggggatgccttgtatccggttttacggtttaaggatgattttgtaattcgatgacaagttgagggaccttcggtgtactttttccatgtctgtatgtatagtctcggccggccgacatcgggagctggcaacagacggttgccctcacgcgcgaattcacgtgcgcgcggcttctctgcagcctgcatgcaggtactcgccgtactgcatctcttggagtcatgggcttggcctccaccagatcgtcgcgcggccacccgaggcctcggccggccgcgttgctggaattatagatggaaaatgatacgaaaaatttccgaccatatcaatactgttttcgtttccgtaaacaacaataataaccaactaataatagttttttattgtttttactgtaaaatttatttatttttcctctgcatcatattgaaattataactaaatatctgataccacttctataaaaaaaataaaaataaataatgtcatttccgacgttttcatccatagcttgattggaaaggttgggttcagctgacctgagctcaacactattagtagtggttttagtttcacggattgttaatttacccaggcttccgtgtgttgattcatctgatcgatcgctacctctttcgctgtactccgtcagtaccctgcatatgcatgttccagagctggctgtaataccatgcatcccatatcgtgcatgaatgtcgcgcaaccatgaagtcacgcagagacagatctacagcatatgcattggtgtcaggcgacaccgatgactttcaacaaaatcatacttaaactgcttatccatatattataacactatcatctaaatataattagcacactatgataccactaaacatattatgacaccaacaaactaattttctggatccgtcgtcggagtcacgcaaatgcatgcagataggcctggaaattcctccatgctattgaaacagaaaatgaaaatatttgagagaattgaagccattaagttacatttatgtgttgccgctgctgcgttgggaatttgggaccgtggcgatggacacgacggccgacgttcgtacggcgcatgggtgggcagccggccggcgatgggcacgtacgtggggatggggacggatccagagcatatgccacgtcgtcggcatatgcctgcagcctgaatactgctggatgaacatgcatagtatgatgcagcatgggcggactgctgcatctgtaaagtttgtcaaaactttggtttggcaaaaagtttaatgttgtcaaaagtacgataagaaacgaagaattagcttcaatccaaacgagccctaaatataatcaaaagcatacagagcagcaggatctgcttactgaccccgttttcggtagctgcttccagtatgttcagtagtttatttttgtcctccgttgccctggggttggttggaccgttttatcaatgctgtctactaatttttttccctcttggctgatgttctctttataattcttaacgttttaaattatgatatgatctttaaaatatattttaatacattttcccattaatatatatatatataataataaatttttatttttattatagtatttcataaaagaatctatatatgtttctagtgtcattatactaaatattttgaaaactattgatagtcaaagttaaaaagaaattgatctcgatcaagattacccaaaacaacaaaaattataaaattagatggattagcttattagctccagcaaaaaaaattaactttaaaattgaatttagagttcttccattgtaatttatttttcaacattcgcttttaaacatctaataacacggatacaaatgttttacctcaagactgaaaataaatgcaagttcttcggttggctcatggtccatagaaagattctcacagcggacaagctcctcctccacggctgggataacagccacatttgcctactctgtggagtggagccagagaccgccactcatctactcatggattgcgccttttacaaaactggtctggagatccatatggcagaaagccgggcttcatatgcctatggcttcctcctttaatggggatatgcttagctggtggacagcgtgcagaagagaaatgatcaaggatcaaagaagaagttttgatggccttttcatctacacagcctggggaatttggcttcaacaaaatgcaaggatcttcaatggtgcctacagcacactaccgcaagtcgttgactctatcatcgccatgcgcaaagcctacaacggagctcatagtttagatgactagtacccggttcctctttttggttgctatgcattgcctgaaaatcctcccatccgttttttcttgtttcccgggggatctatggtttcctcttgttttccatagtttgtaaaaactatatatctcttcttcttcttctataatgaaattggcagagctcttgccgtttaccctaaaaaaatgttttacctccaagttttatgactttacccctaaaattgctctagcatttttatgacttattatcagtcacatctcaaatgatctatttttcaactagtattgtctatcaaaaatctttataatataaaacaactattgtagatacaaaagcctctgcagaaacaggtaggaggtcaaagcctaattaattaagcttggcaaccatcaaattaaaccaaaccggaaccgaaagcaacaaagctatctactgacatgactaacacaacctctagaacgagtagagtttagctggagaagaaattaaggacctgtttagtcccacctgaaaattttttatcctcacatggaacgtttgaacatattaaatataggctaaaaaataactaattgtatagattgcgactaatttgcaagatgattcttttaagtctaattgcttcataatttgacaatgtggtgctacagtaaatttatttgcttaataaattcgtctcgcggtttactaacggattctataattagttttcttattagtgtccaaacacccacacgacaccctatgtaatatctgatgtgacacgataaaactttacacctctatatctaaacacccctaaaatagctgcgcatatctgcaccagttgagacgaccatacaaaaattagcttattggtagtacgtactattaccaataagctagctacgtactccctccatattttaaattttaatgtataacgacgttgactttttaaccaacgtttgaccactcgtcttattcaaaatttttatacaaatataaaaatacttatgtcatgcttaaagaacatttgatgataaattaaatcacaataaaataaattataattacataaattttttgaataagacgaaatgtcaaacgtttgttaaaaagtcaacggcgtcatacattaaaatacggagggagtacaagacggcgttatacattaaaatacggaggtatacattaaaatacggagggagtacaaatatctctctccctttctgcatgatgcaattacttctatcaacaacatctatactcgcagcctatcatcagtcgcctcagtcgttgttaataaagcctggaagctgggaaacgtactacactatctcgaaaagcatttgtacaaccacacacatacgacacgtctcattcgatcgtggttgcgagcattgtgacagttggttaggcgttgtgcggcggccagctagaccgaatttagagccccagagacaagggcatcgctcacattgattttgggacttaatcgagcacaattgctagccccctcttcgctcgtgcctattatttctatgttcttggtcccaaccgtgctctcattggtaggaccaatgttaaggacgacgttgatggccatctgtgtgttcttcagtttaattaattaactgtgtgtttttaatgatttcgatagacataagtacataaccatataatctgacattacttgaaaaagcaattttcccaaacagccttttcatttctctactattataaaaattgaagatgtttttgtcggtattttggtacgtcgtccgagcatgagtcggtttttaaatttgttcgtttttgaacatacatatccgtatttgagtcggtttttaagatcatttgcttttgtaaatacagaaggaatcgtataagaaatctcttttaaaaaactagcatgctaacttaagatgaccgcacttctaattgcagctcatgatttattaaaaatatatatatgcaaacgagtttccacggtagatttcaccataactaaaacgtataacaaaagaaaagacctaaagaaaagaactacgccatgagctagctagctccatttatgcaaggaaggaccgaaaggaggtagctagtgagcactaaccagtgacagtgtgacgacttctacagtgaggctgtgctggtgcacgtactacggctttagctcctggctcgatcgtgttgtgatcaacttaactcgggctggctttgcagatactcctgcctttggccggcgacaataatgccgcccatattctgttcgtgcaaccaccgcgtcggggcgatcctattacatggccccatgtcgttgaggcacagcttgtgatttctgaatgactctgttgtttgtttgttagtagctataacgtacggcaagaaggtgaatccgccgcatatactgatcgatgtggaggttggacagatcgatcactatggatcaaacctgatttaacttattcgaacccgcagaattcttcttggcaacaacatggtctcatcgaaaatcaatctcttttcagttttcaccatgtcttcagcttttggacacgagatgtgtctgtagtctggagtgtgaccacacttgccagtacagctacatttacatagcgttgtgccgctacggtgagggccacctatctgacgagcatctgagggagcttgctaggggcagaacagtgcacaccaagaggagaggctccctcaccctctcaaccctaaacaccagcctgttccgctgtagcatttgtcgtcggtcatgtccctgccatgggtgcacactactgtatacgacaccctggaaggatttgaacttctagttgttttagcttatatgaactataattaagtagagtactaggtagcctataggcatgttttgatatgtttaggacgtcatctttgctattcatccgtcgatgaaatttggggtgctcattctctccatcttagatggcgtgtatgtgggtgaggcaagaagacaggagatcacaaagggaggaagatggaggcctcacaggcgatggtgatggcaaaaccgagcattggtgctgatgagactcctgttagagtttgtgtcgaataaaactagtcatttgagttgtgtagatccagaatctaaagttgtgattttggttgggtctatggtggagcaggtccaatgtgactagggtggtcttccgttggtgggtttggctgtgcattctaacaaatggtatcaaaacctgcaggagatccattgatagaggcgtgatgaggtgccccacagtgcgccgctcgcaggttatgcccagggagggacatgtgcacaaggtggagcacgtcggcggatctgtggatcgaatacttcaggtggcgatttgaaccgttcaatggctgccttcaagcttttaacagtgagatgactagaagcaattgatgacacagaagcaattggcaaactgttgatgtgaaaaacacacactggcctgggagatctgcttaactccagtgcaggtcgaaaggttgatgagatgcaggagtgccagtcagtttgatcctacaactgacaagatatgtaaacagtagatcaaatagccgatcggctgaaaagctgatgtagtagttccagccgatatctgataatagccgatgccgataccagcctatagcgatagggtttaagcaatcggttgtatgtccaatgtagatactgatataaaggcaatcggctgatgatgatgtaataaaataacaatataatctagtaaaaccaatcggcttagcaatatgatataatagaacaagcactgatccgacggttaaagcatacatcggctggaggtccgatgtcataaaatccataagattagattaaatagtgaaacctttgttgcgatcggctaaacccaatatgtatgcaatcctcgtaagccgatgcaacgtctagataactcattggctgaaacccttattggcaatcaagaagcaggctagagattatggttctaaacacgacttagtagatcaaacttaactgatgcagcactaagtatgaaaagaaacataatatctagacaatcaaaccgttgactgatttttcagggaggtagatgcctaagctaatctaatctagcaatacgatttagccgatactagcagaaaccctaaagcaagaagcaaccgatagaggtaaattgatatgctaagattagattaacatagacatatgataaaataagtagacaaatatatcgtccaaaccggagcaatccaagagatcgaatgtactgatgtagccttgaacgacgctgatgtagatgagacaattgcctgggccgacggaacgtaggacttaccccttcgccgaagatcgaaagccaatgcagccccgcatcaggtgccaggttccgtcggatgataagtaaaaacctcggtaaagagggtggcgaggcgctgagagtagttgtattgatcgatagattgatagattacaatgaccccgggtgtacatatttatactcatagggagatactagtccttgtcggacaagaaagaaactaaggataaaaggaatagataaagtccttataggacactaaacacactttcctaaagataaaaggaaactaacaaactgttcataattaatagataacttgccatgccgcattctctttgaactcggtctcttctggataagctttctttagtagatcaatttccttaaccgaatatagcaagaatccgacaactgacgacttgataactctcattggctaatcttaggacttcgaagccgatgctgactctaagtcgatgattactttgggtttaccaaatttcactgttaacacaaaccattcggtggaatttgacactttcgacaagtggcttgaattttttggtgagctactcccaataggatggcgtgtagccacatcctcaggtcaactgaagctaaaggaggtcggcgctctcgattggtggaatcaaatgctccggattgggtggcccgggcgctttcggtgaactgtgttcgatagggagatgactagacatagcacttgggtcgttcggtggctgggaagatgacatgcgatttgtcagcttcagctcgtgactagattcattgcgttcaattggaagtcagagcaggtggttcgtagaggctggtttggaggtgttgacgaggtatttgtgtgatggactactacagagaaagcgtacatatgacaagaggcaaaatcaagctaaggatagccaattcagaccatcaaagtacaagttcaatcatgttaacacaacaacttgcattggttgcaataaaccgatggtattcattgatggtgagattggacggagttaccgggtggctgcattgcactagaggtcgtacaagtgcgtggaggctgaggaggtcatgagaggtggcagtgtgcatggtcgcatgtcaaagccaaagaccatagagatgactagagtctagaggtagcagaatgactctgttcgagtcaggattttgtaggagattgactcggcttgtgcaggcacagggaatagactcggacctcgagtcctaccagccatatgcatggaggaagcaaagtcggggacctaattcaacatgaaattgggaggacatggttttgttttggactctaaatcgaaccaatctcccaaaccctatcttcctatatagttggaacccactaaggggcatctactcctataaagcaagaatgcaggaagccacattatcaataattttaagccattagatcatattagtataaagataataaccattggatcaagaagctacttattcatccaattcaatcatttattagttatccattcacctccctttgctctacctcactgtcacacatagcactgttacatattttgtgcataacaccatgttttctgaatacaactcaaattattgtttattatgtgattattgtttaatatgtgtgttttgttttattatgcatgataagatagcatataattattaggtatcgttacctgaatctattttcagaaaaaacttgagtgaagtagagaaatgcaaattgtctacctataacgaaaccatattgtgtatgaaaataatattcatat

SEQ ID NO: 61410 - DNA, 14687 bp, Oryza sativa
tctaacaaactctaaaataacaataagtctttaagacagacttttgcccacatttatctataagaaatttacataagatatcctaattaatagatacaattgcgttcccgggactccatccgtgtgtggcaatcatcctgaagtacattaacttgaacccgatgtcgcgtacaagtcgtattgtcggaatcggccgtatcggcttgcttagcccgactcagacccagccgatcctaatagtagccgatctggacttgagccgactcctgctctgtttccgaactcgatctccgcctcagacttcgctttgatcaaatcttctgtcctgacacagatgttaccaaatttggtcattaacacatgcccccaagtccgggatatttgataatgttccggatttgccatgtaccgactccgagcaagtttcgcactccgccgcttttgaccgttattccagcactttaaatactaaccgttacccccgagaaatctcacgccgtgacttccgttttcaccgctcaagcgaaacctcttctctctcttctccggcgattcccccggtgcaaaggcgatttctaggcgacttcctcctcaacgagatctccgcccgcaccaatgttgtcttccgccagcccatctggtgcgccatcagtcgaaaacactgaggtaagttctcatcggctaaatccccttccttagagcagatcgattttatcctacctcatattgctttccttctcttggttgcctcggatttgtagcatctttcccaccaagtcgcaattcccagtctgacgcatgaaaaccactactttctcggcccaatcggcaatcctgaccccaccgagttcattattggtgaatccaataggatccccttcagattaaccaacccagatctagctcactggaagaatactttcaagtcctggccgtctctagagaaagttccaccagaaaagagctaaactacatggttcaaacgtgtatcagccagcaagagggtccactgggatgaaattggaatcggccaagcacttgattttactatagcaaactcggccaaagatgaacccctgatagcagctgcttcttacttctggtcaaacactattaatgcctttttattcaatcaagggctgatgacccaaactcttatagatatcagcatgatcacgggtttggatgtcacctcatcggccaaccctatgagcttgaacacaaagaaccaatatgacttcaagaccaaaagcataggaggttggtcaggctatgtagcggcatatatggatcagggctcggtcacccctcgggaacatgtggccattttgttaatgtggctagaaaaatttcttttctgtggatcaagttgcggccccacaaccaactggcaatttctagctggagctctagaaacaaagagacaattttccttgggcaaaattctcctcggctatctataccagatgttgaacaatgcatcggctaagatagccatcggctcagtggttggagcaggtagaccctggtggctgctacgaacctggttaaacctgatagttatgaaggttgtcaatcggccatccgtatcagaagctgagttcccaagactagagccgattgtaggggatgatggagaagagcgtactcatcagagatgcacatcatacggagaatatgcttctacaccaactgatgccggggcaaaactatcggctgaactgctcaaagattggttctgcagcttctatgaaggctttcaaaaagatgctcgagtttggttcctttatgaagattctacagaacttgagcacccactagacttcagattcgaagacatcaaccacgaaatataccaatcgtctagggagattttctcagctgcaatcagcccatgcatccttcctgttggcattcatcaaggaagaaacatccaagcttcttacgaattctatcatccaatgagctcagctagacaacttggaatgggccaactcccaattggcttattctttgccgacaagatccaatgcggaggagaaatttcatcgaccttgatgatggatcggctactcaaccttcatggaccccctctgggcagtattgacaacatagaattggcaatgttgagaaacaaaaactttgacagatggtggggtgaatggaagctgcatctattccaccaaccagcttcaatgtatatgacagacatcttcccagatgttgtccctcaagtaagtctttaactccacttgatttaaatagctgtttggccgattaatctcaactaatcctccttttgatttgcagacaacagaatcctctcctcgccgtcaaagcaacagtggtaaggatatccaatatgccccaggtttaattcctaacggaggtgggctatctcctccggttattggatatgatgcccccaagacctcacctcttcttcaagggcttatcagagaaccagctgatgctggcaaaaaaaggaaaaccagatcgtcggctgtagacatcgcagccccaactaagaagaagaagacaaagaaaaccaagccagccgatgatctgcctaccctagattcatccattgaacaagctctggatgaagagataattgatgacgaagttgatcaggccgcagtcgaagtaagcgatactgaaagaacaccatcggctttgcccaagcaaacccctccaactccttctgctcgattcacttttcaagggtaaatatctctctttaatccctttcataattattttgtcttatagccgatcattcccaagtcttataattgcagaaaaagaagactgcggtgaagaagaaatcggctacaacaacgtctaaaccagctctaccagtaagatagttttaactttcattagttaatttttagccgattctggctgacacttgttttctttcagccttcccctcctccttctcctcctgtacaacaaacatcaagtgaccagaccccttcagctgtggggagtcatcacgtcgaggaagaagaacaaccagctgctcctgctatcccagtaagtttctttttgtctcaacaagcattcagattggctatgactgtttctaactgcttctaaatcgttgctgcaggtattagccgatcttttctcttttgacatcagagactatcttgatgaaggagaagaagataccacaagaaaaaccttagcccctttatctgatgatgtgaagaaaactctaggaagaatcttggatcggctagaagcatcatcgctagatagcctggtggttgattgtggctcaatcagggctcggctacatgagattcaggctctaatcccagatgagttagccaatatcctcaccccagccgtttaccttgagcaacaccaatttaaactggaaaaagccaaattaagactagccgaacggcgagagcgcagggatattgaggccactatccaagctaatcgacaacttgtgcatgaagagaaatccaagcttgatcaactatctgaaggcctaatcaagtctaatattgatcggctcaaggctcacaagattgaactcttagcacaacttgaagaatgcaacgctgagctggacatggaacacaaaaaactagccgatctcccaaaatctattgaagaacagaaagcaagactcaaatcggctatcaagcatgttgctgatctgaccaagtctctgaaatttatccctagaaccgacgctcaggatgcttaagccatagaagaagtagagcagattaggcagaaggctatatcgaccatccagcgatacttatctcaataatttttgtgtaataaaacttagaatttttgtaatcggcgaacactttactatctttacaatcctttgtgccgattaatatgactttgaaatgtgctcaaaatttttgcactgcattttgatatatatgtgcccccctagttttgcaatgtcaagagcattgataaaattatataacaactaagggcgatataacaatatcggccattgtacattggcaaaccacaaccgagtacaccatgaaaaacaactaagggcgatataaccatatcgacacaaccttataaatctggaacggtccttcccaattcggcgaccatttgccgaatttactatgacgagtaccaatcggcaaaatcaacttccatacaagttcaccttccgaaaaatctttaggtaccactttcttattataatgccgagcaacatgttccttatccttggtaacctttgccagggctcgcaatcgcgactgaaccagatcctcgctctcatcagccataaggttgtaatactcatcggctgttaaatcgttttgcaactccgttcgtcgagagccgattctaacttcccatggcaaaacagcctcatgtccataaacaagccatcctataagaccacaatgcttcggccaaccgagtatgccattgctgaggataatcagaaattttccgcttaatgaatttgatcaaacttttattagacgcctcagcttgcctattagcttgtgcataataaggtgaagaattcaacaacttgatacccacactatcggcaaactgaacaaactcatcggacacaaagattgaaccttgatccgtagtaatagtttgaggaagaccaaatcggtagattatatgctcctgaacaaattgactagcatccccagaatcaactttcttcaaaggaatcgcctctacccacttggtaaaataatcagttgccaccaatataaatttatgtcctttactcgatggtgggtttatcatactgattatatcaattccccaacctctgaacggccatggcttaataataggattcatagccgacgccggtgctcgctgaattgctacgaacttctgacaatcctaacaccccttataatatctgaaacaatcctccagcattgtcggccaaaagtatcctgtacgccgaagcaaccacttcatcttgtgagtcgattgatgagtaccacagatcctctcatgaacttcgccgattgcaaccttagcctgatcggcactcaagcacttaagtaatactccatcaattgtccgataataaagctcgtcatccaacagtgtatactttaatgccttatatcttaatttcctagaagccgactgagatagattactcaaatactgatgcacatcgtacctccaatcatcggctgacattgctgcaatttcaactttaacatctttgatcattagcttataccccgactccccttgagctaaatcattagcttcaagattttgttctcgagatacatgctttaaagtaaccagccgaaactctttcattagttccaagcacttctcattataaaccatcaacgtatcgttcttgcattcatattctcctgccaattgactgattacttgcaatgaatcccccatgacttcaatggtatcggttttaacttccttgagtaattgcaaccccttgagcactgcctcatactctgcttgattattagtcgcatatggtttaatagtataagcaaactcgaaacatgcccccctaggggaaattataactatgccgatgccacaaccatgagtacgtaccgatccgtcaaagaataaagtccatggcactatctcaaccgagccgattgaatcttcacgatgctctacaataaaatcggctatagcttgtcctttaatcacttttggtgattcataccgaagatcaaactcagtcaaggaaaatatccactttccaactcttccctttaatattggagctgatagcatgtacctgactacgtcggctttgcatataacagtgcactcattagataatagataatgcctcaaccttgtacacgaaaaatgcagacacaagcataacttttccacaggagaataccgagtctcagcatccaagagccgtcaactgagataaaatacaactcgtttcttcccttccaactcttgaatcaaaaccgagccgattgactccttaccagccgataaatataacctaaacggtattcctttctgtgaaggaatcaaaacaggaggagagctgagatactccttaatattatccaaagccttttgcttctctgccccccaagtaaactgctgatcggcttttaacctcaataagggtgtaaaaggttccaaccttccggacaaattagaaataaaccttctaacaaaatttatcttgccgatcatttcttgtagctctgtcttattttctgggggctgaatcttcttgatcgcattaacgctcctttgggttacctcgatccccctttcatgaacaagaaatcccaaaaactggcgggtcgacacaccaaaaacatattttgttggattcatcttcaagccatatttcctggttctctcgaaaactttccttgaatcggctatgtggtcctccacttctttagatttgacaaccacatcgtcaatataaacttcaaccaaccagtcgattaaatcatgatatatataattcatggctctttgatatgttgctccagcactcttcaagccgaaagttatgacgacccattcaaataagccgattgcaccagggcccctaaaagccgtcttatggatatcttcctcagccataaaaatctgattatatcctgcattcccatccataaaactcaaaattttgttccctgctgaggcatcaaccagctgatcggccactggcattggatattcgtcctttggtgtagctttattcagatctcgaaaatcaatgcacaccctgaccttgccattctttttaataactggaactatgctacaaacccattcagcatatcagcagggacgaataaaaccagcatcatacaatcgtttgatctcagctttaacaggttcgagcatatcggctttacatctcctcggaggttgctggcgtggtctaacccctggcttgataggtagccgatgttcaacaattgatcggctgagtccaggcatctcataatactcccaagcgaagcaatctctaaactcttttaggagctctatcagcttggttctaaactctagagacaaatttttgctaataaatgtcggccttggccgatcgtctggacctatgtctatttcttccaactcatcggccgacataaaaccttgaccttgcttgtcatcgagatcatctactgtatccttagcgtagacatttgaaccctccacgacgccctcaaagtaatagcttgggttctccatcttcgattggctgtatatcagaatcggacacttttagaaaatctccatcccagacttttccagataaacaatcaaggccatccatctcccaaagggctaaatcggcactggcaacattaactgacctgtcggctggcacgatctctatcttgtcaccttgccattaaatcaagcattgatgcatagtcgaaggaatgcaacaattggcgtgaatccaatcccttccaagcaacaagctgtacgaacccttcccatcgatgataaaaaacgtagtaggaatagtcttgctgccgactgtcagctccacatttagaacacctctggtttccgatggattaccaccaaagtctttgagcaccatatttgtcttgatgagatcctcggcgttcctacccaacttgctgaacgtagcataaggcatcaaatttaccgcggccccaccatcgaccttcatcttagacatcggcttcccattgacgtagccgtttatatacaatggtttaagatgccgattctctgtcccctcgggtttctcgaatattgcctgttctggtgaaaggaccaacttagccgatccctcttccacttcatcgacatcggcctgatcgatcccgaattcggctggcaatgtaaagaccatgttaattggtgccgctacaatgctcttcccttttgccaacctcttcgcctcatcggctgcagcatcatcggcaacaggaacctgattcttgacacgccactcctatcttggctttggtttcctcagctgatggttgatttcctcttcaacctcctaaaaacgctccctgttcctcaatctttggacccttcttttctgattcttcgtgaaaataccagaaggacaccattgattcttcctgattatctcatcctcttggccataatcttgattcatcggacccaatctctgatgaacaggaagtcttgtctgccttagccgattacctctactatatgaccggctcgagctctcgacgatatcattgcacccagggcagttttcaatgaatggcaacctcatcccttcgttccagcagaatctaaagaactcacaaccccaatgaggatcaaaaccatcgtcgtattcttcataatgcttctcctgctacttgttatacttcctctgatacttgttgataatcctagccgaattcactcgaaaaccctttgcatggaccctatcggctgcttgaccggctatatgcaccatattaacaggaaaaggattacaatcgaccttcatcggttttttggaatcatcaaacctaatctttcccccttcaatggcaacttggatttgctgtctaaaaaccttgcaatcgttagtagaatgagacccagaattatgccatttgcaatatcgcttcttgcctaattcctcagccgatggtattgtatgaccaacaggaagctgaatttgcttttctcggagtagtaaatcaaagatcttgtcagccttggtgatatcaaaatcatacttttccacttttccagaactttttacccattggcatggtaagacctttttgcttctcacctattcggctgcagctatttcagaatcatcttccttgtcatccgatccatacatgtatggacaaacatgattaactttcttagagcttctcctcacttccgccgacctatgctcatgcaaggttaccttctgtatcagatgcaataagctatcaaagtcttcggacgagaatttctccctgattggaggaatcataccatggaatgccaaatcggctaactgagcatcagttaaactcaagctaaagcaattgtttctcatctccctaaacctctgaatatactcgtgcacgggttcatcatgccgctgcttgatcgctgtcaagtcggacaacttcatctcatgaaccccactgtagaaatagatgtgaaattgcttcaccaaatcggcccaactactgatcgacccacatggcaaagaggaaaaccaagtaaaagctgatccagacagagataaccggaataacctaactctcagagcgtctacagccgatgcttcaccacactgagcaaggaatcggctgatgtgctcataagttgacacgccctcttgtctcgaaaacttggagaaatctggaactttaaaccgattggggagagggactatttcaaaccactcaggataaggcttccagtctcttttggtttaagcccaaattgttctctcattacatcggcaatcacatcggcccacggtcgttgctgagttgctccttgtggctgttgttgcatagactcgaactgaccatactgacatgcgaactggggctgagccaatccccctggctgatattgggcttgtggggaaggaggctgatattgatagctcaaattactcccttggtaattatgaagattcggctggatgttgcgcaccaagtgttcaggaaccatctgaggtatcactgtgccgtccggctgtgcacggtgaaccaaatgctctgggataacctgatttacaaactgctgtacaggttgaccaccaggtactgcgaacccggccgatgcatttactgaccccgggtgctgaatcagctgaacgatctgttgtctcaatggagtctgttggatcggctgctgaggctgctgccttggtggtgtctgctgaattggttgcagaggctactgccttggtgatgtttgctgagcctgttgtactacctgttgttggattggttgtacaacaggctggattggtggtgtctgctgaatcggctgctgctgcactggatcaacaataggtggaggtggcagaaacatggcagcaacttgatcttgggttagccgattcatagccttcccgccatgctgtggcagatcccttgttaacaaccgagggttcaccggctgtcctggcgtcatagctagtgtagcaagcaaaggagtcgatgctggcgccgtcggctgagttgtgggtgcaacggagggaactgcttgaacagatggctaaacatcggtgatcaaagatcgataatttaggaagacacctccatgcaagtaaactgtgcctgcagcctgatgctcagctatcgaaccatcggctattgtcttcatcatgtttgacaatgtattgactaataccccggactgattgatcaaagcatgatgcacagcgtaatcaacccgatcttggaagttattgaaaaaatcttgtgctagttcactattctagttaagattccctccttgtggctcctgagcaccatcaccttgtacgccatggactccttgagaattgtcgccttgatcgctcgtggagccatcggtagcacctttagtactcggctgagccgagccacctgaagcttgtttcacttctccatctttaaaagaaccggtctgtaacatcccggcctagggcttaataggattaatagaatactcatatcaacaagttgcaacttcttttccggaagccgatctccaaagaactccggggttaagcgtgcttggcctggagcaatttgggatgggtgaccgaccgggaaattcttcccgggtgcacacgagtgaggacaaagtgtgcagaaaagatatgtgttggtctgtgagggcagtctatgacatatgatagctatcagatgtaagcgggcccggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgccgccatgcgctggcactggatacatggacgtggccaagagaggacgttcctggcctagggttgatcgacgggggcgtcgatctctcttaagggggtgagggtgtaacatcgtggcctagggcttaatagaattaatagaatactcatatcaacaagttgcaacttcttttccggaagccaatcttcaaagaactccggggttaagcgtgcttggcctggagcaatttgggatgggtgaccgaccgggaaattctttccgggtgcacacgagtgaggacaaagtgtgcagaaaagacatgtgttggtctgtgagggcagtctatgacctatgaaagctatcagatgtaagcgggcccggcctgggggaaggcgggacgttacacggtcccaggactatcagcaaccacttttattttatacttctgaacaagtgtccccttgcgggtctgctcaggcgtgaatttctctggatcgatcagcatgacgttgacatcaatgatgtcagtcaatccctgctttaacgccttgcctttaacagaacctgggctagatagtggtggttattttatacttctgaacaagtgtccccttgcgggtctgcataaatgagtttaggaactgatcccgtgcctgctgcagggttgcttcaaactctgccatctgctcaggcgtgaatttctctggatcgatcagcatgacgttgtcatcaatgatgtcagtcaatccctgctttaacgccttgcctttaacagaacctgggctagatagtggtggtggctgtttctcggccatgagaaagaactgacgtctgacttcttacaggacccgctggacgtgccaaaagcgtgttgacagaaaacacgtggcctgggagatctgcttaactccagtgcagctccaaagctcgccttcggatgttgttagcatgccagttgattttatcctgtaatcaacaagaaatagaagcaaagaaaccgtggttaaatctataaatgatagccgatcggctaggtgccgatgacatatcatttatctttgagccgatgtcatctgtgtatcgatcggcagtcatgaataagtaaagaagaactaaatctactcgatcggctgtagatattaacgatatatactccttatatcgatgtatacttaaatcaagtgattgggatagatcggtcaccatgccaagacagtataaataacttagatcgaaatatatatcaataacagggttatatatgtttgtagcatagccgatcagatagatctagcatgtatcagctaatactccgatactactttatatcaagatattaaagcaagtataatatatcgagcaaaagcctaacattcttagacacagcaatatcttaatataaagggctgatttaacatatcattgaagcatatagaacaaatataattaaatcagatacgatcggctgaaactccgatgctattctaatcggcaactagaaggcagactagagatcgatattctaagcacgactcaataggtcaaactcaactgatacagcattaagtatgaaaagaagaacaatatttagacaatcaagccgctagaagtttcatagaatggtagatatctcatataatctagatcaacatcaagatctaacttaatcggctgccctctgtgtacagatatttgccgatagtagattaggtggcgatattgctagagattatgtaagatatatgataactcgacgaattatataaacaagattagagtatcacaaagatggaagcactaatcctaaaaacacaatccgtcataacgagttttacctcttgttgaagatcgaaaccgatgtagctcaacccgaaagcaagaactcgttgaagcaaaactaaagcaaaagggtggcgatgcgccgaaattgtattgaacgtgtgtgttgttaaattacatagggctcggggtctatttatacccgagaattacaagatatgcccataccggacacgactattatctctaacaaactctaaaataccataagtctttgaggcagacttttgcccacatttatctataagaaatttacataagatatcctaattaatagatacaattgccttccccggactccatccgtgtgtggcaatcatcctgaagtacattaacttgaacccgatgtcgcgtacaagtcgtattgtcggaatcggccgtatcggcttgcttagcccgactcagacccagccgatcctaatcgtagccgatctggacttcagccgattcctgctctgtttccgaactcgatctccgcctccgacttcgctttgatcaaatcttctgtcctgacacagatgttaccaaatttggtcgttaacaaaggggtatggaccgaaaaggagggggagacctaggaaaacagataaaagatgagagttgtattttggaatatcagagattgggggcttctgggaggcagagacagttaagggagatgatctttgaacaacaggtagatgtgatttgtcttcaagaaactattaagcaaaccttttcagaaagagaattgaggaatctggtgggggatcattttgtgtggagatatgtggttgctattggacactctggggggatcatgactggggtgagagatctaatgtttgatatcctagattgggatcaggggaagttttctctgaaaatggttgttaagaacaagagggatggtttcatttgggagctgatcaatgtttatggtccagcacatcaatcaaatagggggggtttttctggatgaactttcccaaagaatgcagcagggggtgtatcctatgatcttggggggtgatttcaatttatatagattttcagatgagaaatctggagggggtggggtggatgttaggagaatggatgctttcaatttgttcattaaccagtatggtttacaggagttgtttaagcttgggggcaaatttacttggactaataagcagtctacccctataaggagtgtgttagataggattttagtaacatctatgtgggaacagaaatttcctttagccattgttagctccattttaaggttggttcagatcactgtcctttgcttttggacacaagagaaggggggagaatacatagcacttgtttagggttgagatgagttggtttgaacaagagggtttcaaggaagatttgttaaaaaaatgcccaattaagttgcaaggcaaggctatggattactggcatcttctcatgccaagtcttaggagatggatgatgggtggagtgctaacatggttaatgcgcaaaagagaagaaggaaagagatagaacttaagttggcagaattagacaatattgaagaaaggagggatttgtttccccaagaatgggagatcagatatgagttggaaagggaagtggaaaatatttatttacaggaggagatttggtggcagaggagagggggtgaacaatggctgttgaggggggggtagtaatacttctttttttcacaagattgccaatggtagaaaaagaaaaagtcatattttttctctgcagcaagggggagacacaatcttagacttcaaccaaatccaacatcacatttatgagtactacaaaaagttgtttggaagagaggaaattaggaatattcatctg

SEQ ID NO: 61411 - DNA, 661 bp, Oryza sativa
gtagagatactcagtgtcggccaactgatcactgtagcgatcgcggagctctcctatggcgatccttgccacctcctgacatgcatggatgtagtttcttcctccagcttcgaacatcactgaggggatatcttcactattactgttcaaggtgactttgactcggcacttctcttcgtgacgatcatgaggaatctgggcataaaaaggggtagtcccaaatcctatggcaaaggacatcgtacgcaactcctggacaaatccctcaacaccaaacaagtactcaggcttgtagcacggcatctaaagacaagtgaaaggagggagttaagacatttatccaattaatagcacaagtttttggattaatttgaataaagttagaaaatcaaagaaaaaggtaagtaaataaagtaaaccaagcttgcaagataagttgaaacagttggaaataaggtcacaaattttgtacttttgaacaacaggttccaaagaaataaaagaaagttataaaatcaacatgctaaatttattttattgcagcaagattaaataaaaccatattgtaaaacttttgctggtaaatgagccattagtacagtaatagatgtacagtactaataacgctggaataaattttgaacgagaaccactaaaagag

SEQ ID NO: 61412 - DNA, 2112 bp, Oryza sativa
ccctcgtttttgttcggattgttcaggatttcaaattcataaacctgtgcatgcaaatcttgtagtagtttgttactccttaatcctacgtgacctatggttcacatgaatgtttatactttgtgtgatatgatgcaaaaatctttatgtacaatgcttttctttatctgttactatttatttggaaggtgtggaacgcgcagattttgcaggaatccgtgtccacggagtctgggatgtgtggcacaactgtgcaagagtggaggatttcgcaagaggcgggtggttttctccccgtagtctgttccttttactcgaactggaacacagagttggcctttcccctcggcaatttagttgccgtgttctatgtacttgtaacgacactcctgccctgtctaaacaagaattcttggccggcattctttcaccggccaacgaaaaaaaaaacaaactgaacaaagttggaagctcagttcatgaaagccaaacctttttttttcctccaaaacaagacactccattacatggtgagatgaagagtgattaatcttgcagtcatatccccagaaggaaaattacatatgcagttgtaggtgcatattgaacacacctgcggaacttgaataagtatgaaattataccatatgcttcctttttttctttataaaataacagatgagcgagcacttttttataacttgatggggtatgagtatgaggcttggccattaggttgttatggtaggcatggaagtctcaggagcttcatctgtttgacaaagtgcaagcctttggattgcactaaaacatctcgttgctagtatcatcagattggcgtgaaccccatgatagatgccagagctggagctaacaaaaatggctttcttgtagccattcctcaaactagctgatactccttagagatagacatgatcagtgtgatatgatatgatatgttagtggtttaagacttgttctttctttcatctgccgattattgagccagaaaaaatgagaaacttcagtaacattcagaagatcgccaaaaattaaggaacttgatcatattatcatcacaaagattgtaaaaatttaagaactccactgatattaattcagaatttcaaataatgctacaaattaagtgtgttggagttgttccaaattcacttcaagatattggccgggcttctgacgaagcttagtacggtacggtatatatgccctttgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaagtggtatcagagctttggttgctgttagggttcatgacgacgtcgatgaagttcgatcttccgctgctgaactacgacacgcggttctcgctatggcaagtcaagatgcgggggattctggcgcagactcatgactatgatgaggcactggataacttcggcaagaggagggccgagtggactgctgaggagatccgcaaggatcagaaggcgctcgccctaattcagttgcatcttcataatgatattttgcaggagtgtttgacagagaaaacttctgcagaactatggctgaagctggaatcgatctgtatgtccaaggatctaaccagtaagatgcagatgaagatgaagctgttcactctgaagatgaaggaggaggattcggtgatcacccacatggctgaattcaagaagatcgtggccgacctagtgtcgatggaggtgaagtatgatgatgaggacttaggtcttctactgttatgttctttgccaaattcatatgcaaatttccgtgacaccatacttttgagccgtgatgaactaaccctaaaggaagtttatgatgctctccaaaacaaggagaagatgaaaattatggtgcagaatgacgggtcgtcgtcctcaaagggcgaagctttgcatgtgagaggcagaactgaaaacagaacctcaaat

SEQ ID NO: 61413 - DNA, 39174 bp, Oryza sativa
tttagtacttttagtttgatttcttcaattacaaagttttttttttatcttctctttggtctttaaacatttattttagttctgaaatcgcaattttctaaattttgtttgaactgatgcttaataatttttaacaagaacatatttgtgtgcatttgaaccttgcggctttttttgtgctctaacgtttaaattttggccttataattaaattctagagttacgtctcctttttcatcgaaaaaaaatatatattggttgcaaggtggacgtctaaattcgctcgcaacttattgattttatgaaaatggtagttttgtcgtaccaaacgatttcttggttctctgttgaggcttcatttttcatcaagaaatttatattttgtacttttaattggattccttaattttgaaacattcttcttgcatcaattcttcaaatatccttcttggagtttccaattatttttgttgtcacggttcatcttccttaagttcgtttgaactttgttttctggtttataaaaacaaaatattcttttgcatttttccctaactgatttattttgctcagacattagtgttgaacttttaattgagttgtaaagttgagtctccgtgtttattgaaaacaaataactttgttgtgagctggacccttgtagtttgttgcacgttcaatcttttcggaaaatcacagtttccttgtatcaaacgtttctagatttctcccttaacgctttattttccgtcctttcatttaaactttaagcttttagttagattgctttatttttttaatgttctcttgtatacatggttttgacatgcaatttggactttaaaactttactttggtttattgtgtgatggttcttttatcattcttaagtttcaactcggtacttcgagtttgatttcttcaattacaaagtctctctttttgcaacttctctttagactttaagctttactttagttcagaaatctcaatttgctaaattttgtatgaacttatgcttactagtttgtgaaaaaaaaattagttgcttgcatttaaaccttgcggcttttttctgctctgccattttaatagtagacttataactaatttaatttctagagttatgtttccctgattatcgagaaaaatatcttggttgatggataggcgtctatatttggtggcatcttattgattttgtaaaaatagtagtttgcttgtccctaacgatttattagtttcgtcgttgatgcttcattttttatccataaatttaaattttgtacttttagttggattcctttattttcaaacgttcttcttgcatggattctttaaatatcctttttggattagaattattataatctagattattagtaataatctaaaataaacaggtagattattatgattgattataataatctataagcctgattagtataatctgttaatctcctctaaacgtgcttttttcaaattgttgggtggctagagactcactacccttattataccataatccacatgaacatacaactcatagcttattcgactatagcttattataattcagcttttattaatctggctcaataatctggattacaacaatcttaagttgaaacaaccgaggcctaagtttatttgaactttgatatctgttatatgaaaactttatttttgtttcttgcatgacgtttgttttttcattattgaatttcaactctaaagtttctctttttggaacttctctttggactttaaagatttattttagttctcaagtctccatttcctaaattttgtatgaacttatgttactagtttgtgaaaagaaaatagttgcttgcatttaaaccttgcggcttttttgtgctcggatgtttagacttataactaagttctagagttaagtttccctgtgtattgaaaaaatctcttggttttgggctagatggctacatttggttgcatcctattgattttatgaaaaccatagtttgcttgttataaatgatttattggtttctctgttgacgcttcgttttcatccataagtttaaattttgtacttttagttggatttcttgattttgtaacgttcttcttgcatcgattcttcaaatatcctttttcgaattttcaatttatttttggtattacggtttgtcatcgtaaagtatgtttgaactttgttttctagtttataaaaacaaaatattctttttgcattgaggattaactgttttattttgctctgaagttaattttgaacttattaattgagttgtagaggtctatcttcttgtttattaaaaacaaataactttggtgtgaactggacccatgcattatgttgcaccttggagcttttatgaaaatcgcgatttcttaggtttgtccattcacgctttgtgttccgccctttcattcgaactaaaccttttagtttgagttctttattttcgaactttctcttgtatcaattgttttgatgttctctttggactttaaagctttaatttagatttgaaatatcaatttcctaaattttgtttgtacatatgattactagtttgtgaaaagaaaatatatgcttgaatttaaaccttgggctttttttgtgctctaacatttttattttcgacttataactaagctctagagttacgtctccgtctttatccaaaaaaaatatgttggttgcgggctagatgtctctatttggttgcatcttattgattttatggaaatcaaagtttacttgtcccgaacgatttattggtttctccgttgacgcttcatttttaatccatatatttaaaatttgtactttaagttggattccttgattttgaaatgtttcttgcatcaattcttcaaatatcatttttaaggtttccaatttttttttggttgtcacggtttgtgttcgttaagtttgtttgaactttgttttctcgtttataaaaacaaaatattctttagcattagggccttatcgatttattttgctctgacgttaattttgaacttataattgagttgtagagttgggtatccctgtttatcgaaaacaaatcggaaaacttaagctacgcagctggggcagccactcacgcgtgccatgtcggattgctacagtgcgcacggtggaatttagctataaagtcctccggtttctacgtaattcgatctgaggactgaggtattattttacataggtgcccttagaaaatatggatattgcatgcgaagaagagaaaaatcgcggattagggctgcgctctaaaatgtggaagccgagcggctttttggcaaaaggacaatcactaacccgaaccatgccccaacccctagcctctgaaagcgcatagaagtcaacgcgataatagattgatcacggacaagatgtcacgggtgaggagattggaagggggattgcagcgaagagagtatttgaacgcagttgttgggcgtgaccctggacctcgtcgacacggcggagccgttttcggcaccacaccagctgtaacaccccaagtaaccacgtacctagagtgccacatcaagaaacactcaaaccactaacttccaaaattattagaaatttcggcagtctcccctgtaaatacggacatccacgacatgcaattataagttaaactaataacaatatcattcccacaatacgacccatccttataatccatggggaagaaactactagaaatctaaaagattattacaagaccaaactaggatataatttaagtgtcattatggacctaagcaatatagtttgatagggtgcgagtagatgtggatataagggtgctacttcccgcccatgcatgtcggtgtaaatgcgtacctaaaaccaaataaaacacaagtgagtataaaaatactcagcaagtacaatatggaactagaaaacacatatacacatcattgacaataaagcatgaacagaaggatttctttctttgataggaaacacatttccaaacaccaagtcaaagaatataatagttcccatcccgggcaggcatgaattgaaatagtagtttccatctcggacaatagtgaatacatcctagcatttgccggcaaagccgagtaagcgtgatcagcgcttacccacaggaacatgaataaagatccaaattgaattcccatgactacgcatggtccttgaataattgaaaaccagaatcaaagaaccaaattgaaaccatattgcacatccatggcaagcatggtacttgaattatttaactagatccagaatacaaaatattgaaacaagaataacatcgtaaacataagatgaactcaaaatgtaaatagcgtgaacaataatctgaacattagtcacttatcacatagaaatatatcagaaataaatagatagagtaaacaatccatgaatcacacaattagttcgtcatgcacttgcctccaacgaaggattagtatcatgcacgatctggtggaccaccacctaatcacaaacaaaacctcagcaaacacattcaaacatgtgtataaaacaatgaaaaaggtgaacctactgcgccatcctatcaaaactcaataacaaggaacgccgcttggactatacacaagactgctgcttcaaacctttatatcttgaaatatgaaaaggctatgactgaaaatgtatacattttgaaaatctacagaacaatacctacaactttgatgtagaaagcatatttttattctgccatttaaatggtctaatttgcacttgaaagcaggcttccgaatctgtccagaatttcagactgtccacactaaaacaaccataactggagttctactcgcccaatcagggtgtactttaccaatatggaaagctaagaaaaaacttctacaactttgtctataggcggcctggctgattccactgtttaacccctccaaaaacagttcaatctactactatccagattatgacacaaaaacaacagtcatactaaaaaaaattatatctcctaaaccacttgagataaaatcgcgccctttggtcagaagatagatccaaacattatctaaaattcctagttatacactttcgcagaaaataacatttagagccccgaaacattgaaacgctgaagcactgcaaatctgcccacatgcagaactgcaacaaaccgaaccacaactacccaaactccttctctagccttccctaaccacgaattaaagcactaaagccatgctagaacaactgatacaacaaggggataagcctcacctagggtttctttagagaacttgtgaggagacaataagggagactccggtctaacccctccttctactcctctcctcctcctcgttccgtttttctacttcgcttcttgttccaagctatgaaggtggagatttagggagagcaatttgttgtagagggaagagatgcgaacacaggaggaggggagtagaaggtgccggccagggagaggggtgacggcactatgaggggaggtgggattcggttcccctctctctaggtttcaggggagaactaatggcctgggtttatgggccttctcacgctggcccacttctaaagatatttttcttttatttatttctgttaacatttttattttaacaagtcaacccaaactaaaaaaacctaactatcttttaatatacggggtattacaccagggaggcaggaaatacatcagatgtgatctgatctcaattgaattgacctacaaatttaaagcaaatccaagggatagaatcctagcaacttaagagataaagaactaacaaactccctaacaaactctaaaccggaccacacactattcctcgtcacggattgccgtcgctgttcctgttgcggcgccgtttatactataatccccacatgacatctctccctccctggagaagcaactcgtccgtgagttgaaaatctggataccgagaccgaaattcatccagcgacatccatgaagcttcagctgccggtttatccttccaatgaacgggaacttcacgaacaccacgcgccaaatggcggcccacatgaaacacgtcatgtaatcaagcgcccgggggtagatgaaggcgatacgccacggcgccaatgacaatgcatcccaacttgccgcgtcccttgacagcgagagacgcaatcggatggtgaagcaaacgaagccaaacccagccacccacactgaactccaatgcacgatgcttgccgtcatacgccatcttgtaagtctgttgagcttgttctaaacgatcacgaaacgccctcaggaagtcgtcccgctcctgtaacgcctgttgaactgcgggcagacgacatgaacccggctcgtaggcacgcagcgtcggcggctcgtgaccatagacgacgcggaacgacgatgttcgaagtgacgactgatacgacgtgttgtagcaatacatcgcgcatggtagccatcgaagccattgacacgaacgattcctagtgaaacatcgaagatacatcatgatgatcttgttagtcacctcggactggccattggatttaggtgaaaggctgatgaaagattcagctgcacacccgccaaccataaaatttcacgccaaaaagtgctggtgaagactggatctcggtcgctgacgatggagaccggaaaccatgcaagcggacgatctcagcgaagaaggcagctactaccgacgtcgccgtgtacggatgagaacgggatgaagtgggcaccgttacgatgaccgtcttgccatgtactcgcgggagcccctcgacgaagtccatagcgatgtcagcccacaccgccaaaggcaccggcaaggattgtagcaggttggccggttggaggtgctccgtcttgttccgttggcacgtgaggcacgcgcgcacgaaatcttgcaccgtcgctctgtcccgcgagatatggaaatccgcgcgaaggcgagatagggtcttttgcgttccctcaagtcccaagccatgcaccgactcgaggatggccggcaatgattcggatgatggcggcatgaagacgcagcccttgaacatgatgaggtcgtctgtgaacgcctatgctggcggtttggcacccttggtgatgtcttcacaaatggcggacagggcgggtgtggaggctacctcgcgggacaactcatcgaacagggagaattggtgggggggatgataaggcgaacgcctccgccaggtgttcgtcccatctagagagcgcgtccgccaccaagttcgccattcccaacttgtactacacgccaaagtcaaagccgaggagcttgcttgcccactgatgctgtggaacagtggagagacgctgatccaagaggaagcgcaagctgcagtggtcggtgcggatgaggaagcgacgcccccacaagtatggccgccaatggcggaccgcctggacgaggccaatcaactcgcgttcgtaggcagcgagcttggcgtggcgcgacgcagtcagcttgctgaagaatgccaccgggtcgatgccttgatggagaacagcacctaggccggagcccgacgcgtggcactcgacgatgaactccttgtcgaaatccgggagctggaggactggggccgccatgagtgcgtgttgtagttgccggaacgccgttgccgcggtgttagaccagtgaaagccctccttccgcaacagcgccgtgaggggcgcggcgatggtgccgaagtcgcggatgaaacgacggtagtagcccgccaagtgaggaagcccctgaccgtgcgcgtattcttgggcagtggtggacggagaaggccggggcagttgacgcgggaaggagcgaaaccgaccaatgccggtcacatctggagcgtaccgttccaccggttgagtggcgagggccaattggtcaactggtcgctgctagggtggctagtactgttgctgctgttgtcctccgttgttgttattgcagcgacggttgcggttacctccctgccgatcggtgttgttgccacgatttccagcgttgccgtagccggtggagtatgcgggcttgcttcctaatggcacccccccggaagtggaaggtcggcctccagtgccggcgaggagagcagtagaagcttagcaaggacgacccttcgtcagttcttcgagcagaagttgagcacgtacttcggcaaatgtggggaaaggtttctgcatagtgaacgcagattgcaagtgaccgaatttttcattcaaacctcggattgtagttagggaaagagtgcggttgcccacatcgtccaagtcgtctgccatggtcttcaacaggcaacagtagtcgttgatgctcaaatcatcttggtagaagttgtaaaactcggtggagaggttgagagcgtgggactcgcggttgcccaagaactgaggtttgaggccacgctgcacgatgcgagccgtggtgttgtgcgtcatcacggactccagtaagtcgacggagatggtgccgtagagccacaaaactacgatgcagtccatgcacatccaatcctgacgatccggcctgtagaggttggtgaggacgtgatcggcgagcgcgtacttgtcgagggtgacgaggatgagaccacaccattgtgtgtagttgccgaagttgagatcgagggtgacgggcatgagagacttgatgttcagcatcgagaccgcctgagcgtggagattggcggtggcgtcattgttgaggtcgacgttgtagaagttctgggcagtaggggcaggagcagcaccggtcatcagagggatgaagccaccgtagccgggaggaggtggtggtggtgcaccagctgcttgaggaggaagacccactagagggagtgttgccgatgcagcgccaggcgtgatgaagaaggcggagacgtcctgagcaggcagagcggatgcagaggcgtcggaggtgccatagaggccaccggtggcaaggatggccgtgagctctggcggtagtgggagagagatcggcggtagtgtcgtgcctaagggggcagtggtgaagagcccggcagacatcgtcgcagccgtcatggtggtggtcgcggctgaggaagaagagttgtcgccgtgtgggtgttgccggcgatgaaagaggtgccagtaccagcttctcgatgaaagaggcaagggctttcctggtggcgcaggcagcagtggtggacgccgtgtcgatgacggaggcggctatggctgggtcaacatcaaccctagatgagggttggaagacatcccgaactgcctcggtgaccacagatgtgatggtgtcaattgcggcagagggggtaaggggagcgttgtcggccatggcgcaggagcaatgtggtggcggcggtggtggcggcggcggcggcgtcagaagcgtgcgtagcagaggagcgcatggcgcgatgcgagattagagttggaggcggaagctaaaagcatctgataccatgaaagcgtatagaagtcaacacgataatagattgatcatggacagagaacatatatagggacggtggacctgtatctctacccgacttatagaaacagaatcaggagataattaggaaaccgaacccaatacaaatatgactctaacagcctctgccgcccgctcccacacctgctccctctcccgcgccgccaccgagcgctgcctacgcctcctcatcgcgctgccacctccgccaccgccgtcaccgagcactgccacaacaacgtcctccactgccgccgccatcgctgagcgccgttgtaatgccccgaatttcgaattagcatatttcggggaatattatagcaaacgagcaaaagttcaacctttaaaccgttgttcgaataggcgatcaggaaccgtggatgcgtagagctcgccgagtagtgcaaaataaactactagtttatagaaatcagagtccgagcgaagtccccgggattgaaacgatgtgggccgttggatctcctttgtctctttatataactaacaaaaaaaaagaaagaaaaaaactctcgctacagccagccctagccctagccgctcctgcgctcttgccgccgccgccgctgccgccgtcgtcccggttgccgccgccgtctttgcgctgccaccacggccatagccggaggccgcagccgtcgtcatccatcacaacctgtgtttcctttccattttcctttttcccggtgagttctggcggctgttccttgttctatcgttgccaatctgattgcttgttgctggggctactgatgccatgcgactgctgctgctagggttgttgctgctgctgctgttgttgcttgttgcggtggccctgctgctgttgctgctgcatgatcagaggagaagggtagagagaggttgtacaggagggagaaggaaaggaaaagacagagcagcgttgaggaatttcagcaatttcgcaaattagggaaatttgtcgcaaggtagtgttccttccctgcaaaggcaacttctctttagtccctagaagtataagattcaaatagaaattgattggatagctgctcgtgcaattttttaggtgctttattataggatgaaaccatgttttcaaatctggtatgaaaccatcaggattcaggttagttgtcctaaataaagtttgtagtcatcgttgatatctttctaacgccgctggtttcgctcgattccgataatcggtttaggagaaacaacaaaaacagtactgttgaccaggtccgaaaatcaggacaccaattcgttttttcttaatatgggatttacagagccataatctgattttcctcccaacataaaagttgtagagaattttatctagatgtcaaagttatattattttctagattccgttagacggtttgcgagttacacatagaacagtaagggaactgctataggttaattaatacaaatcggtaaaaaggtctatatattctaggttatcgattttagtaaatatcacttgtaactatagttagttgaatatagtggtttatgcgtagctttgctccacaggtgtggagggttccaacattggaggagttgagtcggagtatcgaaggagttaagacaagtacaagacggacttgtgtgatgtataaactgtgtttcttgtttgatttcacatacccaattattattcgaaagcttactatcagtaattatgtggatttggtatcattgctacatatttacgtttcactttatgttcaagttcacgatgttattcatgtttcattatttcggatgtttttgtttacattattcaagtaccatgcgtagtcatgggagtgtaatttgggtctttattcatgatccttgagaagtgttgatcacgcttgctcggcttaccggtaatgctaagaggatattcatacctactcaggagggaactactatcttttgacttctttggtttaaaataaagtaaatccaacccttcatattggtttcttattgcattaatcatgtgtatgttttactagttcaatattgtacttgctgagtattctttactcactcttgtgtttaatttggtttttaggtacctaatgacattgatcggcatggggcgggagtagcacccttggactacactttattattgcacactattgaaatttagttttagactatgtttatgcatagcacaagttttgcgttgaacttgtaaaggtcatttaaagttctggtccttattttcacgtggaatttgtggagctaggatggtttggattgtgtggattatatcggtattgacttttcttataactacctgttttcacatggaatttgtggagctagaatggtttgtattgtgtggattatatcggtactgatttttcttataactgcctgtcgtggatgtccgtattttttaggggagattttaccgaaatttctaataattttgggacttaggttttgagtgtattttggtgtggcactctaggtacgtggttacctagggtgttacagccgccactacatccttcgtcaccatcgtcgatggccgctgctgcgccctctgttgccgccgccatcgaagaaacggcggtggtgacagaacagacgtcaaggaaggcggtggctgcagcgacaagaggagaacggcacgttgccaggctctcgagctcacccctcatcagtgatccgttcttcgctcaacctcgctgttgtcgcaggctccaaacctagatgacggtacaaatccagtggagctcttgctgctcgtcacctctcaggtcggtcccctctccctcaggtaactgatgtacttaaggatactaaattttacattaaaaaatgcattacctttcttgaaaaccaaaaggacacatatttttaaccagagtgaatattattttcttttgtacatatgatttaattggaattgatatcactccaactcttcaagtccatacttaatatgagtacatttcaggcggcccaaacgggggacacaatcctcctatgtcgccgggacatgcataactcaaatggagaaaggccatggaaggatttaagcagaggcaggaacaactagaatgtgcactgcttattcatgttcttccttctgtttcatattactcatcgtcgtcgttctaggatttaattttatattaaattatttgtcgttttctcgatccaaagaaattttaaaggtgatcgatattattccctccctacctacagtaatgcagcaatacatattgatgcggtcataattggctcatctactttgaaaagataattaagatgtatctgacaagggcaaccatgtaatctttcacatcttcatggtttgcacggtatttgcctggataacaagtaaattggaacagagagagtacagttttagactttcagtgtgttccttccaatataagaaggggtaattgctcatttcaccttgtagtctaaccactaatttgacttttcaagtttatgtatttaacatcgctttttaaaatcggagtactcgaggttgatcctattccatgaaggtaagataatggtgctaactaagagacgaattatcttttttcctttcctcatttgaccatgttgtataaacgtttttttttgtttgctcgaaattttttgacatactttaacacattgagcatattttgatatatttgagacaagtctaatagatttctcttctttttaataaatttggcttcaatttgatagaattttgacaaaattaaactttttttttgcaaaattttgagagcatgtcgtctcaattttgttcatccaaacttacatacggtgaagaaaaacacggatatagctccagaaaggagatgctcggccggcaaacagaggttgatccattgtcgccgcccagccggcagccgcccttgaatcaccctttgctgatggccgccccgctgaccttgccgccttggctgtgtgtcacgagggcccgactagatatggacagagcgagccagaggtggatgtcgagctcgatgcaggagcccacctaccgcgtcgttgctatcgtcgccactgtcacgtgatatcaccgtcatcaagcccattgatggctcgattttcttgcaccgccatcgcggcttgttgtgtagttggtcgccattgatagacccaaaaccaaaacctaaactgtgaatcatacacagtgacgaatccagaacaaaagttaccggagatccgatacatataattatttaattattaggtaatatattaattaatatggtacaaattagttagaattgaataatttacacgggtccggtgacctaggaaacactacgtagaaacacccctggccatggaactgcgtgagataagggagagaaatggtcaaatggagatatgacataagatttttttaaaaagtaatgaaatgggaacataaaatagagggaatatgagacaataaaaatgcatacttagagtggtattttcaagttcatttctaactaaagatcgaggaatggataaaaattagatgctagagcaagggaaaaaaagcgagagatgtgtgactcaattactggtcaaagacaaaatatgttttcgtggatgaaatagtcttccccttgacctttgactgcaggaatgacacggaaattctgggtgtgtctagcaaccaaaaaagcaaaagagtagacttatagttgatcaaagttgattacatcacattaatatgatagtactgaagtatatatagaccagcatactactggaatagtacataatttgttcacaagctgacaagcggcatatcgaagaccttttttttttcctgaacagtaacaaatagtataataagtgagccgataatataaatagcctatcatggccgtgagacaccagttaatttcagattatatatatggccgtcgatcgagctagctaagcaaacacaccatggctgcttctttcatggctcgcgtcgtgctaatcctagtgctgtccctctggctgctgccgtcgcttctgcccggttctctcgccgccggcgcttcatcagccggcaacgagcttttgccatgtgagtaatctgccattttttttttttgggaactaaacaagcaggagctctgtcaattatatttaaatcagtagagtaaaaacccagagacgacgatggttaattacaggaaaagaaaaaagaaggttgtcaatctctattaccagtactatagtcaatagttgttttttatttcctcaaacattttatgtcgagaagaattatatatttctcatgttcaagtgaaatctgtggtgcagactactactgcaaccccgtaagttaacgtactgatcacataatattacgaatctagataaacccatgtctaaatttattgtattggtgatgtcatattttatttattatttattttagagaagggtatgttttatccggcatatacatctaactgtatatatgcagtatttttaaatcaagaacttagcctattatatagctagggaacttagctatcaaataacccaaactgaaattcgttcctataaagatttgaactcagcatcttaaaatgctactctatttaatattctatttaatattagatttatattttgggacgaaagaaatagtaattaagcatcgttcgcgtgtgcatgccagtgagcggtggcagctccaggcggatggcgatggtgagaagcagggagaggaaagacggctatggtttaagtatcgcgaaatcagcacggcgatctctccggcttacacccggttatgaacacagtaagcagcgcttggaattgacaacaaattaagtggtttgataatttgatgctgccatggaaagtagatcatgttgaatgggagatatatatatatatatattaatatatacacgaaacatatacagagtttgggaaactatgtaggttatacatgtttgattcaattatgttttttaggttatgaagtagatcagttcttttttcctcattatataacttttcagggttattactagtatgcgaatattgattccagccgtctgtaaaaaccatttctatagtagcgactgtcttgtaatattttcctgctatattaatatgaaacctcatacccggttccttaaaaaaaattgccacttacaaactattccagttgttttgcactttaaaatcctatttagaacgttggaattttgcatgtttttcgcagggacttcacacaagcagtaattaaaaaaaatgttttttaaacagggacaaagatagctagcttttataaattactgattttatcaagtattccctctaaacataaaaatttgacgtttcaggttaagatttggtcaaattgaccatcaatcacttctcaaatgcatattttaaaaggtgccgtggatagatttttcatgtctatcataatatcgaactcatgtaatatgaaatcgatagttaaagtttttagaaatttgaccttctaaacgttgatatttatgtctcgagggagtattagtatgtacgtaaagtttaggcaaaatttgttacaggatactcaaagactgtggtctttgttgtgagacacccgaagatcgtgtatttgctcgtggacactgtaaaaaagtggtaattagctgctggacactcttcccattattttattatttccggtcaagatgaagagagaaagagttgtgtaagtaccaaaatgccactggacactgttcttcctctctctatcttttttcccttcttcttccttgcagcagagcagaggtgcgagtgtgcgacggcggctggcccgagcctggacggctcagccatggcgaggcggcggcggggcggtgtaggccccacatcctttctttttctcttctttctctcctctctcgagcaggcgtggtggcagacttgcgtgaggcggccggcggcggagcagggggcggcggcgctggagagagggagagagacggccgacgcgatggcgagctcggcggcggagagtagcggcgcgcggcacggcagcgggggagagggggcgcgcgcaccgcccgtcctccatcgcgatggcgtgcagcacgttcttgtcctccagcgacgccggcgtgccgacgtcggaccacgaccaggccacgttcttcttgtcccggaagtccagcaggatgatgaaggaggtgtctgtccgtgggaacatggtcgctgccatgagcgtgctcgtgccgtcgagtcactggagcttgtcggcgtcgccgagtgcacagcccggcggctcgtagaagaagtcggcctgctcgccggtggtgcagtcccagacgccaatgccacctatagctgactgaggtcttatgatcattgtgacaggatgcaccctgcatccttaaaccgtgacagcctctgcaaagccaacctcatacacactttgctgctcattgctgatcgatcacatgatgcatgatatggccattcatgtagagaagaatccggacaagaataactactagtggatcatggtgcagttgcagagattggggaggaagaagaacactcaatgaatgtcccttgttgcccgagacgcggccgattcgcgcctgccatctccagttgtacacgcgcgatgcggaagaggtggcgcaggtcgccgggaaggcagttatacacgcgcaggtcgccgccgctcctccatcgctcatttgtacacgcgcacagcgctgccgtgcgcgacgcagcagccgccgtcgggcgcggcgcggacagccgtcccgtcgcccgcggcgttccctgccatggacgccgccagatgcagctggtccccgtcgaacggcccccaccgtgcctcgcggaagaggtcgaggaggccgtaatagagcgaggtagagcgcctcgcgccccccggcaaaaccttcgcgttgctgtcgaagaagaacagagaaagagagattgacaagtgggcccatggacaaacttgtctttaacttaagtttctctctccgttttcatcgaaaataataaaataatggcaggagtgtccagtagctaataaccacttttttaccgtgtcaacgagcaaatacacgatcttcgggtgtctcacagcaaagaccacaatctttgagtatcctgtagcaaattttgcctaaagtttattacttacatcatttcagaccctggggatggaccgcgtgaaactcctgtcactcctatagaaagaaataagcagccaggcaactgatcagagaaggaacacctctgatggcacaacaagaacacttgaacgaggaaatgattcagctgtgatcaacagaggttgtaataaaaactgttaaaaactctaataagaagttactccttacggagtaataatacttgtcattttgaacaagtctattattaaactttaaaaactttaaacatatgaagaccatatgtatagattagtattaaaaagtcttttcataaaatcatatgtattgatatttctatatatattgtaaaagaaaaatagtggtcaaaaatatttttaaatatcatttttgtccaaaacgacacgtattatcaacccggagggagtaacagatatgatagccagttgaaggattgtttgtctgttcattataaattttgtttcaattactcatacatattataagattatttgtaatgatgatcttccttttttttcttccctgccacgcttcgtattggcatggtcagagtcttcttcatgattctctatgtgttatgtgttgacaaaaaaatccacgtttggctgataatgtcgggtctgtgttggcacgtactaggtcgacgaacacaacggcctgggagatctgcttagcttctgtgcagatccaccggttgataagatacgggcgtgccagtcagtttgatcatgcaactgacaagatatacaaatagcatatcaataagccaattggttgtcaagccgatggagtaattcagctgatgccgataccagccgatgtcaatagggttttgagcaatcggatatatgtccaatatagataacgatataaatacaattgattgatagcaatgtaataaaacaataataacatccagtagaaaccaatcggctaacaatgatataatagaataagcactgatccgaaggttaaaacatacatcggctgaatgtccgatgtcataaaatccacaagattagataaacaatgaaacctttgttgcaacgggctaaatccaacttgtatgcaatccttgtaagccgaagcaacgtccagataactcatttgctgaaacctcaatgaaatccttattagcaatcaagaagcgggctagagattatggttctaagcacgacttaatagatcagacttaactaatgcaatactaagtatgaaaagaaacataatatctagaaaatcaaacatttttgtgtgattttcagggtggtagataccttagctaatctaatctagtaaaatgatttagccgataccagcataaaccctaaagcgagaatcggccgatatatctaaattgatatactaagaccagattaactaagatatatgataaataggtaggtaaatatatcaattgaaccagagcaatccaagaggtcaaatacactgatgcagccttgaacgacgccgatgaagccaatacaattgccagggccggcggaacataggacttatcccttcgtcagagattgaaagccgatgcaacccccgtcaagtgccaagtttcgtcaatgataagtaaaaaccttggtaaagaggttggcaatgtgccaagagtagttgtattgatctaggatatagtttacaataaccctgggtgcacatatttatacccataagtagatactagtccttgttggataagaaataaactttcctaaagataaaaggaaaacataaagtccttattgacactaagcacatttttctaaagacaaaaggaaactaacagactcttcctaattaatagataacttgccatgcatgctgcatccttcttgaactcggtctcttctggataagcttccctgaatagattaatttccttaaccgaatatagcaagaatccaactattgccgccttgataattcccatcggccgattacaggactctgaagccgatactgattctagatcgatgatgacttcggggcttactaaatttcactgttaacactatgtcccttctttcgaaagcccaacaacattaattgtcaagaaatcttcagaatacatttgttatagtaggggcctattgatgagaatgagagggtttattcttacacaccgagttgaataatcatgttcttaaattcacatcatcacatcacataccaaaattatcgaatactataaatgtacaaacttattgaaatgccggtagaaatatatcaatatttgatattgtcttgtatcattaataatcgactaaattaaccagcaagttcgaatgtgcaaatattacaatataaagaatgcaaatacaaaagatcttagacaaacaaaaaaaataaaacaatgccactaccttactctgcgcttgctcttagacatgaaagttttattacgtcttaactttagagaagatatttcactcaataaatatgactaagaatgattcaataaatcatcacataaattgtttctcaacttgttttcactagactcagtgcagaaaaaacactctcaacacttacagcggttaccgccggtaaaatcaataccaatttaagaagcaaatacacaaaatcataaaaaaaacatggttgtttgtttcaaaaagcaaccaattgttccaaacgcatgaataggtactaaaacaattttgagtacttttgtttttgcaccacataaattttccggtgggctcaccgactcgtgtaaaaattatttttcacaatcaatggtgtcaagcatattcccatatgcctgaaaacacttttgagtggtttcgaatggtttcattttcgcaccacacaaactttccggcaggcccaccgactcaagtaaaaatttctcacagtttggatgtaaaccaaatctattactttggaggttttatcttcctgaaagatttcaatattctctttacataccttggacatgtcttgatggcttcatgttatttttagaactattcaccttaacaaccaccgtttgctaaggtgatgaacatcacactaacatctacccataatggcatccaatgcacaattctgcgacgcgtgagtcacatagaaatttttcacaatgaacgcatccaatccattggtatgaaatttatggtttggtgctttttgaaccattccgttccggtgataaacttcgcaaaaccataaacccagaatggcattcaatgcccaactttacgttgcgtgagtcaccaaaggtgagtattttgataactgagcagaagaatatgactatagagttcgaaaacccgtaaacacgtaatattgcttgaagttacacattgagcttttgttttttgcgggcttcctgacccatcaaaccttagcttcatccctaagggcggcttgcaaaatggcaccccctcgccgccctttcgcagcgccccccaaacccaaacaaaaaaaggggcattctagagggcggcaatgggtctgcctacaaaaaatcctaggccgccctcacagcccttctgtaggtggcccttagcgcgaaaaaaatgctctctgagaggactgaaagaaacctccgagaggatggcaaaggggctgcctgcaaaatattcatccctcggcgggcagtcgttaagggggttccaatggccgtctgctacgtaggataaaacttctttccggagagcgttttttaaaaaacgccttctccaagggcgtgaggcgactagtattgcaaaatattgaaacaaaaatcatttttcaatattttagtaaataaaataaaaaaatccaaatcgacagtagggagaattgactgataggttggaattttgtggatgcctacgaaatagcaaacacgataaacatgcatgcagagagcaagctagctaattcggaaaccacacggaaaatattgaacaatagtttgtcccaaaaaaaaaatacttcaagagatatcccgcctcttcaacttatatattatgtaccgtgataggaatgtggcatgcatggttatctcgcctcattctcagtcaacgatttcatcagcctggatataactaatttatcaccgactcagattgaatcagtcgtgttgaaaaattgacatattattcagcgggaaaattaataacccttcttaattcttatgtgcctaggtagcttaacttgtcaagggatttaaatactcctaccatgcaagtagctagcatagccaagctacacacactatctgcagcagcgaactgaagtgaatccggcgaaaaaatttctgatctctgaagcaccatggaagctactgctcgacttcgcgtggtggcaatcctactgatgtcgtcgctcttgctgtcgccgccgtttcttctcgccgacggctcatcaggaggaggtagcagaggccgggagatgaagcacgatgatggccatctggttattgctccaagaaaattgacatggcctcgtcgagttctaaactctggtaagttcaaataggacaaattaattatgtctctctagatctccctctcctttgatgcaaattacagagaaattcagctgccagttttaatagaaggttgaactgaatcctgagtgaggtgcatacaattcacgttttcatatatacatatggctcttttatttcctgggtacaacttacaagtgaaacccacaccatacttacacacctgctcggatgtgttctactccctccgtttcacaatgtaagactttctagcattgcccatatatatatagatgttaatgaatctaaacacatacatatgtctagattcattaacatctgaatgaatatgggcaatgctagaaagtcttatattataaaacggaggaagtaaataagacttttttttttcaggcgatcaaccgaaccacgacccgatacataactctcctatctccccaggaagaagcaaaaatgaagtcaggcctggcaattgatgagagagtatccataaacacaaccacataaaggattggcatttaaatttttgctggaaacagatactctgcatttctgctatctgactttgagtggttgaaatgtggatctcacaaccaatggccctatgtgtcaatgatccaagtaaaaaaaaaaaaagtactgtacagaggagactcatcattttcgttgacagcctaaaacagtccaggaagagttttttttttcttcttagtttttttcttgggtgtgtggtctaaaagaacaacggcagtagccctggttattcagttatgatgttgttattgaaattattttacggatgtctgttcattagaatttagtggtaaaaaaagatattttcataggcaccctcttacattgcacatacagtcagcaagagcaattgtgcctatggaagccaatttctcgttgagcgcaattcctattttagttatccaaaacccctaataaagcatgacaaaagatggacaattaagccattgatataacgtttttcacgacatgtaccacatcattcaccatgatgttgtcccgttctttgaccatgaagaggaatcgataacaaatgaaaaaaaattaatatcgacctctttaattatgagtgggataagcatatgaaaaggaatttcacctagccacctatggaaattgttcgaggtggcttgctggtccacctgtgaaaaccactttgaatcgtctataaaattaactcttacaatagtgatactttgtgctaacacttattatatgttctagcactaacagttaattaattagtaacaatgggcggatgcgacgtaagatattgggcaagaattagcattttgcatgttaaacataatcaacgctttagtagctgtttagctcgcacgacggccgggtattattttttggtgaccaataattttttagatatcttatagttgagggaaaaaataattatgccgacaatggagtcgcggccgcgcgcccaaccggtaggattgcatgcaaattaacaagttatttgcgatacatgaagaaacacgcttcgacagcttggttgttccaatgtccgcatatcgtgtttacttcttcatatgcatttcttgtaagccctaatacttgattgaccccttcatttttgaaataataaaatcttcagaaagttatgtatgtaggcaatgattaattaataaatactccctccgtcccaggtttaaagttaaaagttaattttttataggacggaggagtaatagctagaaaaacatctttgtatggtcaaaatgtacgaatatccccctaggtttaaataaaggatggaccacgcctgctcacccatgccaaatgcccttccaccgcgcaacatctcagccaaaggtagcatatctgcactcggcagcatgtgtatacacaagcctattgccatgttttcacggcctagcattctccacattgcaaagaatgctaacgataactacagatttatatctaagaaagagggagaacttcatacatggcacactacatgctacatagctacgtgacatgcctcacgaccttctcccaccactcactcataaccctcatagtaattttgttactctcaagacacgctctccacacacatccataatagtaatatttttactgcaacagcctaaagagtgggctagggatgggaaaaagtgggttttctgggcttagaaggatgggctggcggcgagattggtggtgggtgttgacgatgggcagaaggcgtggcggcggagctacgggaatggaagcactagcggtgggtagggctagcagtatggatgagggaggccatggcggtcagtggtggtgaatcatacccgatggcataggggaatggtacccacactggcttaggatggaagagaggtaggggtggaagggggaggaggccggtcaggtatagggattacaagcaccattgacgtcttctggtcaggtggcaaggttaggggcaccagtcgggcgaggaggaagaggtgctgaaagactgtgcgcgtgagtgcgtgaacgagcgaagcgaagaagagatataaggggatacaagaagagtatgcacgaatctcaatgcaatcctaaccattaaaaaaatacttcatccgtcccataatataacaatctagaattgaatattttatagtacaacaaatttggacatgcattatgaaatatcacatctggttctaggttgttatattatgagacggaaggagtaactgaattgaatggtatttttcagttgactagacggtccttaatttttcaccccatgttactatctacctattgtcataacgtgtttttcttcaccgttgatcaacccaaagcatttgaattgacttgttggacgtctcacgtttgattgggtgcagacttgacaaacgtaatcacttgctttcactgcccatcaatgtcaaaataaatacaatgatgaaatattttctagtgtatatatgaagacagagagcgcatttgtgcatgttaaattggcacgcatgcatgcaaagaagtggtcttcgctgttccttttgacagtttgactgccggaatcatcacacagattgtttatgtctgtcagagtgtcagcagaaacatatcataattatagttgagttgaataggtcacctggataagacattgaaccttacctatgaagtttacgtatacagcaaacacatttttctgaataatcacctagggtgtgtttagttcacattaaaattataacaatatgacgaaaaaattgaaagtttatgtgtagaaaagttttaatgtgatagaaaagttaaaaatttaaagaaaaaagttgggaactaaccaggccccagcagagagagtaagagagcgcgtcgataaatagccgtacaagggcaacaggtcaggcacttattcagttcagttcagacatcacctagtacaatggcttcaccggcaataataaccatcctcgccgtgtccctcctgctgctgctgccgccgttagcgcttggctccatcaccggcggcgatcaacgacgcaaggagccttggattactacgatatgtgagcagtcgatcgatctctgaactttcagaaaatggaactttctggtggtaactaatatttaactgagcattaattactcatgtgttcatggcagtgaacggtggcggcagtattgcgggcatggagctgcagcaacgacgacgaggaggccatggattgccggtgatggtgagatcagcagcacggcgatctctcggaggacgatcgacacccaacagtaaggccaacacaacacacgtaatgaaaataaacattaagtaaggatactgcatataacaggaaggtaaaactaattagagtaaatttcagaaaactacatgttgtatggttcaaattgcagaaaaccacacatattttgacagttgacacttaagtacatatattttggtagtttagtttcacaaaaccacactatcaatgaatggattcacccgtgagatgatgtggttgttccatctaggatgaggacgtggcatcctattaatttcgtgcaatggctggtaataggatgccatgtcctcgtcctaggtgaaacagtcacgtcatctcgcgggtgaatccattcattagtagtgtggttttgtgaaaatacactaccaaaatatatgcacttaagtgccaagtgtcaaagtgtgtgtgattttctacaacttgtactacaaaacgtgtagttttgtgaaatttactcaactaattaatactccctctatctcaaaatataacaatttctagcctttagaatttgttctaaaatataacaattttttattaacattcttttcctaatcaatcacaactctccaccattcagttttcttacatacttccacttcttgtctaatcataaccttcccccatccaattctacctacttttttaataattgtctccaattctaaaaatgcttatattatgggacagagagtatataattaattaagtttaaaaaacatgttaataaaaattgagatagaatttgtatcttaataaaaagaatgagatttcagtactacgagtatttggcagtctattaactggtaccctgatcggccagttaggtgacattaattgttttttttttgttttttagaccctggtgatggtggacgtaaccctccagtctcccctgcacgagacagaccagggacggaagcctgatgaaatgggcaactgtgccctctgtgcccgagagaaattggtcccttggcagaatatccatgatttggtctgtgtaattttgtgcgaaaattgatcagaggcgccacacctgatctcagtctaatgggctcagtttgcggtgatgttgtactacatgctgacacaataaacctatctgacaacaatctgcatgccacaaccgaggcaaattgatgatatatatacagtgcacaaaatttattcagatcagattacatatttggataattttaccatcctttaatttagacgataccgataaatactatatttttctaatatcaaattttaatatctacgtgtactttcttaagaactataaaatttctcaatatatttagttacacacaagctagcactgtgtacgtatcatagccacagtagtgagtagtacactgggacttcaccgaatcagtctttggatactcactaactaaggctgtcgggcagagggcggtgaccaaaagcaaccctcccgcgggcagaccgacggcatcggctgcgggcgccagcgcgcccgtggagctgcaaaaaaaaacaacaacattaaacacaaattagtttgttggttcgtcgcatttacgagcttaattggtgagatcagcctgagaatatcgatcatgactgctcacaaggaggggtcaccggagtatggccgccgtccaccaccagcttgcaccggtagccgctcgtcgccgccagccagagcgccacggcgagctgaacgacggcgagtagacggtgtcgccgtcgcagcggcagaagcgccatcgcgacgatgtgctcaattagctcaggacggacgctaattaaagctaggtaaagtagagctctcgatcgatgcggtgaacttggccggccgccggtcggtaggtatgtacgcattatggacgtgcatgcacacaggatttgacaacagctagcaggtgattcacatgtacaagtggcgctgattagtcttcacttatatcctctaggacctctgctgtgggtgtgggcgtgtgcctaatgggcgatcgatcatccctatcccctctattacgctctctccccccttcctcctcccattcttctcttcttactacaccataaatttttaaaaaataaaaaaacaaagttggaaaaaattatgtatagaaatactatatataaaaaaaatatttgaatttaaattcaaatttgaaacgggtatgtaaacgtttgacttataaacttttggtctataaactttaggtgtatagaaatactatatataaataatatttgaattcaaatttaaatttgaatcgaatatataaacttttaacttataaactttgtgtctctaaactttaaatgtgtaaaaggtgtacaaactttaggtgtataaatttattaaaataggaaaataatacggtgccaaaaaaggaaaccacgtggaggagagggggtatcggctaatccgatcgctaggggcgatcgatcgccccatagccttttcgtctgctgtgctactactagttctaaattatttaaaaacactcgttgtattattttaaaaaaaaagaaaaaaacattttttttattaaacactcgttattttataagcaaatactattattttgattctactcactcgcaatttatattctatatttaacgctttgaatgagcttaaatgaaaattttgtcaactacgaacctgtagacatagtttagatatgtatacgactttcatatacattttgtctccatccgagatcatttagaaatattaaatatacaaatagatatgacaataacacattttcgcacatccaaatgtactcaaataaaaaaggtgataaactacagattgtagatcttgtcaagttctacaaattcataaaaagttaggtaaacaacacatatatgagtgatgtcatcatgagtgtcgattttaattgacaaccaacatctagaatcataggtgccggtttttattgaaaatcagtacacatgtgatctccaatatgtgtcggttcacaataaaaatcagcacctgttgggcgcactcacaagtaccggtttattataaaaactagcaactatgtaatgttcataggtgccactttattataaaaactggcacatatgacttggagggattattggtccttttttatgaattgcaccaataataaggttatgagcaattttactgtccttgaggaggtaccataaagtaccattttttctattataaatttggtacctcttgatacctaggtactacgaggtaccatgtggtactaaattttacactaaatttttggtacctcatggtatctcctcaaggaccgtagaattgctctaaagttataggtatcggttttaatttatagacctatgaaaaaggcaacaaaagtctcacatatgtcggtttttacgtaccgacacatatagtactagaaaagtgtttttcctaacgaccaaaactggtttttgtcggcggtcagcagtgtctctagcaacctaaggctagcgaaaatatatgattttcgctcgcagttgcggtctgcatgtaaaaattgatttttgcttgcagacacctatgaggaccggcagcgaaatctttttttttttttttgcaaaggaaaaaatcaatcaacactcagaaacggtgctgcattttcaaattcacatttagagatccagattcgaatcaattcaaatccacatcagatttagattcaaatccacatcaagaaagcactacatcgatattttccactacattttcaacgtgcaaacatcaacacactgaaataaaatagcaccaacaaatgtcgatcgttgtggcaccgtcagctatcggcgtgctggtcatcgtcatcacaggtggagtgagagtgagagaagaacttagctcggctagatccggagctgtgccaaaccagccgtcgctgctgagcctcaccgccctctccttccttctccgagtttgagggcgcagccacctgcaagagaggccactgccaccactccgtggatttagttttgtgatgaatgttctgggatgatttgatttgttgccgttggatttgtgattcagttttttaatgaaatttttggttgcatcgagccctttttattattattcttgagacaataaatgtgcggtttcaaaatcggcacctttgatttttctctgacagttgtttagttatttagttttctttagtactgtctgcaaatcaactccttgatagtactgatattaatttggttgacagagttgtttttcagatcccggggacggcggacgtgatcctccggtctcacctgcagggacagaccagggacggcaggctgattaactgcgcccaagatcgagaaatttggtgacttggcgtaaaaaaagaaaaactcagcacggactgaatgaaacaggacaacaaaataatgtaccctaaaatataagaaactagcaccaagtagtactactgattatactgcattgtgcatagttttttattgactataaattaaagctgatgcaaattgttgatgtgtgcaaatctgatgcaccaagtttattcagaaaacacacgtatagtagtacagtgcgttaattggtactccatacttaattttctcaatctttgttgctcgatacgacgacacatactatatagctaaggctgtaggcgcaagtgctggccggagcaaccctccggcggcgacggtggcggagggcgatttgcctttggagctgcaaagcaaaagggagaaaaaaaaatacatttcgttcgtcacatgtccatgatgttaatttgtgcgtgcaccggtgaagaaggatccggccgggctcgccggggccggagaagaagagagaaaggtactcacgaggaggagtcgccggcgtacggccgccgtccaccagcacggtcggcggcggcggcggtggcgggacggcgtcgagcttgcactggtagctactcgtggccgccagccagatcgccacggcgagctgaacgattgcgagtaagcggagtcgccgcagccgcgccatctgatcacaatcagaagaaacaagattttggagtgtcttgtgtctactatagctactgtactaaaatagcggcccggctgttcaggatttgacgacagcagcttacgtactccctccgtttcacatgaatcctaatcctgaagattaatttggatacacgctatgtccaaattcattcaaagaattatttctttttacataggaagtaattattagctcatcaagtgtacacctatatgccaaagtactcccttatactctcaggcatgctaggtagatagaagtgataacttattttttctaaaaaaagggatcatcacgtgataataatacctctaatatacatccgtcccaaaataagcaccaacctcatattagaatgtaacacatcctcataaaatataaatgatgtatcacattctagcatgagattggctctatgtccagattcattgtaatatgatgtgtcgcacctatatatattagtctaactaggatgatagcccacgcattcgcgcgggcatgtgtattagtttgttctgaaaatagttctaacaaaataaagtgaaattaaggtaaggtgttttctatttttaacagggtgttcattgtatctctttttgaagaaatctcgataaacttttgctggcaataaatgtttttttccaccttgtcaatcctctttttaattgattcatatatatgtgtaattcgttatgcatgtgaatcaataatgataagttcttttaaaactattagttatattttgaatgtagtgattgagtgattataatttcgaatttgttttcaaatcaaattattgtgttattctaaattttcattttaaggattttaatttgtacttaatctcgtatcgtgttgtatttggactcatcttttaatatttattttattattattccaaattttagatatttataacttatacttttatatggactgttttatattatacatgggatcttgttatacattttttaatagttttaatggttttttttaaaaaaattgaatgtgtattttaatcaaattgcttattttttctgaatttaattctgaacacctcggtgatagaaacgtctctctctggccctcctctcggtcctttgtccttcacctaatcatctagcatgctattaggcttaggaagtcatggaaagtctatattggcgcttccgtcggtgtccacctcgctaaggttgtgttcttcccccctcctttcccaacttaactctctcgttttcggtgcacatgctttccaaactaataaacggtgttttttctaaaagttttctatagaaaaattgctttagaaacatattaatccattttataaaaaaattaactaatacttaattaataataatctaatgtaatgagtcgctttattttacgtgcgtgggagagattagctccaaaacctatctaatgaacacaacctaataatatattgcagctccgcctccgttgagttcaggcccagggtatccaccatggttccaaactctttgatggtggttgaatctagactttagactcacatatttgaattcatttgtcttttcacagtgcaaattttgctcaaatatttgtagtcataatggctacattatctaaattttatatagtaaatatgggtaaatggatcttgaattatgtatttaattataaataacatgacaaaatgcaaataaattgagaaaagtgcatgtaacttgagagtcatgatcatttaactatctgattattattttttatatattatatgttagctagaaaataggaaatgttggctcgaaaataggaaatgttggctcgaaaataggagaggagactgggatcccggaggagagagttgaagggttgagagactacgtatgtacatgtgtgcccacacacggcggggttgggggtaccatattttcgtgtattggggataccatattttttttttgagagatctaatggttaaaattagtgggtccgcctatttaaagaaatatcaatggttagtctttttcttttttatcaaaacttttaggatttttttctaatttattagatcgtcaaatggcatcttaagaacatttgtaaaatgccatgtgacagtttgagagcgtttgtagggagttcaatgaacttttagtatataatagatgtttaatggattttagtatataatatatagatagatgtgtaaagaatataatgcagtaaactttcttcaaacattatatacgtttatgatgatgcagtctaggtttgcaaagttataattgtttgtttttaataatgaatgttatttcaattatccttagaaattataaaaggaaaggagagaaatatggacgtgataagggtgagcggtttcgcacgtgcgtacgtacttacttcatatgtacggacttatgggagagctggggccgttgtacattaatacaagggtttataatatcggacccactaatttaagtgaatattttaagggttagatattttgcttttgtagaatttctattatttatttatcagagcgccacgtggtagcttaggagtatttgtaggggtggcatgtagcgacttaggaccgatttaagtgaatatcgatggacaaatatttttgttacaaaataatataaaataatgggtacataatataatataatggtgtaaactttattttcaaatattgtagagctaatttatttatgttcacttgtagagatttgtatgctggtatattctatatttgtaaagtgacttttattcaaaatttattatcacttattattattattagtattattattattattagtgctactattattattattattattattattattattattatctcaattatataccggaaaaaaagagaaagaatagtaacgtaccttggaaaaaaaaggttatgtacgtgcatgcaccccctttaacagatcgcatgcaagcagtaacgtacctatatatggaatggaacagaggagttattttgagataaatctaatctaacggtttataatattggacccaccgatttaagtgaaaatcgagagatagatatttttcttttttctcagattttttagaattttttctaatttattagagcgccacgtggcggtttgagagcgttttgaggaagcttcattgcttatgatttagggggaaaatattgtttgtgaaggatcaacttctgtaatttttaatagaaactaggaaggaagcccgcgcaaatgcttgggtaacttatttataaaaaattactaaaagaagtcatacttcaccatattaattataagaaacgcttatttattatttataaaaataatgctaaagaatcctatatcaccatattaattaattataaggaccatagatcaccttataattatataaaaataaatgtctagacacaacaaaaagatcatctctacttcataccaaattgttcatgtctcacttgtgttcaaatatatgcataaatattttgaaatattactcctaccaattcatgggataaaaccattaaatttatgagtaagtatactattttttatgctggtatattctatatttgtaaagtgacttttattcaaaatttattatcacttattattattattagtattattattattattagtgctactattattattattattattattattatctcaattatataccggaaaaaaagagaaagaatagtaacgtaccttggaaaaaaaaggttatgtacgtgcatgcaccccctttaggaatggaacagaggagttattttgagataaatctaatctaacggtttataatattggacccaccgatttaagtgaaaatcgagagatagatatttttcttttttctcagattttttagaattttctctaatttattagagcgccacgtggcggtttgagagcgttttgaggaagcttcatggacttttagtatataatagataatagatagatagatttgaaaaatctcaatcaggttgagcaatcttcatcttggcatgcagaaaaaggggacacaatatatgttggaataatgggctaggcccaatttattctcaattaattctattggtccacaattaatactatggggattaatatcagcttgaaaatttaagtgggaagatctcaacttaaataaggagctattagagagcccctgttaaccggttgaggtggtggtgggacagccacgcgcgcgcgcgccgggctgggccgaggccttggcaaggtaggcaggcggctggtctctctctctcgttttcattttgtaacagacggagattgattcagtaatcaattcggttttaacgagagcgaattcattcgatgttaatcatgtgattaattacgcagattgaatccgagtgttatccttgcgctacaattcctctcagcaacagacagaggagtaacatctctctatctcctagcggactgtctacttcctcctcgattccccttccttttcctgagctgcttctggcttccccggttctgttcacttgcgcgcacgggtgatcaggacgagcaggcctccggaactccgtccagttgcgtacctgcatgggtaggcgggcgatcaagtttttggggagcgctcttgggcgcgactgctcctgttcgacaacggttctacactgctacatcttcgccaacatgtcgacggacaacaccaacactcgcactggcactggaaagcctcaactagtacatgagcgttctcagggtatatgtccattcccttaccgttaattatgctgctagaagatttttctgttaatgcttatcgcaatgttacaattgcgttactatgtgaatgttatacttattttatgaaaagcatgctcatgctgagcaccatcactagatcaattctcattgcaaatgtcatgtttattatcttgttggtggacctgcagccaattttgggtcaagaagaagagaacgaggtagcggagaggtttgaggtgatgttgtgtggtggagaaatgcgtgagatgaggattgtgtccgatatttcacttcgcaccggttgctcgatctgaagcattttcggatttgtgattctattttgaacatttgtgttgtggtactgaaatttccgagatttcagaaaaactttttaaaataattcgaactaattttagccaaatctaaacaaatttggaccaaattcaaaaaaagagaaaaaatttgaaaattatgacgaaatattttggtgtccggtgagggtccgaaatttcgggaattccgaacgaaaattataaacattgtgcatgggagtttaattacggggatgggaatttatcctcatgactccctgcctttcaatacgctgggggaattgggaggaaattcatcttcacttaaaatataatttccttctatactacgtaagactatcggattgaatccaataaacttctaaactgcctaagatatctgtccaaaattagagataaattagcaacaccataccaaaccaaccaaaatgacaaattaattctcagtccaaaattacatgcatggacagtgcagcaacaaccggcatccatgaatccataaaccgagagtggccaaacagctgctacttcacctgcactgcaacttcttgcgaatccttaaccctctgaatctgataggttgtcaagataatcttgcatttgtggctttgacacgacgacgatgacgaacactgcctgattctgatggagcagaagctgccatttcccgatgggcacagcaagctattcgaccgaggaatctctaccttcgctgccgatgcaacctcttgcaccggcagcaagctggtcgtcggtgccgaggagaagcccttctcaatgttgatgttattccaatacactcctataatcgataatattgtaagctaatatattgacgtgcaattcttttacgtcttcgcgaaaaaccggtaatgtcgtaaggaaatgcccccaaaagctcccacgtgttcacccttccaacctcttacaggctagatgttgaagaagcatcctgggccgttggatatcaatccaacgcatagcagtagtcgaccgagtagacattgacttgggccgtgcccggcccggcccatcgtgcttcgtgccaaaacgggccgtgccggaacaaccccccaccacggcggcggcggcggcggcgccatggcgaacagcggcaagtcatcgccggcggcgacctccaccaccgcgccgccaccgggtcggccgaaggcgaaggcgccgcccctcaccgtcgagggctaccccgtggagggcatctccatcggcgggcaggagacctgcgtcatcttcccgacgctgagcgccgccttcgacatcggccggtgcccgcagcgcgccgtctcgcaggagttcctcttcatctcccacgcccacctcgaccacatcggcggcctccccatgtacgtcgccacccggggcctctaccggcagcgcccgcccaccatcttcatccccgcctgcctcagggaccccgtggagcgcctcttcgagctccaccgctccatggaccagtccgagctcagccacaacctcgtccccctcgagattggtcaggagcacgagctcaggagggacctcaaggtgaaggccttcaagacctaccacgccattcccagccaggtgaagggttcatcagttcttggttgttctggatgaattattcttgattgattgatttggtcggaaatgtgtggtgaatttggttgagatgtgatgtgattgtaggggtatgtgatatacacggtgaagcaaaagctcaagccagagtatcttggcctccctgggagcgagatcaagcagctgaagctgtcacgtgtggaggtctgttgttgtttttttttttttttgatattgaggatgtctggatgaaatggaatacaattcacaatttagttatgttgttgatgctgtgcgtggttctgtttttcagattacgaatacattgacggtgcctgagattgcttttaccggagatacgatggcagatttcattcttgatcctgataatgcggatgttttgaagacgaaaattcttgtagtggaggtattgcttcttatcgtctatatggttaatttgttgtcaattgtcattgttgctattcagcctgagaaaaaaaaaagagggaaactgtttcttcaagcacggatatcagtatattaccaagattaattttatcaacagaaggaaaagccacagcctttgcttttcaggagagattgattccaactccatattaactgataactgagtaccattttttcaaactgaaacctttgcggaaccaattggcagcaattagtgggaactatgttgcctgaagcatgtttcagtttccatactgaatatttattgtccttctcctgacgaaattttaattatctccaaatttaacttagtgaactgtgttctggaaattgcagagtacttttgttgatgactctgttacaattgagcatgcaagagaatatgggcacacccatctgtttgaggttattcccaaattttgcttatttcatatttctgtggaagaaaaacatttcacctagcattgctaattttgcccttatcttttttttttatgtatgcagatactgaatcagtgtgacaaacttgaaaacaaagctattctgctaatccacttttctgctcgttataccgcagaggtgagctatctctgttgtaatccaattttacttatatcattttatcctgattcaattagtaatctgtatgctttgtttcaactctgtggatttattttttgtttcaagcaagtttcaccaatattgttattttttaatgccatcattatgagcaggcaaaatgtgcccacttttcttgtagcatcctcctttcctcttaaaagtacacatgtttgtgtttcattctttacaaataaatacatttatcttcaatttttttctcaccatcattaaacatttcatcacatccttttcaggaaattgatatagcaatcaataagttgccaccctctttcagaagtagagttcatgcattgaaggaaggtttctgacaaagatgaagtgatcaatcagaaatgaagcattcaaccttactctcctctcgatgcactcatgtaccaagaactctttttttttttggggggggggggggg

SEQ ID NO: 61414 - DNA, 6238 bp, Oryza sativa
caagaggaggtggccaccgccgctctagcgcccacccccctgcccgtcgcagttgccgccacgcccgacccctctctttctcttgcagactcgcacgcaacaccggccccggaaggtaaagagaggggggccactgccgccgtcatcaccaccactccgcccggccttcgccaccaccgccgctagcactggatctggaagttgcggggctacggcggcgcaacgggacgaggaagctgcggcggcgaggggcggcgcgagaggacgtggccaccgccgctctagcgcccacccccctgcccgtcgccgccgctgccacgcccaaccccttttttcctctcgcagactcgcacgccacaccagcccccgggaggaagagagagatgagggggggggagacgccgccgtcgtggccaccaccaccgtcgccatcaccaccactccgcccggccttcgccaccgccgccgccaacaccggatctcgaagccacggtcaccagcgcatggcggagggagagagataagagagagagagaaagggagggagggaggaggaaaaaagggaggggaagaaggattacatgtcgggcccacatgcctgtgggtcccttttttgaatgacatgtgggcccataattttttgttccacgtaagcgacacgtgcacgaaaaccgggtcaacaccaccacgtaggcgccacgtcagccaaaaccgcttgcaaaaccacccagggagtcaaattgcaccggtttcaatagttcgaggagtcattttatccggttttctggttaagggttacgaattagattcggccgacatttaagggagtcaaagtggactttttcctctggtaaaaatagaggggtaagtactaaaatataaaaattgggctgggtgtatgtgaacccccttaggtttattgggctccgcccctgcatttattgcatgttatctgaatgattatgaaaaaaattgacaagatagatcaatatataatatatcactacacaaatatgcaagttaaaattcaacatctacaaattgtaacaaaagtaacaaaataaactcaaattagtaaggtaaatttgcagttaaatttgttgtttttattataacatgtataagttaaattttaacttgcatatctgtggagtgatatattacatattaacctattttatcattttttttattttttttcataaatacaccatcattccaaattgatcatgatatatatttatgcaccaaacccaaaaataatttaaatcacatcaataaagacaccatgcacacattctctcacaatgcatgtatcgattaaaacaccatgctaattacatcttagcatatacacattctcccattgctatattatctgtattctgatgaaatccgtatccatatgattatatgatgatcaatttagaaaggagagagtatttagttgacatgtaataaactggtgaaaaaaaaaattggatagaagaagatagagctgacacgtgggttttaggtattttggttaaaccagtgaaaccaaaatatatggcatcagtggagggtggaacggcgaacaggtcaagctccatggacacgcgttgcgcccgcgcgcggcgaaggcgagttttcctccgcaaagctacatggagtgcgcgccgccctcattttcttctcccgcggcctttggagagagagagagaggcgacacccttcttcctcccccaaccctttcacccgcccaaactcatccatccatcgatcgccctacctagctactctcgatcgatcgaccgcccgcccgccatggacgtggagtacgacgtgatcgtgctcgggacggggctcaaggagtgcatcctcagcggcctcctctccgtcgatcgcctcaaggtggtctccttctccatctctctctctctctctctctctctctctctctctctctctctctctctcccgcccggatcgatctagctagggcatcgcgtcatggatggaggattaatttccatttctaattgcttgatcaatcgatcccctcccgtttctggctaaccaatcaaataccctttcgtcctttgtgatgccatttttggatttttttttaccgggtaaaattattcgaagaaacgacagatctgatcgtgaatcgctttgtgatctgattaacaatcacaaattcacaaataatgatgtgaaacaaaccagcaattttttttatgttttttgcgagtgatcttgaatttgtcattattttgtcagcgaaaaaaaaaattctcatcagaaaatgatgaaaaacgtgtcccatttctgttttgtcaccaggtgctgcatatggacaggaatgattactacggtggagactccacatcgctcaacctgaatcaggtgacaaggcttcaccctccgtagcaaaaatttgccaacattatcttacctacctgtctgccaacttctgttttcctgacgtgctaagggatgttagaaatttcctcatcaatattagtttcagacaaatttgtgtgaggttggttacctatcagatgaaattatctgatcaagctcattgtttatgtatgccagctatggaaaaggttcaaaggtgaaggtactcccccggcgcaaattggggctagcagagactacaatgtagacatgattccaaaggtcaggcccggctccaatttatatttgattatattctggagtttgtgtgtagtttgttgggcttagatggcactgctctactttattatggagagtggagacatacacaaaaacttattggaacttgggttttaagtgtcgcacagttaaatattcttcgcatgcgcatatgcaaatatttataggaaattctttttagattgtgtgatgattaatttcaccctacttcctttctagttactgacatattgtgaaatgctattttgtctagtttatgatggcaaatggtacattggtccgtgtacttatccacactggtgttaccaagtacttatcattcaaagctgttgatggaagctatgtcttcaataagggaaaggttggattctaattctaatgcgtgtagatcactccataactcaattggcaaatctataatacaattttgtacatgatatttggatcacagatccacaaggttccctctactgatatggaagctctcaagtctccattgatgggattgttcgagaagcgcagagcagggaagttcttcctttttgtccaagattacaaggaaaatgatccaagtacccacaagggatatgaccttaacaaaatgaccaccaaggagcttatctcgtgagtacccatgtttactgctgcttttctacctttttttttatttcacgaagaataagtgcttaattttattttcagatgtaagtagttgatttggtttgtttgtgaaatttatatttgggtcccatatggttcctgtatgtactcagtcgtatcttcagtgtacatttataccacctaaatgatccatgcacaaaggaattgtatggttttatttgtttatatacatatataataccttagaatcaacaaaagtcctgtcaaaaaaaaaagaatcaatgaggggcctcaattgcttttttatatgctctgttcaataaatctgcaacatggtacagtactacagtggtactcacatacggatacattcaggccaacacatacagatacatcaatttaattcctaaattttcataatgtacatccacatggatcaaaaatagctccccttcattgaaatatataaaaacaattatgccagttccgcagctgcacttattttatcatcacagagccatccttatacggtacacttcttcagttcatttatagataagcataagaattaggtgaattttattcattagcgatgaattgacacatcaaacttattcatacaatctgatttatgtttcatatatattttctgatattttggtctatcatactatttgaagaacctgaagttgtagtgcctcttaatgattcaatttattgagacttctctgctcccctttatttttttccagaaaatatggtttggatgataatacaatagactttattggccatgcagtggctcttcataaagaggataactacctgacagaacctgcaattgacactgtaaagcggatgaaggcaagtattgagtctttcaacttcaaaatattagaaaagaagctcggatcaaactagtcctgacagtctgatgaaattccacatcacactttggcgtacatacatcgaatagaacatcagctgggttatctgtggacaaaactaaagccattttagtcacaatatattgctggaaatcacaactatgaacatgacgtgtctctgtcaaccaactaaaccacttcttccaacccgttcgaaactagacattttactgctgttcccatgctatagttagcatatatggtcacttcactttcactcccagatattgccttttacctaacacttctttgaattattgcagctttatgcagaatcagtgggtcgttttcaaggaggatcaccatatatttatcccttgtatggcttaggagagctgccacaggtcattactattaaactgtgtcatcaattccagcaatcacagagatcataaatggttgattttctaacttgtttttatttgatccagggttttgcaaggcttagtgctgtctatggtgggacatacatgttaaataagccagagtgcaaggtataatttgtgttgttattgtgagttgaaccttccaaataatttctttggtgatttgggcatggtgatcacaatgtgaaatgaaaattttaggattttaaggtgcaaaagcaagaaaaaaaatttgaggggggagggcaggagatctgccaatttcattaaggaggatagaaatgatacaagttcgcctctcaaaggttccatagaagaaaaaattaggaatatgatgattattgctttgaaaaggaagaatagatcaagctgtcagagtttgacaaaatatattatgttaacataatccaggcttggatttcaccagttgtatgcatggtagatgctagtgctaatgaattgtggcatgacaatctaaaaattgttctagaagctgtaatgttaaatccatttcagtggtaaatatgtgattttctgatcaaacatacatgggcatattcagatagaatttaatgatgaaggaaaagtttgtggtgttacgtcagaaggggagactgcaaaatgtaagaaggttgtctgtgatccatcatacatacctgataaggtaaaacacttttttttcatacaaacaaatagttgccctcaaagggagtatatcttagtgattaccttcctaattagttaattatactgtacttttcttaagattatttgaaggagacctactatgtctgataaataaattgtcctttgttgcattaaatttatttattacttattcagaatcaaatagaagtatgatgcaatttagtgtctctcatgttagcctcctcagctcttctgtaaatataagtcatcctagaacattgaagtacttctatacagtatctttttcacttttgtcctatatatataaatgatactgttctcatggataaatgacttatcttttgcattctgaataacaatcaagggtgagttatttagttaatttctaagtcccagttctgtttttcaactccaaacttcaatttcctcgttttccgttagcacgcttttcaaactgttaaatggtgtgtttttgacaaaaagtttttacatataagttatttaaaaaaacaaataaatctatttttaaaatttataataattaatacttaataaatcatgtgtggatgatgtttctcgttttgcgtgcaaccaaaatctgtctacaaaaccccacattgaacggggccttagttcctattcacaagtccaaaacaacttatgcttaggattagaggacgtagaagtttacaaaatgttggtactgattagaattatctgctgttatatcaggttagaaaagttggaaaagtttttcgggcaatcgctatcatgagccatccaatcccaaatactgcagattctcactctgtacagatcataataccacaaaagcaacttggacgcaaatcagacatgcaagtattctgtatatcacctctggtttttatccattactgggcattacacctatagattactcttggt

SEQ ID NO: 61415 - DNA, 6263 bp, Oryza sativa
agtttgaacttgagatttggtgagaatgtatttcatatctacacctatctctagtatttttttcatgaatttacaaaacttttaggtatgattttcacgagttttcaacacttagctcattttcaccggatatgtccccaacatagaaatgaacaagtaatatgatatgatattttaacgatggcaaaagttcaactatatggatgatccacaattacgctgaaatttaatctttgccattttagttcgcttacagaggccttttgtatagccattttggaagcagcaagttgtggattgttgacagtaagtactagagtcggtggtgttccagaggtatgtgcatatatgtttatacatttctcttgtagaaaaccctgtactgtagttaattaggaaatttggagttgctgtcaaataactttttcctttttcaggttttaccagatgatatggtagtacttgcagaaccagctcctgaagatatggtacgagctgtcaggaaggctatcgatatgcttcctggcatagatccccaagttatgcatcttcgagtgagtctcaactcttgcatgttgcatgaacttgctgtgcatctgcagtttaccgtttcagctatgggctctgtgcattacatttcctttttttttctttagtttttagtggaaaagtgatttgcaagttcatttatattgatttggttgtttctaatatgtatctagatgaaaaagctttatagttgggacgatgtggcgaaaagaacagagattgtgtatgatcgtgcaatgcagtcaccacaaacagatttgctagaacgccttccacggtgagtatattgcttttgaaacattaacctatttttgtttacaatttttatgcactggggcatcaaatatatagggatgcagtccatctgatttttctacaatggtgtagatacctcagatgtggagcttgggcaggcaaactgttttgtcttgttatgatcatcaactacctactatggtgcctcctagaatatctgcaggtgaatttctgcccatacttttatcatcttctggagatctggaggaaatctaactagttcttttcccctcagcccactgaaggtattgaagaggtcccagatatcaggccagtacatgctcgtttagaatcagtagatgatacatgtgaaactcaaggaaaaggaatttagaatttgccattatcgaatcattgaccagcaccctttcctggtctgtagaatttaccttctctttttaattttacttgccctgaagcccaggaaacattttcgacagtagagtacccatgacctagtcaccccacatttggggaaatcctttgacatgcttttgaaagctatgttgtttgtaaatatcagtggtaacaccactattttgttatgtaagtggatgatccatgctcttgaaaactatgctgttaacgatcaatcgacaacatcctttggatttggaatacatgtactaatatttgttctttgtatgacgccaaaagcaccaaaaaaacaatttggagcgacctcaaaaaacttatcattaagaaagtcccattttgtagacactatgcataatgtcattaggaaaaaattctccagctttgatgaaggctgattgtctaagcacccaattctatgataatcaagattgtaccaacttcaatgatccttccctacgcctgccaattcgaagggaaacgaaccaaacagggtgttcaaaggcaggcaaatgaccggttggaagtgaacaattcctcagtctatatgccccagctagaacggaacaagctataataatcagattccaattccagtggaaaccatccaatgatcattttaaaccagagagtttgatcaaatgttgctgcaaaacattaagaaaattactgcttttggtggacgtagcggttacaaacagattgtttgtgacgttggaactgttaagatctgtgtaacgcaaaacacccgcttgcctaagagccaaattggatggcttatccgtcgatggataagttgatacaaacaaccctaaacaactgcctcaggccagagtgagcatcttcctgtaaagtgcttgctgcaaaataatgttacacttatcttgcaatttgaacgctaaacctaatagtttgccaacatataaatataatgttctatgccacaactcatcttgatttctcagcaactaagtctaagccaatctcaggtacaaccaaaactgacagcacagcaccccgtggcatatgcaattgaagccagtgctcgcacaactcacattcgcgtccttcgtctgatacccatgtcatcatctcgttccacctgttccatacaaaaaaaggagtgtaaataaagcacgtagtatgcccacttatcactaccaattagttttaacataatggaataacaaaatctcaagggctgatgctactatcaatagtagaggcaggtctaacgcaggagacaatatgtataatgtcctcaagaaacagtattgagattgtggtggttgctagctctttacctcagtgataagcttcttggattttttccctatatttgatctcaaatcagaacctcgccctttaggtttctttgctaccggttcatccaaaagatcatcttcatccgtctcacctgcaatcatattttagattctttttcttagtgaaggtcaaattggaaatgacaggctattaaccattttggctggtaaaaatccaacagatgtaacatattagcttgccaaggcatatcaaaatttccttcacatcatcacagtactctgaaatatgttgaagttgaatcggaacaaagggaagtaattaccatcattatcatcatcttcatcatcatcaggaaggcctccaaaatcttcaatgtcttccatgtcatccatttcatcatcaccttcaacatactccacctcttcctgtgttaacaagtgaatccatgataaatggatagttcatgcaaggtgagatgagcaagtctgcactcagtaacaatgcttacttcttcctcttcctcagtaggagctacatcatctttttccatttcaagaatagtgtcaaattctttgaagggatagttatagatgtcaccatagacacctttcttcaaccgttccttcaattcactttcaatattctgcatgacaacaggtacatgttcaataaggcaaaccatcaaagggcgtggatagcatcagaaataataaccttttccaactgagcggccttttcagctttatccattcttctgagatggcgctgagtctccttcctgggcattgtcatcaccttctctctgataaggggagaggaatatgattaatctttccattgcatcagagagaacagcagaaagttcacaaaaagagtatacatcaacaagcaaatcagattataatgaaactattacactaaattataccaccaaagtagaaacttgtgagatattgctaccattattattttttccattagttttaaaaagttctgcaacaatgtgaacacagtgcatctaatacaatcttaagaccatagaacaagtcaacaaaatgtgcaacttcaaaattctgtaattgaatataaccaaacactgagccagttcttattcttaaatcctagtacacaatttggcactgacagtagcgctggttgtggcagtatgaaatacatagaatgcctataagacaatcaaccaaaatcggatccccacccccatctaaaagcaaacctataaatcaatagagttcaatctacagaaatctgttactttatactactatgtttcttttttaatgacaccctacaatccgcatcttcaacctttcaaaagttttactgctaatatatttggaactactgaaaatcacatcattaaatttgtaattaggaatactttcataataatataattttattattatacttaatgcaaaagtataaaaataaatggtcaaagtcacatcttgaagacagaaaagtaaaacaacaaacaagtaaaaaggaacaatgccctttgcaaccaaaacatgctaaacaggtaagtacttcagcaaccatcttcccacatggcatgtatctcagaacagttgtcccagatttaagattttcaacctgatgagttcagcactctaatagaattttatcgtgttcagcttaagaccataatgaaaacactatggaaataaacctaagagcctacctcactttcagttgaagcttcctcattcttatccgatactgagtcatttttgtcaggcgctgcttaattttgtgcacaagtaacttgggccaaaattcctacataatgaaagaaagacaagctatgagacttaaaataaaagttcacatccagatcgaatgacaaagctcgaagtgcatacaagatgcttattgatgacttccattgctttctcataatttctgggtagtttgaccctctcccataatttgttcggaagatgggctctttcagctgttttcatgtataggtagaaaatacctgcaaggccagaaaaaagagagagaaatgaaacagaatgtaacaaaaaaaatattaagatggtatacataagttgggaaagaaccgggagcaaaacaatgtgcttaacaagtatgcttagactgcaatctgtatccttggacgaaaggattctgaagccctcatgtttcatccagagagcaccacataatacagcgattcactcgtaaaaatgtaactttctgcagtaccgagttcttgactttaaaattaactaatgaaataagcttccatggtagaccgcattatcttaaaacagtcattggttgtgtttgaactgagggtttatcccatccatagactcacaatatcatcttgatggcagttaataataacgatcacagtcacgactaaataatttccctcgaataaagaccaatcgtctcccaataacaactgtaaatgtaacccaatgtttccaatagcaactgtaaacataacccaatgcttcctaaagctattgccacaaagggcgacacagtgcatcatcgaaacggttgagctaaaaagatatttcgccccgaaaaatggaggaaagtgcggggtagtagtactcaccgtcatggtcccggatggtggcgtaacggctgttggcgagagggcaggagctccggttgcatattccggtggcgttgtacgggttccggcagaatatccccgtcgtgatcctgccgcaaaaccaaaaccaatttatcgtcagaaatcaaagaacaccacagcgacgagagaaagaagataggattgctgctcgcatacgtacttggccatgaagctgcagtggttgtgccggatgcagtgccatatcacgtcgtcgctcatcttggccgccgccgccgccgcgggctcccctccttcctaagatgctgctattggtactagaggctggttaggcgagagagaaaagcttccagatctacaagggaggagtgagcaagaggatgggcgtgggtacgggtggtcacctcaccggcggctggcggcgcggcgcgggatgcagtgggaaggcggcgcggcgcggcgggcgaacgaaacggggagtcgagggcgcggccgaggagaaggggacatgacatcatcatcatcggctagggcaaattaatactgacaggtaatgggctttggcccactcaaggcccatttattcttagagcggcccaaatccaaccctaggccactatatgaaggaataagtccactttgaccataatctactctgtgatcatgcaccacaaaactagatatcttgacccctatatggtgctgacatggctaacacatgacacctgctttgcttctttctgtctcttgctcactcctccattgtactacctccgtcccaaaaaaaattgcatttctagctctaaggctttgtcccaacaaattgattcatctagataagtttccttaagttctctcagcttgtaatttaggtatgctaattatatgggttaattctctaaacttacttttaatcatttgtatatatgaaatatgtgcatgcaatgggttcattaaataaggtcattgtggtcatttttcaatcctactgttttgtcctaaattagctagaaatgtaatttttatgagacggagggagtattataataggaaaaagtacaaattaattaccccctcccgaactatcacggtcgattaaattacccccttaaaacataaaaccagacatctcacc

SEQ ID NO: 61416 - DNA, 593 bp, Oryza sativa
  unsure (1)..(593): unsure at all n locations
cgcgtcttggaatcgaatgataaccncctcggnaccctgcacaagaagttctaatcctctaggaaacattcccgtacaagaaactaactttacaaactccaatcgttccaaatttggacttcctccaaattcgactccgcatcccatacgcacacaatacctccatcgtatgccatatggaatctggactaaccatgtgcattgatctttagcctaagtatcccacataatatctgaccgtccggacgtctccttatctccaagttgactcccaatccgctatactatctcgaggcgtcaagatcacctacacatgaatcaaacaagaaaccatatctcgagcacaagctatctccaacttgactcattgttagcaaacaacagtattacgtacacatagtatccatctagaagtcataaacacaaattatccacaaatatccaatgaaataacccgaaactaaaaccgacacatagtcgaatggtcagaccgcgggctggttggtctgaccacacgtatacctctggtgtgaccggcaaaccttgaccggtctaaacggtccaattatccagtagtccctgtttatcatctg

SEQ ID NO: 61417 - DNA, 542 bp, Oryza sativa
  unsure (1)..(542): unsure at all n locations
ccgtatgatgtcancctactctgnacccactcatcatattatatgattttttagctaaggacgcagtattaaattcattgacattgagagtgtgctccggatgccactatatataaatatataaatagacagagggagggacagggagagagaatgggtatctcaaatgctctgcaatggtgggaggagtggcagctccgggttcttctcttgggcagcctcgctttccagtacttccttttcattacagcctcccggcataagtttcctatccgatcctacctcagatcctttatctggtttgtatacctcggtagcgatgccctagcaatatatgcccttgcaaccctatttaaccgtcacaagaaacaggatgttggtcacacacacaacaacgatgtcttagagattctttgggctcctatcctactgattcaccttggtggacaggatagcataactgcctacaatattgaagacaatgagctgtggatgcgacatgttctcacggcactgtcccagatcaccgtagccatctatgt

SEQ ID NO: 61418 - DNA, 2316 bp, Oryza sativa
aacacgctagccctgtatccatgcctccttgggttgtcttcttccccccattttcccaacgcaactatcttgttttccacgcgcacgcttttcaaaccgttaaacggtataatttatgcaaaaattttctatatctaattattttaaaaaatcatattaatttttttaaaaaaataataataaatacttaattaatcatgcgataaaacgaacttcgttttgcgtgccaaaaaggaagggttcctaaccccctcctccgaacacattctttggtgggtcgggggccttgccttgtgccaagctgcaggcatcgaatgtgaggcggctcaaccaggaagagttgaagcctagggtagataagaattaataagagcatatccaacaacatctctaaatacaactttctaaatacctattttgccagtttgccaaagagttggagagtcaaatttgcatttcactccaacgatctctctattaccttctccaattttaatagtgggtcccacatgtcaatctctaccattcttcatttcttttcacgtcattccctttccccaccctcccgccggtggatgcgcaggtgatggcacagcggctgctgctgctcgaggcaagagggctcgcggcgatgcttggcggcggcaggggcggtgatgcaaatggcgccgcaccgctctaggaggcccctggcccatgtggcgcctgcgtggaaccccttggccgcgccaacaacagcctccacgtcgcaggcgacgtccggcgggagcttctggaggtccgtgaacaagggttcatcctcctcgccatcaccaccgccaccggcatggcaggaattgattgggacttgcgattcgttttcctcactgtgcgtgtcgtggtttcgccttttgcggtggcgacggctctacgtgaccgtggcgcagcgacaatgacaatgactgccgcggcgaacggtggcccagacgacgatagtcgcggcggatggtggcccaaacgccggcggcacgctcgtggccggcgtgtcctccggttcggccccggccgatgcgctcaagttgctgccttgctggtgggtagacagaaagagaggaaggatcagactaggagtggtggtgggacctacctttggccagtggaggaggctggctacatttggtctgtcggaggagcaatttggtcatccgaatgaagaatctgttggagctcattttttctctgtgttggtcaaatttctgttggagatgctcttattttgtctaaaaataaatggagtaacaacttagacataatcaattattacgaatatcggtatggttcgtagtatcaagttatatctaatttagttgtagattattttaacacagaaaggtaatggttgcggttattggtcgatcggcggggcacaccgccacagtcaggttgaagcagctcgatccatgcgtggcggcgagatgctgccgaccgaaacgttagggtctgtctaagaagggcgacgaatcggtatggaagagactgatttgcataaatatcggagatttaaatgcataagttaggaccgctcccgcttgtaccgaattacccgatcctaggggttctatttgcgtacgattgatagcgattcgaattagggattcgtttgcacgaattcatattcatgtggtcctctgtatgggtaatcctactggaagccgtcggatcagcacgacagtcgacagcacctgtgagtcctgtgacccttcggcggcggtggaagaatcatcaatcatccgcgaggatccctggggcggagctcgatcaacccgactctccgcccatatggtctcatgcattcatggtgccgcacggccgcgcgtgaatgaatgtaggggacaccgggacagcggccaacagctgcctcccggtcactaatcatcgtttgttcagatttgaaatcaagtctattgttaatttcgaagtgctgggagttcacagttcagtcgggaagacaggacctctcgtgagcaaactagcaaattgaggtgtaatctactaatcttgtattagttatgtactacttgctcctttccaaaatgtaagtcattctaatatttttcatattcatattaatattaatgaatctaaatagatatatatgtctagattcattaacattaatatgaatgtgggaaatgctagaatgacttacattgtgaaacggatggagtaccttcctcttaaaaatagttatttttctagtatttaaaatgagaaaaatggacatttggccacgttcaaaaaacggtttcgttggaatgccattcccaaaactcgttt

SEQ ID NO: 61419 - DNA, 3751 bp, Oryza sativa
cccgcgccgacgccgccgtcgtctctcgccatcatctcgctgtcgtcgtcgtcatcaccgccgccgccaccgccaccatatctctggggttgccgccgctgcctgcgcgaactctctctctctctctccaaaccgccgccgcctcgtcgtcgtcgtcattgctacgcctgccgacgccgaccccgactccgccttccgccgatgccgaccccgacgtcgacgcggccgccactgccgacgacgcccccgccgcaccgcgccatgccgccgccgctccttttcgctgccgacccatcaatgccgaacgtgaacgaatgcgaacggacatgaacgaacgcgaacggacgcgaatgaaacgtgaacaaaacgcgaacgaacgcaaacgaacgtgaacgaactcgaacttaacgtgaacgaacacgaacgaacgtgaacgaaacacgaacgaacgtggaggaaacgtgaacgaacgcgaatgaacgtgaattcacttgaacgaaacgtgtgaatgaaacgtgaacgaacgtgaaggcacgtgaacgaaacgtgtgaacgaacgtgaaggcacttgaacgaaacatgtgaacgaacgcgaacgagacgtgcacgaacgagataattaaacgattattaaacttagcatatatatatatatatatgattatatacttgaaaacgtgaacggaaaatatatgttcctttgcgtttagactaatacatttttttgcatgttgcagataagagacttcgtcgtcgtccctcaagccgaagtggtagctaaccctcggaggaatttgcgcaggcaagtgatataaagatatgattatctagagttctaatatacgaaacttagacttagcatatatgattgttagagttttaatataagattattagagttttaatatacgaaacttagacttagcatataagattattagagttttattatacgaaactttgacttagcatatataattatttgagttctaatatacgacacttagacttagcatatatgattgttagagttttaatataagattattagagttttaatataagattattagattattagacttagcatatatgattattagacttagcatttctgattattagagttttaatataagattattagagttttaatatacgaaacttagacttagcatatatgattatttgagttctactatatgattattagattattaatatataattattagacttagcatttatgattattacagttttaatataagattattagaattttaatatatgattattagagttttaatatacgaaacttagacttagcatatatgattatttgagttctaatataagattattagagtttttatatacgaaacttagacttagcatatataattattagaattagcatatatgacctatagaattagcaaatatttcttgtatgaatagatggttgatcgcgatgacgaacagatactataccatacaatcgcagagggaagcagccagtactggaacgaagaagaggggaacgaggatccaaaccagtacttgaacgaggaagggaacgtggagagggatgcggaggggaacgaggatgaggaggctagtggaagtcaaccctccgctagacagaagagggcacacggacaacgaggtgccgcgaagaagatagagggttggcacatcataactgaggtggacgaagacggctgacctagtgccccggcagaagcagccaagaattttgtacgacatagcggttgggttgtaagggataacgtgcctgtcagcaaggtgtactggcgcagaacaagggcacgcggggattatgacagctttgtcccagaatcagagaaagagatgttgtggaccacaatgctcgagatgttcacgctccctgcgggtacggagaacatagtgaaacagtggactcttaagaaaatggcagaacagttccagagcttcaagggagatctctacaagaaatacatcctgaaggggctgacactgaacttcgacgtattcccaaagctaagggatcattgggacgagttcattgcttacaagacagggcaacaagggcaagcgatgatggacagaaacaaagaaaataccgccaagaagaagtaccatcaccacctggggtcaggcggctatagcgtcgcaatgccgaagtgggaggagatggaagcaagcattattgagaggggtatcgaacaggccaccgctaaatggccgtatcgatcgaagttctggtactatgctcacggtggaacgcttaaccccgttgatggctccctgatgttcagcgatcagatacgcgaggctgccagtcgactaacggatgcagtggaagcctcttctcagggcatgttctgacccgacagagagaaggacgagctgtcactcgccctgcagactcccgagcatccaggacaaacacgagggaaaggcgtggttccttggaagattggattcaaggaggacatccacacatacaggagtcggatgaggagcaagagagataccgaggcgaagattgcagatcttgagtacagggtatcgagctacgaggcaagaggaggtggcaaggaaggtggatgaacgcatggccgcacatcggtcccaggatccccagctgtacattcctcctgtaatggttagcccctcaggcaatcgtagcagctgcgcctcaacggggcaggtaggatcacagagcatggacgccatgcaaactcaggatgaaaccacctgccccgttgatgagatcacgcagcggacaccatgtgagctgcatattcccttcaagaacttatcaatcaaggtatgttcgtagttttatgatttatgctcgtagttttatgatttttgacttgtacattccgcaagttgctacttaggttgattactaatagataacctctcatcacgtgaaggtggcgttggaaatggccatcccaacggacccttcagggacttaccactgtaggccggttccagcaggatactcaagggtcgaagttgagctggtggaagccgcgtacgaggacctcgagttggactaccctggaggagacggtgagacgcatctacgagacacaagccacgccattatactatggcgcaagcggtacatcatcctccctaggcgacaagcggcgtctcgtgcaccatctcctccggctccgccatctcctccgccacctcctcctgcaccatctccttcggctcctccggctcctccacctccactgtgtccacctgcacctctcaagacaaggtctcgccaagctccaccgcctgcccgcacaagggcaacgaagaaggcgaaagttgacgccaccaaaaacaaggagtcgccgtacgattgcagtcaagaggagcttaatgcttatgtggcaggagaagtgaagaggcaactcaagcctcggagtcctgaaaagaagatacctgttgacccgagcgtgaagaacttattcaagaaaatgtccacaacaaacaaggaggtcttaaagctatcggactatgaccgaacacttaagaaagcctattacaagaagtccaaactagtcccttagcttggagaacaaccataccaacaggtcgagccgttggtgactggcgaagaaattggcatagcagaattcatttctgacaccagtctaactgtggatcagttgattagaggcgcaccaatcctgaaggcggaagtggcatacaagtttgaactcggtaa

SEQ ID NO: 61420 - DNA, 1991 bp, Oryza sativa
gagtcttggcatataccccagttgagcgcctgtgaagatggagccgtaggctgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagatggtatcagagccatctcgactgtaggataagccaagtggataaaacctaaggacatattttataaatgaaactatttgcgaaagctcctctttttctccttcccctaatgctatttgcaaaaggtttactcttttcttccttcaaatttcaactagtactagatggtcagctttgctaagaagaagatatcgccaattgtttgccgaagctccggaagactgcaggatccgctagcgaagcaaaggaagcagtgaagccagatgtgaagcaggagtgaagatcttggaaaacccatcgcagaacctaagccgtcctctagggtagagtcgtttgtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctttctctcccctttgttttccctctctccctctccaaatctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggactcatggtgacgtgccacatgttgacccaaaagaagcaagtaacatttgctttatgtgtgatgagcaagggcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctagtggaggtagagtgtctgatagtgaagattcagatcaagtctcctcagatgatgaagatgaaatggaacgtaaggcatgctctcgttgtggagaagtcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaagattaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcagcaaattgtcatccatgcatcccgaagcagtcctatagcccgcgttgcaacagctctaactccagcgagtgcattactgtcgcgaccgggaaaattgccttttcccgaacgctagtgtattaatccccgtcccaggaaaagccggggtacaccatacaaacatgatatgaaaggcacatctttattaacatcg

SEQ ID NO: 61421 - DNA, 9898 bp, Oryza sativa
cgagagttgtggatgcttctggtgacgatggggtcctttggcttgctgcctttcagtgaaaccttgaagtgtttcgccaaaagctatactaactgtcgttgcctttgatccgaaaaggactcatctgtaactcttagtccaaacaaatgtctctttggttaatcacttgatttttcttttccatcctcaggttggttattagctcgaggttagaatatagttcctctgacacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttatgattaacacgaggcctcacaggtatgacgtttgctccagtgaccacaaggcgagtgacttgtcttcttcttgcataatggccggagtgatgacgcaggttacgcttcggctgtggacaatctctcgagaaatgacctggttctttgcagttgtaacaaatcaacgtcttctttgctgagttgtccgcctgggaacgatcgtcctgactaggagttggaattggtggttggaaatccttgctaacattggcatcagtggtaccattattgctatcacccttggagtctttctcagagtcaaaattgctagggttgccattctgggtgccttcattgatactatcgtcgatatcttggtgaatgatgttgttgttgtctacattgcgttcatcttcttggggcaggaactcgtgatacccaacagaagatccgatgatctgaagtggctcagtgcgctgtctttggttaccacctggaaatactgggatgttgacaatccttctcttgcagttcgtcatccgattatgctcactttcaagttgcatggctttgtccacaagtttctcaaaattttcataatcctctaggagtagttgcactgcaagctcatcttttaacccctggagaaacttctcttgtttttcttcatccgtttccacatcttctggtgcatggcgagccaaacgatagaactcgtgcaggtactctgtgacggtcaaatccccttgcttcaggtagcgaaactctcgttttcttagtgtgatcattcctgcgggaacatgtgatctcctgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgatggtgcgcaaccactcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggttgcgttgatgcttctctcattcccattggcttgggttcttgagtcatcggatccatcattcccatagccttggttaccaggattatccatctgtcacaaggtagaggttgagaggggaagcatacaaggagagaatagaccagaactagagacaagaccttaaaggaactaactcttttttttgttgatgtgttgtttgttttgcttattctgcaggttgattaagcaaacaacctagcatggttacatcaccacccaccgatgcaaaccacgcgctacacacacaagcaaggaaacacacgacaaacgaaacactagagggtggcttaggttctgcgacgggttctccaagattttcactcctgcttcacagctggcttcactgcttccttcgcttcgctagcggatcctgcagtcttccggagcttcggcaaacaactgacgacatcttcttctttgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccatacaaacatgatatgaaaggcacatctttattacatcgataatatttacattattacaagggcacttcaggcctgacaaacaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaaggggataataataggggttaggttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccatacgacatctcgactaccgggccgcagctcgtgtagccttcatttgccctggagaatgtccatcgacacccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagagaaagagaggtgtatgtccaattccaccataatccaacaattccatagtgtccaaatgatatgagaattcccaaagtctaaagttagaaaaccacctaatgttgcctaattattcagcgaagcatctacctaaatttatactagtggaaccatgaatagagtacccactagttggggtttttattttcctagggtgaacaaggtaataataataacaataacaataataaggtcataacaaaggtaattaggcatggctagataaaacagtgataacgcgggaatttaaataaagcggtaatgcaataatttaaatcaacataagtttacaaactgggtttcaatatgttcaaggatgatgtgacttgccttgctcagagagaacggccttccgaaccttcggcgacgaccacgaaccacgctttggaaacctccggaacgacgaaagctacgcgaagcacacaagcaaagctacaagcctataaagaagcaataacaatacataaaaacaaagcacagggttctttaggttataacaagcattaggagacttgaacgggtcgattcggagctcgtatgaccaggatatgatcatccgaagtttaatgctgttatatggagatttgcgaattattataattaagctttgcaattataaaacatgtgtaagcgctagcccggaaaggacaggaaggctgcgccgttgacatgcggaccccacatgtcaacctaaaggaccgcggtagaccgagtacacagaggcggtccacgggtcgacggaagcggatcccgtgtgtcaaccgaggcgagtggccgacaaacggactccactagacaccacacggactgcacatgtggaaaccacgcggctaccgagcggacacactaacacggtcaccacgcgcacaagctaacgactgccgacgccgatacacgggtaccggggccgacaaccgcacaacgggcacgggggacaccgaaaggacgaggacagggcagcgagggagagggaaccttaccaccacgcgacgaggcgtgggaacgacaacgacgaacgggcgcggcggaggcagacgggcgcaacggagacgaacggcgaggggacggcttcggcggcgatccttgggcgaaggcgagacgcggccggcacgaggcttgacgacgcggagccgaggacgaacacgaggacggggctgcagcgatcttgacgaagcgaggacgacgaacgagaacggcttgacggagggacgaacgccacgacgatcgggaacgacgagaggacgaggacgacgacgaccggggccggcgaggaggctacgagggcagccggcgaggagacgacgagggcagccggcaacggctgcacggaggcgaggacggcgtggaacacgccgcagcgatgacgatgacggaggcggcgccgcaagacgacgagccgggcgaccgatgggacgtcgacgacgagaacgatcggagacgacgatgaaacgatgatggcaggcagcagcggctgagcggaggaggggacggcgtggaacacgccgctgcgatgttggtgaaggtggtggtgcagcggggcgacgagccgacgaggaggaaggagaggccggcgcggagacgacggcgttccggcgaaattcgggcgaggaggaggtgatgccggggaagaaggcgatgccgcggtgtcgaaggaggagacggcggcgtcgatcggcgcaccggcgatgaacagcagccggctggagggagtacagtggcaccaatgccactggttgccggcgggggcaccgttccggcgagtttccggcgaggagacggtgaggccggtgaaggggacggtgttgcagagccgagggaggcgacgacacggccggacgatgctccggtgaggagggagaggcggctggaggccggccggcgtcggagagggagaaggagaaggcggggagaggtgatacgaccacggggaggctcgggaaggggctaaaacgatagaacgaaggatgaggatcccattttataggatgggggagagagccggccacgggaggagcgggaacggcgacgggaatggcggccggcggcaaaggaaggcggccggacttggcgcggccgttcccggcgattgggggcaccattcaaggggaaattaagggggaattgaagaggagggaaaggggattaattccccctaattaatttggaaggaacggttggatccggggcggatttggaggaggaaacgagctagggttccacgggagtgagaggagccgggcgggaggaggaagacgacgcccgcctgacgcgcgggccccacgcggtcgggcggcggcgtcagcgcgcgcacgcgcgcggcacgtgcgggaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaaaagggaggagaggaggacttcggactgggcttggcccaaaggaggaagaggagggacttttaggttttctttttattgaactttgataattgtttttgttgtttaataattatttccggtgctctgaaaattcaagtaaaatttgagggctcctttttagaccaaggagaatttaacaaaaattctccgggccacatttgaatttttcttgcacgtattttagtgtttgccaatttctttccgaattttaattaattctattattccttttagaaaatggattttaatttggaatggatttatcaggacgtgacaattaccacaaggtgtcaatgctcactttcagccccagccatcagttgacaagacagaggccagtatcggcattgtacctttggatgttccagcacagcagccaagaaatcaagtaccagatggagaacccgagcataagaaagttattgtctgttacaactgtggtacctgttaaggaagcggacatgcccatcgccaagtggtcactggagcaaatgcagtacctgttaagcctggcgctaatcagaagcaaccataatactcttatatcagtgttcaaatacttttgttttatagttgttccccgtcaatcatgtaataacagagaaacatgagataatgaatgagcttgataagtttattgagggatccgtgttaggattgcaagtgctgtgagttgtgtacattttgttgctgattagggagacctagggtctcatttccgtaagctcataatctattatgaatcaaataacctagcgattgatggcgaagcaaatcaagtgattaacccaagagacatttgtttggactaagagtttcagatgtgtcttcttcggatcaaaggcctacacccgttgtggagaaattggacacgttgctagcatgtgtctcacactctgcactcactatgaagaagaccatccaccaggggagtgtcccactcgcaaggtgacatgttttctgtgcgaaggaacaaaccatgtgcccaaggattgccaactcagtgtgttgttgaccaagaccgcagaaatccaacgaacaatcctacgattgtctcgtcagctagtcagctccaacaacaacatcgatgatatcatccacagcaccaatgctcctcttgctccacctaactctgcaataaatcatggcaataatacctacagcactaaccattctctgcaccgacagccccagcaaagaattgtcgtcgatggaagaagttgtgtctctccccgacctactccaggccaagcaaagggcaatcgacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaataccagctatatctctccagaatcaaaatgagcagccatgtttgtggtttccagttcgctacttatcatggtgtaatcgaaagtttgcagcaatcatgtaatacagaaatatattcatgtctataaacagtgagcttgctatgcttatggatgattcatgttgaggatacaatgtaccgatgttaagcaccgtccctttttgtttaaggcagtgccttgtattcatgtaatatgggagaaatttgtaataaaaacaagtcctaagaggattcttttggaagatgcggatatgtgatcatgtgtataattgtttactgacaaaggagacatagggtctcatttcagaggaactatgttccaacctcgagttaataaccaacctgttgatagaaaagaaaaccaattaaactgtgttgggttaaaaagccaatgagacagtagttgggggtaggagtttggatacgccttttacagatcaagataaggattgttggatgaaacccataagggtacctgccatgcctctacattgataagttcggatatacctgcaaacagttaagaagatccaggagacatcaatgtttgagaacatagtagtcgatggttggtaattagtctatcaggtatcagaagagggtcaaaggtgatatggcagaagaacaatttggatgctccccatctcgaggaagcactaaggatgatcatcggcaattaaaccctagtggcatagatacagatagcaagcaatgtatttccctgaaggtagtcagtacagctttctgacaaaccacatcaaggtgtcactgaaaggcagcaagccaaaggacctcatcatccccagaagcgtccgcaatccacattaaagaataccacctgttagagataagccgaaagaagattgataaaagagattggcaaagatgttctctagcatgaaagaagtaggccgaaaggtgattgataaacagaaacatgctctgcatcgctcaaggaagacccctaattgtaattgccccgcaacagtcaccttgtcattaagtaagcaagatgacctaggtaaaagtgtttttatgaaggcaaagagtgaaatcttcaactcggtatcagatgctacacggagtgaaaagtacaagcaccggttaccaggcaatgccatgacttgggagatgatccaatgggaaagaacacatcaaggttaaaggtgtaaaggaatacgttgaatgctaactgaggacaacctgaagataataaggggaagtaaactgaatgtaaagaaagtgaatccgagttgattgttcgtgagggctattcccagttatgaatcaagtgatatgttcgaagataatctacaggggtcagattaaaagcacatctaacaacgaagcctcagatttgacagggtaatgattagacaataacaaatccagcaataaagccattggagaagacgtcaaagtatgtcaagtgggataaactggttctcttgggaagcataacttatagttagagtggttgacccttgcatcgaatagcagaagtacctagcaccggagaccaggaaagctaatatgagacagttggtggcaagttagaagtgaatgacaggcatgatatccttatgatgacaaacctggtaccctagtaatgacaagctagtgttgacgcatgacataaagtggtgacttgtatgaggttgactccgaagatatgaatcatgagaagttcgggaacggaagcatcattgaactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttccccccttcctctcttgggccggctcggcccaactctccctccctctctctcctctccccgcggcccatcggcctcctccccgcgggcgcgccgctgacaggcgggcccgcccgccaccctcgctgacgggtggggcccacctgtcatccctgacctcgcgccgcgtccgccgcccgcccgtgccctagcgccgccgtcgccgcctattccgccgtctcccgccgtccccgcgcgcattaaagtggggggaatcactcc

SEQ ID NO: 61422 - DNA, 35953 bp, Oryza sativa
actattctattcaatatatatttgcatctaactgaaccatgcaaattgtaccattactcttgcatagcccataggcatggaaagtcaactatttttgcccatcttcctgaaccaagatgggctaccttacactatagttatgttggcctataaatagtgagcaagagttgcaagaacctttcactagctcttgtattaaatatttgaaataaaattataaaacaatgcaaccaatagaatattaacaaagctgaacatactaataacacaatacgaaccgtagaatcatccatgaagatggctaggaatgggttcctcctatgttcttcttcaggatattgtaataaattaggaagcttttctgaactttatgttaaggatgtgtgtctgagtatgctttggtatacccgtgcatgtgtgtcagcatgtatgtgttcgacataaattaccattatataaggaccaaataccaaattagaccactcatccacaataaaacagattggaatatcaactagatagaacatctaaagatactgtgtgacactgcaactggcttgttccgcctttttacacgcttgcagtattctctagctaacaaattggcctcatgttgatccatgcccaagagccatatgtcaacctgaatacaaaatgtacatgaattcatagatgtacatgaataatgcttttaaaaagttcgatataaaaactatacatgtcaggaaaaatatagaagcatattgagactactaatttactggatatggtggttgcagaatttattatacagacctgcacagtaacagtttagtgaaactgaacacgtgcatcatctaaacaagaaccaacacaaagctatgctatgccatagaaaatatagatcaaatatgcctcgcgcacaagaatctatgaggtccaaaatcaatgggaagcaagcaaggttggactagtctatgactccatatcaatataactacacttggtgacaaacagagatggtgacaaacaaacatcctaaggttcaggggcaacgctacattgtatgaaggtggtacgcatgcaccatggtaaatcaagattttgctagtaaataaactcatatctgtggcatgttacttcgaaattgcataaggttgatatatttctaaagagggaaaaaaaaccttctgaaataatatggtagcacactgaaaagaaaggtaaaatatatcagcagcagtgaattcttcaattagatctctcccacaacacctgtgggtaaacagaaatgaaacgacttgtacattcaaatgatccttcatttgatttgacgaccaaatttaaaggttgacaagtaacagtacacatttttacaaatgatccaaacaggaatatacctttttattatactcacagtggtttttcttgcaacatctatggcaagtggccaatattcatcagcaagccgacttatttcatctgacaaccacactatctctaccctatcaagggccataccagctgctttccacatctcaatattgtacaagccaatagtccgcatttcacttagattgccaccaatattacggttcatctgggcaatccagtctgccattaggattttaactttgtaaccagatttaaccatcttattaacagaaagagtcgttatgatcccctgcagcatgagaatagatcagtgcaaaactcagagtgaacatcgcattacaaacttgagcaatttgtcagtataattggcatgatggcatcatctcaaaataaaaatggttaaatgggtaatttaaaatagcaaatgaattggctgagtaccactcaaacaaaagttaatattttccacagcccattgacctacaacatcagcacaagaaccatccaccctgaaagcttattatcatcaggataaagggaacaacggtatattcacagttcactaaattacacttcgatccaaccgatatttatggtccagggaaatccctcctagctgtatttgaacaccttttgtttgcatgagattgatgatataacagtgtatgccaaaagatactccctccttcccaaaatataagcatttttggacttgtctccgagatgctactttgaccaacaatatctatataaaaataagatgttttaaatgatagtttgcttaatgataaatctagtaacatcaattttacatgattgatctttttaaattttttactattaatagtcaaaattaaaattgtttgacttgacactatactaaacatgcttatatttcgggacgggggggagtagtagagaatctagtactgatggcttcagcagtgcattggcaaaaagagcttgggaaatcattaagaaaaaaattgacaccctgagcaggaaagatttcactagaaagtggatttattaggtaaatcaaatcgtacatacaggtccaaattttccaaatagtgttcgagaaaagatatacaattcagtggtgtagcatgactgcatgaagccaaaccaagagggatccttaacccaataccattacatagttatacaagtgccaaattaacaaccccaccccccacacccaatcaaaaaaaaaaagaagaggaagagcttatactgttggaggaaattagagattgcgaacaaaggcgcggaagcaagtcatcttcttaagagcccctgcctgaatgtcgttagaaaaagactatcaagtagagtgctagatgcaagaacgtcgttaataacaggcatgtagcatcttcaccctacggtattgtcaggccactccaccctataatctttccgaatatttcactaataggaagacttaagaatgttctagaatcgttcagataatcctaagccatcacattttttcaatgaaacatgctagttcaactttactccctgaatccaagtgatgtaaaaaagcaaagttctttagttcttttaaattgcattgcaacccaaatgattgtacatttagtttttctttttccatctccaaagtccaaacttcaagttgttactgttgtgaggggttgtaaggcattgatgattgctccctgaaagataaaaccagtctaaaacatattcattcatgattcatcaaaattttaattttttgaaatccattacagactaaaagtgtattatcttcatcagactatcctcgttcttccttgggaggactacaatacagttgatgtggataattcattcatagaaatttaccagtttcagtatgcagaatttaaaaatgctaccacgaaaaatatattcgttcatatacctgggatatgcgcataaagggggtgggatcacaccaaacatagcaaacgggggcagatttcttctttagcagtaactcaagctcgctgtctttgacacggtcctccccaatgctctttagtgttgcgaacctctgatcaaaactcccctcaacagtatccctggatgtaaacaatcgtaacattacaaagcttgggtcaagattgaagttcagaagagcaaggttacctaatagagtcgacggcagaatcggctgaagtcatagtgttgacattatagcactgcttgctccagttttgttctgagattaagtccagccttggcggagctcctctgttagtagcaaaataatcaggttgcggtgagaaagatgtattttttttccttccccaatttcatcataacaactcatgagatttaacattcttttccgagcatgagtgagtttatctactccaaccacaccgaaaatcgatcccactcctagatgaaacaggcacggagatcttacccgctattattttgtaggtggggccgttcttcgcggaatatttccggttgtgccgacctgctgtggaggcgacgaagcagcgccggtaagtcggagcggcggcgcggcggcgtcgaggccggtgttcgcttccatgctttgcccacaaggccaaacgcccgcgctatcattgtctccgctccacacggtagcgccaaatcatggagcgtcaccgaccggctaatccggtcgcagcctcctccgccgccgccgacgccgccgccgccgtcgaactcccgccgtcgcctaggggtttcgttgggtcggggggcgggccgaactctcgttcgggtggtctctgttgctcggccgtacgctcgcctcggaagttgacaagcggcccatgtacggcccagggtgtgcgttcagccggcgaacgcatcttggcccattacctgctttttcctcacgtgcacgatatggagaaaaggtcggtaataaggtctcgtttgtcacatatctagctccaacttacctggagccggagttgtgccaaacagtctagatcctctgattttaggagcggagttggtagagctgctccacaaaattgtattacgagggtggagctgagtttttctgctccacagcttcactccacccaaaaaacccactaccctttaattttttagtgtatttacactaaaataccccttcctaccccatctcctcccgttctctctcctcctacgtcttcctcggtagacaccaacggcggtagcggcgggcgggtggcgtggcggcaagggccacaggcaacggtgggggtaggtgcacgggtggcagtggcgcggggtcgacgcacgtgcggtggcagccgcggcggcgggtggcgcatgggctgagcgggagcggcggctgcggtccacgagcagcgcacgggtggtggtcagctcacgagcagaccggcgccggcgggacgggcggcggcatcggcagtgcatgggctgagcagcagcagcgacacctatcaggtgtttaacaaaataccaacaagggacgtggtggagtggagctaaccatcaagccaaacactttctattccacttcaactcctataggagccagctctaactggagttggagtttagagtttggagctaaaccatcaatgctatagcttcttactgctggagtactacctgataaaatacagtgtgatagttgttacaaccgggtagtatgcttactactagcaataagttattaaaatacttctttttttgcttttgtatgcataacaatctcctcggataacatttaatgtgaaccccgctttacttaccaatttaggtattaaatattgtgatgtctgctagtaactattagagaaaatttcctatctagcataaaaaaaaattgctcttccctctatagcacccaaacttcaaaagttccctattgttctatattcaacacttccgttagttttaagggtgacggtgttaagtagcatgaggaaagacggttttgcccttctgtatttgaaacattttttccctttatctgttcacagtttttttgttctttatttttttcatttagtgtccagatgtctgtacatctttttttcattttgttcacagtttttttaccctttctacatctaaaaattttacagaaatttgacagcatgtctgcaacaacagcatgtttgcaacacaataatgaaccaaataaattttagagagcatccaaattcacatcctgggattagccggccgagcaggcctagggatggcctcctgtgccgccggcgctggccgtccgggggagcccgccggcgccaatggctgcccagggggtcgccatcctcgccgcccggctgattcgccgtcctcgccgccggccatgggggccgcccgggcgctggcctcccgtgccgccggcgctgccctcccatgccgcgacgggctggcttcccgtgccgccggcgatggccgtccaggggagcccgccggcgccaatggccgcccggggggtcgccatcctcgccgcatggctgattcgccgtcctcgccgcccagggggtcgccatccatgggggcggcggcaatgtagggttttgctgaaaagcgcgcgcgggttgggaaaaccaggtcgtggttgcgctctgtcccggagaaagagcgacgaaaaaaattcctgagggtgggtccatgcttgttttgacggtggaggctaacgggattaacggaagtgttagatagggaacaaaaattttgatggtgcatagatagggaacttttgaaagttgggtgctatagagggaagagcaatttttttttatgctagatagggaattttctctaactattattggttgatattgggattcatcttactattaagttgataaataaacatcgtggttacctttacccatggtggagggtgagatagggtagggaaaacggatggacaatttgttatttatttttgaaaaactacaatttggtatttgtgaagagtgcataatggcaaattctgaagaagtgtgcgacatgaaagaatgaaaccaattagtagtaacaaactttttgtgcatgtagcttttttccttatagaaaacgtagtggtataagtgcaattacctttaaggcatgaacacagatgttttaaaaaaaacatgaacacagaaccgtctcaaaggcagaagcctggctgaaagagcagtagaggctgtatggtgcacgacaatccgtttgccattctgcgtgtagtttgtacgagtcgccagacgatcccaacagggcaacgcaactggcgtgtctctatagtggacagaaacagggcattgctacattcctacactacgtgctaccctgtatagcagcacttgcccatctcattgatattatccctttttattatatataccattgagtttatcaatatttatacaatatgtcatcgggtcaagtctttttttaattttttttccaaaataaccttacaagcatacaagattgacaattgatttttgagaaaatcacgattttttgtgtagccttgttagacaacatagaagaattacaaatttgaaaactacacaaaataaattacaaacatatccttgatgccaaagtcattgatatcgagggcctattataaacaagtttttttttaaaaaataatatatgtttagtcgccagccaatcccaacaggtaatgcaacagccgtgcatgtctctgtagtggagagagaggacgatcaaaagcgctacattcctatactactcctaccccgtcttaaaaaaagattaatcctgggtataaatctggacacatattatgtgtgtttagatttctagctagacttatatttagattttttttttaatggatgctacgctgaataaatagccctttccgatctgagacccaacaccggccaccactatcgaaagatctcgatcgatctcaatccttatctgaagccacacggcatatcctactccactgtccacctcaatcgtcactcgacgacggcgacggcgaaatcaggaatttttactcccccgccacatatgctgatcaacgcaaataaatgaactaacgcctgattagtgcccaagtcaaaggtttccgttaagtttattacacggacccaattcatgcatgcgctgatcgctggtcgaccaaacgagtggaacgatcctcccgggcggctgtgatgactgatgagagatgtcgtcatggcgaggaaacgaacgacgcccatcgccaacttggcgaccactcgccccaccaacaccacacacccaagccagccatgatgcgaaacgagcgggacacccgctcacgctgtcgcctttgctggtgcaggagccaagcaccccattctccttggaccatcacccacgactgtgtttagttcacactgaagtttaaaaatttggttgaaactggtacgatgtaatagaaaaattgtgtgtgtatacaagatttgatgcgatgaaaaattaaaagttaaaaaaaatctttagaactaaacagggcccatgtttcgtttcccctcctctcgccatcggtgaatgatcccaagcgtgcgacgcccacggcgctgtctcgcgatctctctcacgcgtggatcacagcaccacgacggggcggttgcaaaaccgtagctagcctagctagccggccacaaaaacaaaaaattcggtcatattctctcgtgggtcgcatggtgcagtccagctcggaggcaaggtgatacatattcttctcttctcacccgggtcacactcgtgcgtgggtccaggtacactctctccacctttcgctttgttctttcctttgttaccactttctttcctctactagctgtgcctgtagtagtgtagtgtagtgtactgctgctgcaaagacatggcgaaagaacacgaacctaacggcgacgcttttttactcatcaaaaggcaggacaggcacatgtgaggtgatgctcctcccgctgtgcacacaactactgtgtgtctgtctacatctaatgcgccattgaaggggcgcatattgggcgccacttgtgctagtaccaggtaatgattatgtgtacacttgtatgtatatcatgggcgtcgctgtggccactaaaaacattctccagatgagacaaggactggtgatcttgatgaatcttgaggtgagagagagattgatagagacaaaacttacaggactcgagcaagaatgcctggacagtgtagccaacggaatatatatgctggataacagaagaatggagggaacctttcacagttgtgttggcaatggcacagcagatacatcatcacagtatggagtatggatcagtggatgatatgtggctccttacctctatcatgcatgagggcacataaaaacatgctttcctgcatatacgtctagttcaaggctacaacaagcacaattacaaccgagaaaacaagaaaaaaaaatgcaaacatcaactagtaacctatccccagacatctgaactcttttcttgcccttcttcagtttttccttcttccaacaattattcacatgccaatttcgtgtcgaaactgctcaaacaaatagcgaaagcctggaaggcagagagaggatagcggtagtccattgtgaacatatcccttgcaacttttccaaactgcagaataaccttttcggggtcggctggaccaggttgcgaaggagttggagcaccagcaggaggagggcttggtgcagcaaccagctggaaattcttcactgaggcaatggtgacacggccacggaagttcaggcaccagcactgtagctgctcatgccatctcgggggcttgttacggagcactaagggcctctccttgatttcaccattgtcatcaccacccattatagaaccactgatgtcagagaagcgagcactactgaaatccatggatgggtccatgatggacttagagaaggaggtggtgctccggaatgattgagagaaggaggtggtgctgcgaaatgagtcctccagagctcgaggtacaatttgctcaggctggccagggactatgccaccaggctccaccgaggaggcaggtatggagtgcatcatgcaacgcatccgtctaggacctcttgtgccaaggacatttagttcatagctcacctgagctatgttataagtaacagaaggaaccttcggagaaactttcgttgagttaaatctcttgctggtccttccgacgtgagggactacagccccattgtaagggggctgtgtgtcataaattataaattttgtgccaaggaaatttgacctggaaatgacagtgctagggtttatatattatgaaacaagcaaaatggaaaataaccatcttcaatgaacatgataattacctcaattttccaatattagttctgctcgaccttgagatgttgccagaaaccattgaaatagtgtactctgtgcaagttgttttacggtgtcttttagcggctaagacgaatttcccaccttccgcagtaacaactgcacaaagagaatgattcagcaaatttgattaactgaagtcagataatgcgggcacttggtcatttcataagaaaaataaatctcatggttgcaaggcctttgttttgcgggaaatgtggaacaatgactcaatcattcaaacattggaagttctttaagaatgaacaactttcccgtccttaggcatatgcacaaaaggaaagaaagataaagctaataagggatgcaaagtgcgggagagtaacataccgttgctaaggcacagatagagatggtaggtggattttgatctattcctctttatataacattgaatcataccatctcgaggaccaggctgaaaaaacacaaacaataatctatcaagctcaagcatgaaaaaagatagccactgctcatacttagaacctcactcaacaactttgatttaaaatttataaaactgaagggtgagaactaatctttcttatttacctgctttatagagaccggaaaggtaagtttcccacaaaactctgggctcaacacagtctctttacacatttccctccatgtcctacaaacagctgcaaagcagacgacattccttcgggatggccatgtactctcatcagcctccagtctccgtatgacctcacggaggagttcgggcggaagacttgcccagcggctctctgggattatagcaggtgagtcatcgagctcatccaatgagctctgagtcttccctttgtgatgcccagtaagtccataaagacttgcaagggtcacctcaaagctccttcttgacaagcttccaaaaccatcccggacatcgcgaactatgctacgaaacgacatctaaaccagccaatgccagataataaggcatacgatgccctacaaaatatgacctgccaattgcaaataggaaagagtggttaacaatccatttaactaaactttggtagaaaaatgagcaagagtttaccacacctcctttgaaaatggttagaaggttagatactgtacacatagaagcaaccgctactagcagtccctgcaaaaaacaaaagattcttgattagataacatgtgaagtatgtactagatgaatttgactggcacatgcttagaatgatataccgctaaatcaacctagaccttgtaacaaccaacaaccaagtacacctatcctagccagcagttaaaggggaataatcaagtccatcaccagcacatactttcctcctacgtatatacacaccaagcatcactttgggcacaagaaaactatgattcttttcaaattgaggaaattgctatcccaccactgaaattaacacggtttgccaaccacatgacacatccttctgcaactaaaataaagaactttccatggaagaggactgagcaacagaacattattacacatattaaaatcgcctgtagattgctgttgcatttcgaggtggaaatcttgcggtttacatgacaacccataccctagactaggaatataataaagatccattatttatctccaatttttttatagacaagttgataaatttgatatggtctacgcttagatacaggcctaactaaatacgcttcccttcgtcaactactgcaatgcgaccggcaaagaaaaacaagaactgtgacagagacagtgaaggaaggagaaaaagaaaacccgcaagttcacatttcctctcgaaatttctcctgaacaacaccatatctaccaaatcgcacccctacgatgtaccgatccggccagccaagaaggtcccgaaaacccagccctcctccaccgaggcagctactcaccgaacaaccataagccccagaaccgcaaacaaaccaagcccaaatcaggtaagccagacaagagcactcacattcggccgagtgggagccccgccgccgccgcctcaaacctgtccgctgcacagagctctcactctcacaaacccgaagtgcccgctcctctcgggcaaggcaactccacccggcaacgcggcggagggggagacgaggagttgcagtggtgggcgggcgcgagcgaagaacagcaagaggaagaagaagaagaagaagaagaagaagaaggcgaggagtagaggagaagagaggaaagggaaggcgggtgtggggaagaaggctacaggctcgggccgcttttgtttatccgcgctgcggtgcggtgcggtgcggtacggtggtgggggtgggtcaagctgaccgcgccttttccgttccgtcgggggactctctaacggcgttccgtcactccacgacacgtcaggtggcagcgcgtacttggccctgccttggcttggcttgccccggcgctcacgccaccaaaagcggtgggcctggtgcgacggacggacggatggatggggtggatgggtgggtggggggaatgtgtgcgtgcaacgtgcaccgttgaacagatgccaccggaacgcatcgccggaggggagttgaagtattgcaatttgcaaagttttttctctttgttcttaaaaaaaagttttttctcttcaaaacaggacagacacttagtgaaactttcatgtacgagttattctttaggggacaccaaggaggacttatataatgatttaactataagaacaagttggaattttaaaatggtttagttaaggactaagtagtagtagaacttgtatggacaaccatgaaactcaggtctgaccttgttgctaccgatagtagtaggagtacgtactttttttttagaacttaggagtacgtacttggattgcagttgttaatgacgatgtctttttaacagctggatggacttgataacagtatgatgtcatgagcagagtatgacacttcaataggaagattatccgatagcaaatgatcaggtgattagaaaatcttttatttaatgtaataaaacatttcaacctttacttaaagagttacaaccaattattagaaaattcacgaccatagaaaaccctaaaggaccgtgatgaattttagccgaccgttgaggacgcttttaactgcgtttcatgagggtcaattaattgtatgctcgagtatttcaacagtggtgctggtggttagcatccaagtacactttattctgtttttgcttgagttcattgtgttgatcgtaaaggcatgttgcatactcctaatataacggtctctacattttagcctgcgtagaggatcagctgatcacctaatcaaacggcaatcccttgtgcaattgattgttccatcatgatcctattttgagtattttcagtaggcacgctgtgtgacactcgacggcactttgggcgcaaagtagtgagtggcagttgctttcagcattgtatatatctagagaagtatagctaaaacactgcacagcatgtccagtactatagttatatacgcacaggccccagaaaagtacctacagcgacttggaaatcagaatctaaacgtacgcttaaagttgtgacaaagagaagcacacaatacgtcgccactatgccactactccatccaccaaacatttttcatatgcgaaaaaaagaaatccatttttttttctgatcgtaggggaatccaccaaacagcattgtacagtcgactcgtacgtatggcttgtgacttgtctataagagatagcagtacaatgtgcgcatattttctttttgctgacccttgaagtctgaattctgaacactgcactcaagagcgcagaaaaaacgagccggcctagctcactatacggccgtaacatgcgggtacacgttttgactagagaatacacacacggtgagatcgacaaaaattactgggactagcatagctgaggaaaaattggctttgggagcagtaaaaagtaaaaaagcctcccactttttcagtctccggcgaggcgacacgcgctctgttccggtattcttgcctctgaacctttgcagccagtcgatgcgcgggtgagtactccgtcagtgtagtttttttttttttaagaactcggtagtgtagtgtgaggagtgtttgaatggggtggatgggagaaaatactactagtaaaacatgtgaattatggtacgattatttaaatacttattattttaaacttaaaatttaaaatggtatggttatttaatcaatttttaatagaatttgtttggacgggagaagtacgacgtcggttgttcagttcagttcagccggagacagcgaggcggcaagtcgtcacgacacggcgccctcacggcgcgcgcggcgccatcgccgttagctcagcgggagagcacacgggcgcgcgcggccaggaagcttccggccggcgagcaggcctgccgcgcgcgtgcgctgcgttcagtgaccggagatgtcagtcactcactcaggtgaggggccagattagatttggatcaaatgagacggcagtttttaatgtcgcggcccggggcgaggttttggtggcgcgtttctgtcagtgatctgaacatcatggcataatgataaacaaggacaggcctatttaagccttaattcgccgtgtttctgaaaaggaaaaaaaaaacaacagaacttcaggtttcgagaaacagtggcgttgtgcgagacgtgccgtacagaaaaggatttggcgaccaaaggatctgatagattatcagatggttggatgaaatcatcggcttcgtcatttcaaccactacaccatgtaaacaattccatctgcttgcgtctgcgctaactaaaactccttcgaggtcgtcgcacgaatcaggccggggcagacgataagatggccgtacgcaattgccagcaatcctgatggaaattaaaacaggaaaagataaacgcaagcaactggtttatcatctcgatttctcttcattatcttctcttgtagagaatgtagttagtcaaacttcttgtttacaaacaaatgatttggttctggactgctgcagctaaaccctttgctcgtattgtcaaatcttgcagcttgtgtagcatatgctgtcagattaaaagatgcgttggtttcatgcttctgtacccttgcatacgacttttctgcttttaaccgatacgtttgtgtcaagatgaaaagaagaaggcgaaaggcagattgatgcccccatgcttctttttattcaacggcgagatccgtggaagccagggcacctccctactactactacttctacacagcagtataaacgtttgcagcataggcaccacatccacaagaacgtagagctcaccatctctttttctccctttttctgatggcgataaaaggttagacttttggagaagaagaacgaggcaatatataaaacacagagaaagaaaatgccaagaggggcaatacatatattcgtcaggtacaaccacctattcaggctgaggacatctgtgccgaccaaagcttacttttttttcatctgcactgcatcccaattgagtcactgagttgcctttcgcttttgtgaaagctgcgtggttgtaataagcgtcgtagatcatcatcagatggcgtttttcgaatactcaaatgcgtttcgtgtgcataagaaattgccactataacgtcgacgaaagcggtagttcgaattggattcgaacttcttcctatccatgccagcgtccagaacacaagacaacaaaagggtacgtgttactgagaggaggacaaaaggcggaggagggcggcaagatggcgtttcgtcacacataaaaacaaagatcattctaatattactatcagacatgcaaatcaaggataaatcatgtcacgtcaccctataaaatggaagaagcaaagaaggtaaacggaaatggaaggcattagtcatacgaactcctggcttttagacgaaaaggattatttgggtgccaacaaacttggaaatcgtaatgacatatcagttaataatacagctatgttatacttagtcctgttttatacaaacgaataaacgatcccttcatgaggcgttgcttttggaattttgaccgagataggagatttcacgaaaaaaatattttcaaggcctgagcaattttcagaaaattaattgtagatttatagaatttacataggagctaagcctctctctacttgttggcttaagccacaacaacataattaaatattaaaacttaatattagagttgattctaggtttttatttaatcgtaatctattttccagtctttaaatcttaacttttaaaagctatcacagataaataatttacctagaaattaatttgggttgttttgttctttttcccggttaccaggtactctgtctatcccatttaaaaagaatatagtaatacgtatggtatgttacatcctatatttttttttgggggcaattgtaaatttaccgctactttaaatcgttattacaaaactgccactaaaaaattacaaaaataccactagaactgtcatttgagtggcatccttacaatattgaaaaaaccggtgacaaatttgcaaatgccccatattttttgattttgctatatatttgtcgacaaattttttcccaaaaatttgacagatgtaattacagtacaatcgtagtgtaattacactgtaacttgtatgtaattacactgtaactatagtgtaacttgtatgtaactttcaaaaatctctccgtaacatgttattttggtaaaatggaggtcgtgggaacaaattctttcacatatgtgtgtgctataatttgttttcttcctcaccaaaacaaatcttgtaatagatctaacgattcaaaattatgtgaaacttacatataagttacattgtagttacatgtaagttacagtgtaattacactacgattatactataattacatctgtcaaatttttgaagaaaaatttgtcgacaaacatataggtagtcccgatatttttttatgggacagaacagccgaaacatctaaaatttacaatcagcagaaagctgaatcgtgctatcctggcccacctaattaggccacacaagtctgaaagggtccactttgactcccttaaaagtaacctgaatctaatccgtgaccctcaaccgcaaaactggatagaacgacttcccaaactattgaaaccggtgcaatttgacttccttaacggttttggatggtggtttcactgacgtggtgcttacgtggcggtgttgatctagtctggtcttgatgtggcgcttaggtggcatttaattaaaaacatatatgtgggacccatttgtcaaaaaaaaaagtggggcccactgacatgtcatcctctctctttcttcttcctccccctctttctcccttctctctttctctccccttccaccgtccacggggagcacggctggagcggcggcagggcgggggccgaagtgctggcggtcggcgggagctgaagcggcggcaggtaggagctaacgcgggtggtggcggaggagaaggaggcggcgacaagaggggcttgagtggcggcggcggtggaaaccgccccacgccacagacctccaacgaggcagctgcggctgcggctgcctctgactagcgcgctggattattcccagcctccgtcagctccagcccacttccgccaccgctccagctagctcccgtgtcagctcccgccggccgtcaccactctggctctcgacggcggggaggagcctcgacgacgggaacaggtcagcgacgccgaacctaatcgccttcttctgcgcctcgcccagcgtctccaggaactcctcacgccaccggaagccgcactccccatgatggcgcgcagcgtcaagtcggtcagcgtcccgatgatctgcctgctcacgttcagtgccggcagcggcggcgatggcgccaacgagcacacccgccaaagagtatcctcaccgtggtgccgatggagtccctcactgtacgcccagccatagaggtcgaagcccttgggctaggcgccaggagaaggccgagctccatcctcgcctttggccatgatggtatgcatgtagcgatgcctgccttgggatgaaggcgaggcatatcatcaccttctcgacatgatttttgatgagcaggaagtaatcgagctatacagctatacacatcctcttgcttgctcgccttctcctatgctgctacattggtgtgtttgttgtactgctgctcgactctgccgaggctgacccgtggagcattgtgggggttggccggattgccgggctgggttcgtggactgcatcctcggagaccgccgccatcacgcatgcggatacgccgaggtcaaggtcgatggcgatggggaagctggcgcccgcccgctgctaccgcgtcagccatcgccgccgccgccgccgccactccggctcccgcttgccgtcgccgcccttgcatgcagattacgctacgagagagaaggtgaagagaaatgggggagataaagagagagaacgtggagagagggagggggaaggagagagtgaatgacatgtaggcccacatgtcagtggggcccacaatattttttatgtgtgaatcacatgtgggtccatagattttttttaattctaatatcacgtgggacgaaaactaggtcaacatcgccacgtcagcgccacatcagcaaaaccaccctccaaaaccaccaagggagtcaaattgcactggtttcaatagtttagggagtcgttctatccggttttgcggttgagagacatatattagattcgggttacttttaagggagtcaaagtgaacttattccagtctgaaagtagggatctgaaagtctcaatttgtgcaaattaggcctattaataaagcccattgggcttccaggcgattgtcgcgtgggcgccgcaaccgagacacagcaaaaggccttaaggccgcatctcaccaccaggaaaaaacgcgagcgcatctgaagccgaagcgacaccagcggtgttagcctacccgcagcttggcgagttcagttgggtaagctagggtttaggtctcggcgcgcggcggaggggaggaggaggcgatggcggcggcggcggcggcagcggcggctgaggaggagatcgcggtgaaggagccgctggatctgatcaggctcagcctcgacgagcgcatctacgtcaagctcaggtccgaccgcgagctccgcggcaagctccatgtatgtaaacgctcctgcttctcctcctattgtttgttcttcgaatttcgtgctttgcttgtggttggcccttctctgtggaggggaaatacggggaatactctactgttgggaacctgattttgctggcttggtgtgacctgctctcttgtagttacagatgtaaggcgacgactcgctttgtatggggattttggtttgtctggttgataccacggtgataatcctaactagttgtggcaatctatgagccatgtattcatgcggaacaaaattacagtgcctctgtaaaaaaaaaattgtgaggaaggataataagcactcccgtagttgacattgtgtgggaatttgtcgaaattgtgtgtgaactattcaggatagtgggggtagcagtcgagcaggagatgattccaggctttacgtgactctcactttaataaccccttagcatcatggtgaggttgtgcaaatttgtttagattctcatgttggatgtgaatagcaatgctgtatgctgataaaattttcaattgtacattgccttgcaatgtctttggttcatgatactctcaccctttctagtgcatctgtacaatttattctgcattgttgagagctgagatccatattataacataatatggctgggagttgggatggctgttgctgagatgtctttcttgtacctctttatccaggcatacgatcaacatttaaacatgattcttggagatgttgaggagatcgtgacaacagttgagattgacgatgagacatatgaagaaattgtgcgcgtaagtgttttgaccttttgttgcaaattttgtgatcagtacttttgaaagtcatgctataattgttttggttaaccctgaccattgattgatgatggaatatcaatgtggataatatgtttgctttaacccatgcacatgagttgtttggctgccaccttgtgcgtgccactacacatctatattgttgtgcacatttttttctcaaagtacctatggtgcttagactgctgggcatatagtgcttaactgctggtttagtgtaacataattgcggttacatactttttattgggaataatctgatgctttgggacatatttcttactgctatattctgaaatttctggtgaacatgttgatgctgtactaactattgctaaatcgtgtctttttccagaccacaaaacgcactatccccttcctttttgttcgaggtgatggtgtcattttggtttctccacccctccgaacggcatgaagtatgaaggaagctcctgccgattgtcaaccatgagtaatgtgtattttttaatcaatggcatgtgttatgtgctgaagtgctactatttctgatggattctagttttagcatatgatacaattgtgtaacaatttctgatcgaggtgctagtttctactgtcatgttgaatcaaccttttgttaccagattaatcaactcaatcccgaagcactaatatttgttgtggtgatgtcttgcgtaatttttgtagatccacatgccaagaacaccctgttccaatctctattaaaaaagagccagcaagttgtaacatttttacagcgtatatgattcacatcacaacacccagccaaacagggaacgtatcaccgtcccaagacttatcacagccaaacagccaaacagccacacggcagcggtgtctccagggcttgcagaaaagacacattttacatgatcatttcattagctacaaaaagagatctataaactattcactgaccagcaaagtcaatcttcattccagccatgcttgaattcgccccaaatcctcacgcccggtcatgaaattgtatccatctaaagttctaaacagcaagccaacaacacaaaaagttcgacacaaagtattagccaaaaatattcgaatttcttcgggaaacatgaatggatttaactaaatttcaccacatagaaaagaatgaatttagcgaaaattcaccaccatagaaaagagaatgcccgggatcaaaccgaagattcgattcccaatccagcggagagattgggaagaacaaaaaaccttttcatgattcccaatccacatcaagtaggaatatttctggtaactgaaagaggtcaaataaaggagagggtgaaacggccggcgccatcccaagtcgtcttcctccttcgctcaacccgcagaagaacacagattcgaagaggcagaggcggcgaagagacgcgcgagccatgggcgtcaccaaggaggatgtcgaggccgccatcacctcctccctcagcccttccagcctcgtgagtctctcttccctaaaccctcgccgcttatccatcatccttttgccgttctaaaccctaactgccgcttctgctttggttccacggtttcaggtggtgacggatacttccggcgggtaattcctcacccccaaactccaattgttcttcacctttgtataggagtatttaatttgcttgcttccattgttacgaacgaaagagaagagatcttgtgtttggtgactggttgatcgattggtgtgaaggtgcggcgcgagctacgagattgaggtggtgtcggagaagttcgaggggaagcggctgctggagcggcaccggatggtgaacaccgcgctggcgccgcacatggcggagatccacgccgtctccatcaagaaggcgctcacccctgctcaggcgcagccccagccggagccggccgccgataaggcgccccaggcttaagtagttcttgaactcacacctccaaactgttcgatcacatatgcaccacgagtgaaccgatgcacttggtgtagcgtttgtcatgggtgtttgagatgtgcgtcagctctctctgcttgaataatgtgcatacaatggcagaattggaatgatactatgcttgactgcttagaaatttcagtaactttgcgtgcttcccgcgtcatgtgcttggcagttgatcctatttcacaattttgccaataaattgccgtctagataatgatcctatttcgcaactttgccgataaattgtcatctagttaatatttagtcctaggacttggattgttttcccctcgaactaggttgtttgattgtagagataaagtgcagttgcttcatgattgatctagtattgtttattgctgctactataagttgactggctcacagcctgacatagttgctagtatctactaggggttctataatgccacattgttttacttgagcatttagtctctgtatttttggtgaagccgacaaatattaagaataaactattctcactgcttgctggaccaataaaactggatatgatcatacaattgtgtttggtgctaggtgtatgatggcttttagtttatgtgataagtagttctcagctagtttggggacaataaagtggtaactagtttaaaatcatatcgttgtgttgtaagtgcatttgctgcttgcactattaatttcttggagatctgcatgcatgctgacatctgatagaaaatgaaccacttcccttcagcatttgctttgcttctttggtctgtgttggtttcgacttcctttaaagtgaattctatcagaaggcctgtaaaaatgatttttataggttgatgtgttgatactagagatgttcttcactgagatgtttctgtcagaatgctcattgaactgttagatacttctcttagttttggaattggtttcacaattgtttgaaagcttgaagcaataatcaacacagtagatccaaataggcgaaactggtaatgtcagttgggttaatgtgagtccacatgtctctatgttttctgaattcagaagcttatgttcattccttttttttttttggaactgaacttatgttcatcctttgcaacaacttgtagagtgtatgtacggcacctacttgtacatgtgttgtttcaaatgattcgaaactgaaaactttttctagtgtaattctgacttaaaattaattatattttcccctgttctgtttgagcattatatgctatctgtagctttgatgcaaaattccatatggaggctgtcaatctgctctgttcgttaggtttgtacgatccttggtgcttaggacagcatttttttttcgtagacgggttcatctgaaccatatttactgaatggtgtccataaaagaagtccttttttttctttttcgagggaacaacactgatcaccgatcaagtgaacagtataatgcatagtatttgtatttttatagagatgtttaatggcccttacttctggcgacacatatggaggctgcctctatacaaacagtaaaccgaactgtacggcaacactgtttgttctctactgtagcgatctatcttagttcattcgctgcaaatccgacgcctgaaaataccccaaagtcacagatacagtacacctcctaacttcaccgtggatcccaatcccacgccacatcccacgccagcacaggagcgtgagcggttgcagcgagagccgctcgcgtcacttccccgtccatggacggtgctccaagttatggaccaccccgtgcagcatcttcccaaaacgcaccgaccggcacaatattaaccgtgcaaagagccagaatttggccacgaagcgagcaatctcaagtgtggccgggttccgcctcccgcgtcgccagttgtcgatcaggcgcaacggcaacggcaaaggcaaagcagtcgcctccgaggaaaagtccgcatgaactcgcgagaagcggcgggccgtggcggggctacgtggtacgtaccgcctcccgccgcgaccgcatatatgcggtgcgtgcgcgcaaacacaacagacgccgagagcccgcgacacgggagacgggagtacgggacgttcgtgtacacccccacacgtaacacgcgtgcgaaatgagcgaggcggacggaggcgagggggcgaagccgaagcggccggcgccgcggctgaacgagaggatcctctcgtcgctgtcgcggaggtccgtcgccgcgcacccctggcacgacctcgacaccggtgagctcactgagcttttgctctctctctctctctctctctctctctccttctctcacaaacatgcgcccccgcgccgatgaagatcatggcccgccggcctatctgccgatgctaacaccgtggggttttctctgtatttgcaggcgctgacgctccggctgtgttcaacgttgtaagcgccctcgccacatgccacgccacaagggattcttcccttggatttacactcacttgactaacgatgcgtttcttcttggttttgcgtggataggttgtggagatctccaagggaagcaaggtgaagtacgagctcgacaagaaaacggggttcatcatggtctgtaatcaaacactgtatttatacactcacgtcagggaccatatgctctgtggaacttttttaccatttgggctcttgttgtacaggttgatcgggtcttgtactcgtcagtggtttacccccacaactacggcttcatccctcgaacgctctgcgaagacaacgatccaatggatgttctagtgctcatgcaggtgatcatccttcaactgtatatgctgatgctgttataaattgtgcgataatcactgcaacacatgtccaaacgtttaattgcaggagccagtgattcccggctgctttctccgagctagggccatcggactcatgcccatgatcgatcaggtcggttctaccccgcatccattttcaatacaaattcatcgtcaaccgcgactccagcttgaccgattggagctaaatcttcaatgagacagggagagaaggacgacaagatcatagccgtctgcgtggacgatcctgagtaccgccactacaacgatctcagtgagctttcgcctcatcgcgtccaggaaatccggcgtttctttgaagactgtatgttcctactagttctcaaatcgctgcactgaccaatgttttattcttcttcagctaactctgtagtttctgaacttattcagacaagaagaatgaaaacaaggaggtcgccgtgaatgaggtactgcctgtgaccgctgctcgggatgccatccagtattccatgtaagtgatgaactgtccatcagttcagattttagaacgatatattgagtagtttacagtttacacgtgtaacagcaagatgacatctttgcaagtttgcagggatctgtatgctcagtacattgagcacttggggcagtagaccagtagtataacaccagaacaatccttcaccgccattgatcatgtgtttaatagaagtgccaaactaccttgaggtactaaaattttagtgtaaaattttgatacccgcaccgcaggtacactttctgaaggaccgtaaaatatctactcaaaaggggtacccaaaactgaaaaaatattttgccaggaagacaggaagcacaggtttgccttagtgacttgttgtattagtgctttagctgctagagatgcacggtgtatgtattttgtaaataatagtagaaaaggccttagttgctcatgaagctgttccaggcctcaacactattacactgaattttacaaacgtacagtaagacgaataaaagaagtgcctgacgaatcatgcatgttacagtaaggccagggagtccattcgcacgccttgatggtgccagatcgatcaaaccgagcttacttcgcctgtgcagcgtacaaccctttgatctcctccacatcttcgaagcttccaagaaatattggggatctctcgtgaatcttggtaggaacgaggtcaagagcctgcattgccaatgtagcaacaagtttgaacaatgtatcaggattcaagaactcaagatgctaatactaaacatgcatgctgttttaatcaagatgaaatgaatgaagaaataagtacccgttctttgcctgtgaaagactggcctccagcctgctccatcaggaatgacatggggaaaacttcatacagaacactgtaattccaagatttggtgaattcagaattgtttatcaatatgaaattggaagtaccataagcgaagtgagatgccgagagtaggcttaatgtgtaccggagttttccatttgggctcttcttgtctgcagggtacaaaaatactcctccatatagcaacgtacggtggacatcagcaaccatactgcaaatcatcaggaagcaatactgtcactacaatgttaattggtggtgattacatcctattagaaacttttatgaatcacaacagagggtcaaaaaagctcctattaataactacagctaggttatatacattgtcacccaaaaaaaatgatcaccttccaatgtatctcaaggatttaggtgatgaaccatccttagggaacttgcacttctccacaaacctgtaaatgattgttgtagattttagctcaggttcttcaggaagtacactattctgaaaacataagtagcgcgtactttgcggtaggctcgtcccaatttttcgcattcccttcattcactgaataaatcttccctttctttggtatctgcacagagtgaagcatagaacacacatatgagtattttgcccgctcatcagtgtacattaaaagacggaagtatcactactaattgtctcataaacagttagtcaaaaaaaattgtcttataaaccttgatgtctggatgagttaatatgaactccccgagagatggatcaagtgtgaagccattgacaccatttccagtactcagaacaagctgcatcaaattagttacacaggttatattcaggtgagaattatgacatttatagagtaggatggattaggaggtcgattaccgtgcaggaactgccgtacatgcagtatccagcagcaaccatgttttttccaggctgtaacacgtcctcaagagtcacattctccttatctttgatcatgtagatcccaaagatctataaaacaagagaaagaacatgtagtacaggaatccattaaaggtccttctgacgaatcgaatcgagtattgttcgaagacaattcaagttgaccctagagtctagaatccgttaaaagttaagacttgctatcaacttttcactgtcacactcacacaacaccttgctgctgaaattttcagtttttgaaagcagtactcgtgtcctcagaaaagcatgctagcagtaattcacaactgatggaggaatagtatttttcatatgttgctttggccaaaagttctccctttttcacgtcaccatcctagaaggatgccaaaactgcaaattgaacagcgacttgccgttcttccgagttgtcagtgttatcttttcggtttggtggtttcatgtgtacgcaccgttccgatggagacgccacagtcgatgttggaggagccgtcgagtggatcaaagcacacgcaatacctgtaaaaaaaaccggcaccatgcatgtattttgtcaggaaaaacagaacaacagattgctcgaatcaagaagcagagaggtcgcgtttctgatccgaagctacgcacttcccacgcagcgcagggtccacgaacgtcgcttcctcgtcctcctcggagacaagaacgcactgcacgcgatcgcagtgaaaaaccataaatattgagaacactctgagcaaagaaatggtttaaggggagaagagagtgagttcgtacggtgcggccgctgctgacgagagccttgacgaacacctcgttggacagcacgtccagcttcttctgctcctctccctggtcacaccaagcaagtcctcagtcctcactatctcaatctcagagacaagaaactgagaaagatgacagttattgccaggtacacttgcctgaacgttggtctcgccggccagcccgatgagcttggcgagcccggcctgcatgcacaacccgagaagttttgttcagcgtgccaatcagtagagtgagaaccgagagatccgtacgcctaacgatgaaacaacgggaggattcgtgtgaccttgttgacggcggaggcgacgaacttgcagccaagcacgatgtgggagaggaggatggtgaggtcgccgcgtgcctccgggttgcggctctgctcgttcagcacgtaccgcgtgatcgtcatcaggtccgtccggtacgcgtccgcctcgtgatccatctccgcaccactctcctcagctaccgcgccgcgcgctgttcttctcgtctgcttactctgcctcgcgctcttcccttcgcttcgcctcgcctcactctccggctgctcgggtcggctaaaaagcgcgcggtttaagtgttgagtattggtcacacggcgcgggaactgacccggtgaggtgacgtgacgcgggcgcggtgtacgtattgggcgttttttttaggggttttgggaggtagcgaggggagaaagtgaggctgggagccgaggggcgaggagctccaacggaatcggcgcggaggcctatcccctctatccgcgatggctggtagcgcggtgaccgtgtgcgtttgtggtcgtcgcgtttcgccccccaggtgatcgaggcccgagctaagtcgagctactagaggcgagcacggctttgtcctgtaccgccacgtactacggcaacgcagcaagctagcgggggtgtagttgttgttgagcagaggcgccgacgccgacgccgacgtggatggtgcgagattatgaccaagtacgtcgtgttaagctgtgcgcccgatgtgacggcgaaacggttaaccggagagggggtctcgcaaatgggctccaagcctccaactctccaaggtagaagttgtttgcctttaatggcctagcatttacgcgtggaatatggcaccgggttcgacttcgagtgagagctacagggcgggagggggactcgcaggcgactggacgctttaccttcacgctaggctgctcgagcttccggtcagctcggggaagagctgctttaccatggcagtgtttagttttcccctatttctgactttccatcacatcataatacaccaaaaactttactatacataaacttttaactttttttccaaattcccaattttcttcaaacatccaacttttgttagaaataaaacacaccccatttgacttatcctactggattcgtctgcctttcgtatttagtggttcagtgaatagattcatacttttgacaagcatatgcgacggataatccgagtaaaaagtcctgctcatttattgtccgttgaggtaaagcgatggtatatgcaactcagaaagaacttgaaccgaggatttcacacggggctggtcatgaactcatgatcaactcgacatggtacgcaactactatatgcctattaccggcaatgtaatcgagtgtacctttaaaatactgtagtcatagtagagacatcaaataccaatcatatcaataacataaattacgagtagcaaacagagcgtgtactccaacatgctttgagaattcaacaatctatccagtggaaacaagatgttggcgattgctggcgggacatgcagttcaatgaatgtgttagttgctctggaacataaaccctggaaggttccttcatcaccaaagaataatagttttgacagttttactttggcacgattcacggcaattgatcttactgtagaactaaacagtatcggtcggcttctgaaaagggggcaaaaaagtgtggtaagaagtcatacatatggtgaaatttattttacgggaacggacctaaatgaaactagtaaatacagaaaaagtgggttcttatgtccataagcaaaattaacctggagtcttcatcttaaggacaggaaagtccaaacttcagagtatagtacagcattggtttgttttctttgcctgcttgtagaacatctggaagaaaagaaaaacaatatccctcaacaaaattctggagacaaacggtaatcaagataaaacttaacaaacaaaaaatgtaagttaaaaagggtccagcgattctacaactgaaatagacgaatgacagcctagacaaacaggggcttaaggttctatcatattttgctcccgtcacataataaacagactagaattatcataggctacagccaaaaacctggcataagtatagctgtgccataaccaacagattcatatatactatttacataatcaaggatttgcttatacaatatttccatggttggcaatttcttcataatagaaaagaaaaccccactaattcaacagacatatgcgcgtgaaaaatatgtgtagtcctaaacaaatgtacttgaggaatcacagtgagaacaaaaagtaagaagcactcatcaagtaaaaaagcaaacatgaaaacacatgattacctgtgaagcagcactcaggtctgaactcttctcaaccaagctatccaatctttcccctctttggagcacactctcaatagttttatgctgttcaaatattagaacataaacaatgcacatcagcaagcagttttacccatatgaaaaataagttatgagatatcaattcataacagtagataatatgaattcaagtcaatatcgtaagctccagcacaagatcgggtcattgagtttgttagaacaagaagtgttggtatttaccaatatgaatggcagagctattctataatttttttttctggtaagaaatacttactaggataatttttgtttcatccaagtccctctggattttcattaacttgtcagcctctgcagggtcctacaaaataatgaaatcaagttatctcataagaaaacattcatgcaggatgcagtgcgtgtttaagtactggcagtttggaccaacaaggacaagaagaaaatcacaaacaaaagcagttgtcttaataagtcgaaagcatataatatgttcagacaccaaccaaaagcagcaaataacttatcatatggctaatggacatttctcttttcatccaagaacaagcatagcatatttcaattgagatgatggaagaatacattgtaaaacaaatgaacttcttcagttacacttttctttgtttattgtaaggttcggttgtcctccataaaggagatggtaaaatatcccctgaccccaggtcaatagtgtgtaacaatatttgtagaacatttccattacctctgatcaatgaaaccataaacagattgtatttttgttcatggaaagctttacctgaaactttgtcaaagcatctgtcaagaaaggccactgttgggcagcatctgttgcatcttttgtagcagctttccaagagtccccgaaagccttctggtattcgtcaagtaccttcataaaatgaattctatcaataactggataattaggataattcttaactactgatgtgttgcatcatgaaacttactctagcagatcaaagggtcatggatcattaataaattatctaatcacgtattcacatgtatgtagatgtatgaaagatgacgtagagtggttgcatgaaataaatagaactgaactactcattgactaaaacattgattcaggtgtatacttgttatcaggactcaggagtttcggaatgatatagtgtgccaggtttcagcctcgaagatccattatatagctaggtgaatgaaaaggagttcctagatagaagggtaagcttcaaagtatccgaacacaacaagatgtatgttctgttcaacatagaaccaggccatagaaaattgtacataggttgtttctattaattttcaacaaaccactgcagaaacatattgaacagaagtgaagaaaaaggactgctaatgttgggtgaaataagatgcatcagcttagcatcacccttgtatgcacaacataattttttgtgcctgttcagaagatcaaatgttttatcccactgagaatagcaaggagacaatcccttattgcttgtgaatctgatcctaggtcaaatacaaggatatgcaatacaggaatgtcaagaacaaaggctcataccttattcagaagagaaaatgcacttcgtacaggatagtgatcatccataaatgcaactgcgcaaagaccattcctgttgtgtgagtggaccttgtattctgcaaatatcaggacaacttgtttacatgaccgttcattaacaacagcaaactgaattctcctgatcactagaccgaaaatgaacatcgactgcagattgcacaaacaattgcatcataactcgtcataaacgttggaatcaggtcccatattttcaccagatatccttacgacgaacacaaggtcactcttttcaacgaaatccaacagcgcatcagattgaactaacaggcaacactgcctatccacaaacgagttccatgttgaaacaaacccaacagcgcatcagattgtgaactaacaggcaacactacctatccacaaacaagcaaatagttcccatgaagcccaacaccgtatcagattgaactaacaggcaacgctacctactccatccacaagcaagctaatactgtagttccacagcccgctgatgttccaactatgttggactactatcggatcagcggtaaaagtctatatcccacataatccaagtccatgtgaagaccggatctgagcatcgggtcagaaagcaagcaaaccctaagtgcggaggcagatctgaggaggacgatgggttgtttaccttcgtgctggacggactggcgctggcctggctgggtgcgctgggcgacggtgcgcgcgacgaagacgatgaactcccgcgcggcgccccgctggaagaacccgaagtggctcacgtccgtcgcgttcgccagcaccaccgcctcggggccgcccgacccgccgccgccgccggacgaggatgctcccccgccggaggacgacggcttcagcacgaggagcgccgtgatcttcatctccgctggtgggcgcgagatctgcggcgccgccgatctcgcagcagccgcccgctcctgccgcgtcgatgcgtggatttggcttggggggcggcgatcgtagagaatagggtacgaaaaagaagcttcccttcccttctaatgctgggattcggtcgcacccccactaaccacaacgcgcacgagaataacaacactcccaggactgagtgaatgacagtgggcccggccttgtcagacacacggacgcctttgcatttggagcaaaatgcacaaaaggaaagcggccaattcaaatgaatttcgaaggaaatttcctaataaaaaggaaaactaaaaacgtaacaagaacatcatcagccatgccagaagcaaaaactccaggagaattttcggatttggtgataagtagaattcttcacttccatttcattccaacaccatgggatcacataagagtaagacagataaattacatacgcaacaccccaactaggccatgacagatctgagatcaaacaccaaccaaggaaccccatcaaatctctacatgtgcagactagacacaggaaccaccactagaactaccagggtatcacagcctctcgagcagatcacgcctaggccctctcgccacggatgcggcgggcgagctggatgtccttgggcatgatggtgacgcgcttggcgtggatggcgcagaggttggtgtcctcgaagagcccgacgaggtaggcctcggccgcctcctgcagcgcggcgacggcggagctctggaagcggaggtcggtcttgaagtcctgcgcgatctcccgcaccaggcgctggaacggcagcttgcggatcagcagctcggtgctcttctggtacttgcggatctcccggagcgcgacggtgccggggcggaagcggtggggcttcttcacgccgccggtggccggggccgacttgcgcgccgccttcgtcgccagctgcttcctcggcgccttgccgccggtggacttcctcgccgtctgcttggtgcgggccatcggtgatgaggaggagaggctagggcttcttctacaagcttcgaatgctcgggtggatttgggggattgggatgagatggggaattcgagaggatgcgaggtgtttaagtaggggagaggagggcgggagtttgggaaattttgggcggagcggcgcggtttccacgagggaagatgggtttggaccgttggatcggaggggagtggacggcttggattgcgatttgacctcgcgcacgcggatcgtgggggcgcgatccgtggggaggggtttcctggattctgattggctgggggtgggagagcgagaagtggggtgtcacgcggatcgtggttcggttttcctgtgctgtgattggctggctcgttcggtgcatggattctgggacccagcagttgtcacttgcgttcagcgaaatgttgggcccgaaagcgtaattggcctggactgggccgtacctaggcggcgttgttaatgcgcacacaaatcattttttacggtatttttggtttaccagaggttaaaatgtgcattttcacccccaaacagcgaggtgatactatcctcgcatacgtgccttcgctcagggagcttaaacaagctactcagtcccaagggggaaagcataacatccaaaacactacaagtcgttcaaatacaaataaacctttactacgtacacaaaaataagttatcttcaagagagaaaacaaaactagaggtacaatcattaagacccgcaattcggctagtagaaaattcgaaacaaaaagctttcaaactgcacgggcaaacatccttgttgcccggtgaaacccaacacaacaatccattgcatacattaggaatgccctgatgcgatgccattgtctgaaaaaactgaccgactcagacgacctacactgcacactacctggacagatttcttccagtacaccaattgacttcaccttccgcattgccccatggccaacagccctcaggtgctactgaaaccatgggacgcatgcaaacaatctgcagatcacgtctcaatcagctgataatggtacaaatctgcccacaaacttagaagcacttcatgtggacgatgcctggaccagattcatcgtattcggccttggagatccacatctgtgacaaattaagtggatgtcattagttttgcagagcaaaatgatcagcaatagaaataccaatttcaaagaagaaatagtagtgcatattactagacaaagagaactgtctaaaaacttcacaaacaatcaggtttatgtaataggagttatgtcttatacatcatgtagtatgcaacaaaattacactagtttttttttgacatggtcggtacttaacagtttgacgctaagatttccttttaaaaatcattatttctaatccatgaactaagtatatattgaacttcctagtaaagtcctgtcttggcctttgtgttttaagataatggaaagatcaagtacatctccaccctttgacacagtccacagcacatggcccaaggagcatgtcaaagaaagcaacaccaaaaagtttgttaaatgtttgcaaggatgcagtgtcttgcagacaatggactaaaaatgcattaagacacatagtttggtaatctcgttaagcagatgaaacaaaagtatatgcattgagacaatggatacctgctgaaaggtactgagagaagccaggatggaaccaccaatccagacactgtatttcctctctggcggtgcaactaccttgatcttcatactgccaggggcaagtgcagttatttccttgctcatacgatcaccaataccagggaacattgtagatcccccactaaggaccacattaccgtacaaatcctttctaatatcaacatcgcacttcatgatggagttgtatgtggcttcatggatgccag

SEQ ID NO: 61423 - DNA, 780 bp, Oryza sativa
agccatctcttagctcgattcaagtctaacctatgacgagttaactggctacaagcttaaaaaacttgcaagctgcaagtcttttttctgcaccagtttttgacagaaagttaactggcacttagctcttggtaggattgcagactcaacaacagcaggagaatagcaaccttgcatatgctttcccatcttagttggctcatcagtcaggtcttaatagctgacaaaacccctcaaacaacacagccgaatctaacgtggcccgggcaaaatgtttaaagaatatactttggatcaacaggattctgaaactgttaactcggttcttcattcatcgtcacaaaggccaccaaaagcctgacaacaaaaaatggatgagatcaacagcatttatataaccaagataaagttacagttcaacaaacatataagacttcgacagacagaagtcctacctgaaccaggaaactgttgggttccattatcataaaatgagtatatattttggactggtaaatggcaaggatattgaccacttgcactcacaaggagaagcatgtacatactgaatgggcaacatctggaagaaattgatcacagtgcagggtaaaaacttgatgactgaaaccatgaaatgtcatatcctgtaaatgtattgtatctgaaactcatcatcttacattaggcttcgaaagaaacacggattgaactaaaattacaacaccaagtgtacaattacaagatgagaaaatacaccccatgaatgcactgttcaatagc

SEQ ID NO: 61424 - DNA, 1416 bp, Oryza sativa
ggcgttcgccgccgaggccccggttcctgcgcccaccaagcgccgcttccgggggcgtcgcgccggccatcggcgcggcgctcggcgccaccgtggtctcgttcttcgcctactaccctgagtgagcccaacccgaggaggaaaaaaggaagaggaggagatggatgcatggccatggctactaaaccgatccaaacacgcgcgataatgtgggtgctttgatttgtgccaactttgatgcctcgtcttctttcttctctttttataatgggttgtatttttgatgcaccggtttgatttcggtgctttgatttctcatatttcgtccaccctatttgaagggaatggatattgtactattattcaccatttgtttggattaaattaagatattggaattactggctacgcattttcgtttgatttcaccatcattcggttacacacgttctgacgttcatcttctaggagacgcgcatcaatcatgactggcatgttaatttggcaatggcattgccgtattggcattcgtattattgcctgtatctgaataaaatcgagttcatttcgtacttcagtaattggattactgaaaggtatatataactgctaaatttcttttcagtttttccataacgcagtagattaattattgccataacactcagaaacaaacaattaagcaggaccaaatggaacagcctggaagggaatgattttcagaaggccagtgacatcaaattgcgctgtaatcatgccaatataaatcattctagttccttcgaacagaatgtaattttagtccgctttgcagttggcaaaagacttacaaattccgttaaaacatacataagggatatgtggtggcttaatatcacccgagacaactaaattccacaagtatgttcctcctctttttttttttttttgtcgaactgacagatcaaaataggccccagttcattagatcaagaaaatcacaaaaatcttactaagcattattgctagctctcctgaaacaatgcctaagtaaataaaactctgaacaaaagttgtaaagggggcacacgatctgcacaagtacagaactgagcggccaaaaataagcattggcaattcagattcaactactccagcagcggaaaggaaataaaacacaggatactctgttgccaaagacaaggagaaacatctcactacaacattgacatcagaccatcagtccactttgccattggcttatttgcacgcaccagaaagaatgaaactaatcggaaaaaaaaaaggttccgacaaagtctctgcgatgctgtatcccttagtggccaaaaaaaaaacttgctttcgagtcatgttacttagtgagagtgtagagcatgtgattcagaatgaccaccacaattgattcataagtca

SEQ ID NO: 61425 - DNA, 908 bp, Oryza sativa
cttggtttgctcgttcttgccatctctcatattgtgcttgagcttgtttttgcctgatctacttgcatgcttaattaatatagttggtgaccttatatcttgcttagatatcttatttgtcaccttttgattcatatacattttgtttattcgtgctacaagtccatagctagtgttttattccgttatccgctgaacctttcggttgagatcggaactttcaatcccataccaaaagttccgatttgaaccgaaagttctcatctatctaatatgctatgaagttgtggtaattttttaggaacgcctattcaacccctcccccaccccctctaggcgacatcaaggtcctttcaaatcatgatcattgatgatgcgtttagttggagggatatgatgggttggattataaagaactcgtttttcatagtgtttggcttggaacaagtggaatgatccgttaaaggaattccctctagatctggttagctccatccctcaaaagtggatcaatctaatccacttcctcttgacatgtgggccacatcctctgaaactaaaaaaaaaagatcattaacacataaatgaaaccatcccatcctaaaaaaaactaggatggacctaacacatcccacttgatccccaaaccgaacacatgctaacaaaatatgatttttgttacatggcactcaaaataaattggactctctattatttaatgctgatagtgttcagcagcaaatgtaactatcttgttccagccctttaggtatgggataccgtccctcatcatccctttttttgaagtgacaaaattagctactccctccgtttcgcaatgtaagtcattgtggaatttcccgtattcatatgtttagatttattactatcaatataaatgtgaaaaa

SEQ ID NO: 61426 - DNA, 2864 bp, Oryza sativa
ttattctgacacagtccaatgctggataatggtcctacaatccaaaaagcatgaagaaataggcaataccaaatcatggacattctttttctgccaactaagctaggcagtaccgaaatacgattccagcaaaaacgacataattttatgaacgaacgaacttgactcagcttttttgtgtgaaggcagaatgcttagtcattttatctcatcatcagtagtctatcaatgtcacaacaattgtttcacttcattctcgtttgttattattgaactcatcctaagaaccccttcaaaaaaaacaaacaaaattactcttccaccatgctggcgtgacaattctatgtgggtaaaaaactcaaagcaccctagaattcaaaaattgttggaaataaacctaccactgatgttactttctatgacttctgctttgatttctgcttcttcaactccaaggaagtccctaatcctactggtgtggaaccaccggactttttagacgatggcccgttggtattccctgcagtgccgttttgtgggggtccattcgattgctgaccttcagatgcattttgagtgctggcagtagcggaagtagcagcggcagtggctggagtgctaccagaagcagtaggcgccttcgccgagcccagatagttgagaatttgagatagattagacatgtaatcaggcgcctgcccgcttcgcacattaaggcctctggcagcagctttcttccgaacttctgcagttgcccgagcagcccgctcatcaactcctcttactcgaggaacaccttcaccaactactgcagcattaagtgatcggttgacatttgctgatccttcaccaggttgtttcgcagctgccttcagtgctctcaccaaatcaggatttgcctgtcaaatcataaggtaaaaactggatgtcaaaagaaccaaatacaaaatactgagatgtctaatagccatatacatatacttcgttaacagtgacaaggagaaacccaaaaaaaagtggcaatgtaccatcaccttcaaacgaccaagcgtgccagggattaatccatgtacagaatagcaaacaaacaatatagggacaaatattggggcaaaaagcttccataactaaaacaagagaatgtcaattcaatcatactgccagtcaattcaatcaacatcatctgatgcaacactaatgttgccagattctcaaaaggaggttttcactctgtacttcctatgacaagctaaaaaggaactacgagtctacggctatctattctcctggaattgtagggttgtatcaaaggcaaaacggtaaagacttcaagattgcagcaactaaacttaccttcaacaactcaataggattagcaggtgggttagtaccctgctgacctttttgcttctgggcattcacctgtacagcaaaatgagagttacgtcttctatggacaatgcaaaaccggatccagcatgaagataaaggtatgcaaagcagaatggaagattttcttacacaaaggttttgcattgcattacttggtacttcctccgtttcacaatgtaagtcattttagcatttcccacattcatatttcattaacatcagtataaatgtgggaaatgctagaatgacttacattgtgaaacggagggagtatattagatgtacaagagatacaggaccaaataaaaaatagccgtatacattttcttaagaaaatacaaaactacaatactatgccatacataaaacatgttgcatgcttgttaaaagtatcacaaatccaaatacagtttaaacttatacctgctgttctcgcgacttaaatgtatttaaccaactttctgcatccttagtccttgaatcatcactccccaattgtttcaccagtatatcataggtcttcttttcatgctgccatcagaatcaatacatgagatcaatgttttcaaagtattctttttaccaatcatctttctggtgaactgacctgaattgaaagtttgaatgcacccatacaactgaatgcaatggcaagggcatgatagcagatagctgtttgaatatgatctggtcctagaagcctctcgttctttgtgagtgcttcctgaagatacctaagagcagtactcatattcccagcatcctggtacatcattgcaacatttataagagtcgctgcaacatctggatgattaggacctgatgctaaacttagcaaaagcaacgtgcgagacatgtgacgcagagcaagttcagtttgattaagcccatgatagaacaaagccatgttaccgtagctgaaaaagaaaataacacacaaggttagttaatataaaagatattaactgcacaaattgaaagaaagaaaatgatgttgtaaattaatatcacatatgacaaagatacattcattctctagttggtttaaagatttctagtagatgttgggatctaggatgggcggtcagttttgtatcaataacgtgaaatttagcttcacaacaaggacaagatcaaaattctatagaaaaattgaaattgaacaacatgcctgtgggctgtatcaggatgatctagaccaaggcatcgctcatttatgataagttctctatgttgctgcacaattgctcctggtatatcgccagcatggtacaaaaccatagcaaggtaccttcagtcaaagggaaaacaaattaaaatccaaagattttattatggatgacttatgtacataaaaacaaaaagagaaatctagaaaatgccagatgcctaaacaaataagctaatgtgttaccggcaacagtttgcggcatccttatgcatgggaccagtaatctgttaaaggtcataaa

SEQ ID NO: 61427 - DNA, 21897 bp, Oryza sativa
agcacagtggcgctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttttgtgaagaagggcgagcatgtagattgctaagctgacacgtggtggacaagaatgaccgacgtgactggtctgataccagtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtatccccttaaaatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtaggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactcctccgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacctgcgtctgtccactcttgggaggatttgtgccaacagttcaccatgaacttccaaggaacatatccgcgcctaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgtggtggtcggaggttgccctcaccttcgaccagaccgaccacccaccgtgcattgcccggggagggtagattgcgatggttgtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacatggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccggtccccggtggccccatctctgtccatggcgacctcaaagtcgcgctcacttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgaacaccgtctcgccgtgcggccgggcgcaaggccggtccggcagaaagtgcggcggcaggccccagaacgtcaagccttcatccgcgaggaggtggcgcgacttctggaagccggattcatccgtgaggtcatccatccggagtggctggcgaacccggtggtcgttcccaaggcgaacggcaagcttcggatgttcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacaggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagaagggaggagaggctcccgagccgaatggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccaagccgaacggaggcctaaggcccctgacgaccgaagttggccctttgcccgcttttccgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctctgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccacagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcatcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacgtcgattcatggatcgaggagttgccagcggtgctctgggcaaaccgaactacaccaagccgagcaaccggggaaacgcctttcttcttgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgttccccggccgggctccatatggctggccacgggcgacggcactgagctgcctaacccgtggaacatcgaacaccttcgtcgcttctacccctgaggggagggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggggaatcggcaaaaacctacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgtcggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcagtcctcggtcccaggagggaactcatccaacgccatccatggagagaaattggggtccctggcctggtaactcgccaggacgagctccaccgctccttgggcgaggtccctcgaggatgacttaattgtcttctcgagctcctcggggagccgttggagggccccgaccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcgaaggcggaacgtgaactcttcttcggcgcaggcagcctcgtgcgccgccagcgttgcttcccggatggcgacggcggcctcgcggtccgccagatccctctccacgacgcaggcgcgctcttccagcgccatggcgcacgcctcgagggcctcttcgcgccgccgggacgccgcttcggtctccgccgcccgctgttctcgggcagcggcagcgtcaagcaccccctgggcggcgtcgagcttcttccctagctccgcctcccagctcccgtattaaaggcggagggtgtcctgcgcctcgttcatcacggtggtggcaatgagggcagccccccgctcctcctctatttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctacctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccgacctcctcccgagcggcttccccggcctggcgggcccgggcggcctcctcccgagcggcttccccggcctggcgggcccgggcggcctcctctcgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagattgaatacagccacgacgggtgagagacgaacctgcgagggggtcggttaaacgaccactttggaggggaaataaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaagtgttcctccctgcttcctcttcccccgggcgttggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcactggagcggcgcaatccgacgacggaggtagtcgccgtacaccatggcccctgtgagcccctgggatcgcaggcccgccaggcggtcgaggacggcgtcatagccatcccccagatctaccggcgcccgccagctggagacctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacgaaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgctaacgctgtgcccggctcctcgcttctcgcgcccactatttcgccccctcgtttctcgcgccctcgcttccactaatcccattcgcccgcttgcggcgcatgaggtgggtatgcggttgtggcagtcgagatagatcatatcgtgcgcgcgttaattacgcttgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgcccgtttcccttaaagaaggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccatcggccccgagggctgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttttgtgaagaagggcgagcatgtagattgctaagctgacacgtggtggacaagaatgaccgacgtgactggtctgataccagtcatgtcgttagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcagcatatctcaaattttgtaaaattataatggtatgattccaatttttccttattattatagccacttgcagtaatgcttggattatattgctcgttgtgaactcagtggatgggatcaaatgacagggctgctggtcaccccccgaatgcatctggcattggatgttggtgttggtcatgcatacaagacgacatcaactattgtgcgtggctgatctgtttggataacctagcttaacagcaagtagcaactgccataaaacagtatataagctcaagttgccttctcacacatactcttacagtctccttaggtcgaaatctgaaggaattcaagcaaacaactatacgaaaattaaacatagttaactataattaagctgtgctgcttgcctgccactagtctgcagatctcttatataactatatatacttcgcaattcccttttctcgctttttcttattttaaacaggctttagtacttcaattcctttccattttgaaaaaacaagtacataaaagcgtaggcatggcaagatagaacacacaacacgacgaggagtgtatgaacatgtatgcttgattgattgatcagcttaaattgctttaattttgtgtcctgaatatgttttttttagaactgtcctgaatatgtagaacttcggtgcgtcccaagctgtgccgcaacgataaggccgacacggccgatgaggcacgtccggggatgcattattgtctggacaacatcaggcgcttgctaattgatcattgacggcttcttgattagaaatcactcgctataaatgttggagtacttgacatacacctctttgataagatgccttgaaaatacatatttcaaattaattcgagaattattcttacatatttcaaattacttcgagaattattcttctatatgctataaaaaccttaaaatatgaaattattactttgtgtataatctagcaccgaaggatcttgaaatattccataaagaatcttaaaatacgttttccttagacggtagtatgatgggccgatataagcacgtttttttagcagtccggcccagaaagcccaggcaaacaaaagaaaacgtacgcgcgccaaaacgaaaccaggatccgacaggaagttgacacgtcggacgccaccctgtcctacgtggccggaacggaccacccgcgtattgacaagtcaccgccgcggtggcgccacgggagccacgtgtcacgcgcccatgagccgaccggtcgcgctcaactagtggaggctccggcatgcaggattatgattgccatttgtttaatccagtctctaatgatggatggttagtgcggtttggcgtccgttgcatttgcgggtttcagcgagctagacgccctagaccctctccggctcgtagaaaactcggtttaaacacgcaactccgtgggctcgtttcgagtttgtattttgtctttgtgtgcttttagctcggtgcatggaagttgcaagcatcttaaagtggaaagttttgtgcttgccggaaatcaaatgctcagttgttcttttcactactgttatatcaatcgtgcagggactctcgagaaaacatccttttattatttacatgctatcgaaatagttataaaaaaattaactaaatagattaatatgtggtaaaacactccacaaacatataagttaaaattcaatttctttaagttgtaaaaaaattaaattataactatttaacgtatattcatagtttttttcgtttcttgtacaggttaaatttgatcttgcatatttgtagactgatttatcacatattaatctatcctattactattttaaaatttgttcataactatttagatgatacacaaataataataatgttcgagagtttagaataatttcctcaatcgtactgcactactgatacatatacgtcctgcctctcaaaaccatggaagatgccgctgtattgtgtgttctttttgcttaattaaacttactctttctgaaacataattttaaggactaccggaaagataaggaggtcgcatagtgctaaagctcgtaggttcaaatcttcaccccctccttaattcaaacatataacctccgttctaaattaaatcaatctagaatagaataagacattacctaattcaacgaatttggtaaacaaactcttatttaaatttgtttatgtaatatcatattttattttagattgatttattttggtacacaaggagtaggtgatttctaccaatttttttttagagaatatggggaattggaagtctgaaactgaactacgtactgaagcacttccgtgtaattctgcatctggtcaaaaagcctgtctgtcctgtgtgtctcctctgaattttgccggtaatccggctcccttacgtacaataggtagtgtggtgcatcttatctccacgactcccctccattactcgcacatgcctctgaattgatcgacaagtccacagggtaagtacttctgttaaagtctttcttttttttcccccgcggtgcccactaagcaaagaacaaaaatcacacagactgaaatgacggcgacccgaaatatctttactattaaaattccactgcgcactgtcaccttcctatataaacggccaccctcgccgtgcgacgagagaactcttctcccacgagaccaacgttttctactgtgcacgtgcgtacgttggtttcctcttggagttttacacgaaggaattgaagtgagctaccaaaacatggacgtcgaacagctgcagcagcatgccaggaggcttctgtcgaacggcagggtggtgtcggcggcggcggccgccggcgcgtcgcctggtccggctgggcgcgtgttggaaggcggcgcggcggcggcggcgcgtcgtccggcaccgttcagctcgctggacgcgacggtgatcacggtcctgtccctcctcctctgcgtgctcgtcgtcgggctcgtgctccacgcgatcgcccggtgcgcgttccgcgtcacgcggcgcatgtgctacggccaggagccgcccggggatcacggcgacgaggcggcggcggagcgatgcgcccgggtagccaggaagaagccgggacgcgccatcgcggagaagatcccggcgatcgtctgcccggccggcgggctcgatcggctcgccggctgcggctcgacggagtgcgccatctgcctctccgagttcgcgcagggtcaccgcgtccgcgtgctgccgcgctgcggccacggcttccacgcgcggtgcattgaccgatggctcgccgcgaggcagacctgcccgacgtgcaggcgggagccgtttgcggcggccgcggccgtgcagctgcaggtttaccctgacgccgccggcggccagcacgagacgccttagcaccaacgtgactcaactgtacagtaggctatcacagtagttgggaacacagtgaacatttttttgcttttcttttgtcatccgagatactgtggtcattatctctgttttttttttcttttctgttatgttcatgtcgaagtgacccggttccgatgaaatgaaggtgaaaaccacccgagtaaattttactgaaaactgcaaaaatatgtaccatcaggttgtgatttggttcaggcttgtaaacccatttgcaaatattgcacggagagtgccaacttttgaatcgtctgaattgtttcagacacgatgggagctgcatctggagtgttttttttctactttcgagaggtataatactctactaaaatattatatatacaatagaactgaacaaaaactcaactcaggagtataatatacatactctctctagtcaaatttattttatgttgagtttagttctcccaacgtcaaatatttttactagatcaagtatctcttaatatattctaaatacaaaacaaaaaaaaatccatgaaattgacgatatattgtgtgatctgttccacaatgaaatgggcaacaggcccattgagtaaattcggcccacggacgtactccaggagtgccagcctgctacaacactagtctgacgttgtgactctacattgtactgtacatacgagtattggtatagtagtagcagaattagaaaaagaggaatcggcctacggtgtatctcgtactataaaagatggatgtttgtgttgtggatttgtggtggcgtgtatctccctcgtagtctgaaaaagttaactaagaacgcatatttgctaaccacgggtaattccagattcccttgctactggttaagaatcgttttgacttgtacggggttgctgaattttctttgccgatgagttatagatgatgacggccgactgatgaattggtgacttcctgaagttcaaagcaggtacgctgaataatgcgatgcttatcgctgtttctgaagacatcattttcccctctgtctcactgcaaagtgaatcacaataccatgtgccatattcgattgtttgctgcaaaatgaaccttccggggaggaaatctagtcaatttatgaatagtttagcgcaataattagctgaaatggggaggcatgaagcacgctttttgactgcaagtcggttacatcttcattccgtcttccccccggccgtccagagtgggagctgcagctaccactgccacaaacctttccgcctcactgaattattggctcacgtaatgggttctcctgaggccttccactactggaagctgcaaagcactgtactatagctagcgtgtgcctcgttaattatacttttctgttgccaataatgcagccactattgcccagaacaactgacactaatacgcgggcaaagtgatcaactgagccgtagtattcgcgtatcaacttatcatatcccccagtgctgaaagcaccaacaggatatcaacatatgctgttcttccggcatcataggatggaactgcgtcaactttctgaaagagggtaatacagtatgaattattgctgctttgcgtggctggaaaagtcaattattgggggagagttcggttctctgccggctgcttgctcgaccgaatgatgcattctgctgtagctagtgatagtgctacgcattagtgttttgtacggtcttaatcaatcgtggtctgtagaatttgatggagcaagctcttcgtgttgcatccttggtccaatcttgtgcttgatatgtccgagtcacaacgcatgaaagttgtttcgcgtaatttgtgtcgtatatactccgtatctcctagcagaagaatatcacgatcatccgacgaggacttgtgttgacgtgacaaaatggtccgcgttttattcgtgtggccctggtgtaaatcggtttagctcagatcgcacctcggtagaaaagtgaacccgtaaatggtacgacaattggcgagttttctccccttaactttgtcttttattttgcttttctttcatttttctctctttactactgtaggcagaagccagaaaagctaaagagacgaatttcctctcttctttttttgaaggaactgaacacggtgacgccacaggagcaagtaagcaagagtatttactcccagaagcccaatccattgatcttcgtgagactttcaggagaatccaagcccaaataggtctcaggcgaacggcgaccagcccaacaggcctataattggcatccaaactaagcccaaatagacaaaagcgcggcagctggacaccttgctattcatcctggactttcgcaacgggaaactcatgggccctcaaggtgattggcagcgcaggccgccttcgccgtgctagcaggattttttttattagtttaaatttttatttacaaaaaaaaattattcaaacttatattctatccgtcctataaaaaacgaatctagtaccgcatgtgatatattctagtatgatgaatctggatagatatatgtctagattcgtagtactaagatgtgttacatccggtattagtttggttttttatgaaacggatggagtatgtatttagtagtgcatctctaccctctcttaaacggtttttatgacataacacacgactgtggatgcaagttagcagccacgcggagggaggtcaaccattttacaggcagccctcttccgctctcctaaaggactacaaatggttgctcgtaaaatcttcgtgcggccattaacatacaccaacggatatgtcacatatgccacgtcataaaaaaaatcatcttggaggaaaatagggttgtagatttataaagagtaaatttaacaaaattaaaggtaagttgatcaaattacagtaaaactacatatttaagataatataccacaaaactatatatttaacattaaatttttcccaaaactagatattcaaggtggagtgccgtaaaactatagatatagaaaaatgttatcacaaaattacgggtgtttacaactcaaacatagaaggatttaaaacctaaattttgtaattttgtaattttgtgattttttacgatacttggtcataaacctaaaattatgcaataaacttaggctgcgttcaggataaggggttgggaacccgaagcacgcattattgcataattaattaagtattaacttttttttaaataaaggattaatatgattttttaaaactacctttttatagaattttttctgcaaaaacctcacggtttagtaatttgaaaaacgtgcaggcggaaaacgagagatatgagttggaaaaaattagaggaataacacaacattagtgtcaaatatatagttataaatatgtagttttgctataatttagttataaagcatatgcagttttgtaaaatttaatcatttataaagctttgaaaaaatatttttgtttaacattttattaataactaaaattaaaaatattctgcaagcaaccggatcgctgtcagcctatcaccgcctcaccggcgaaggctgacggggtcacgggagtaggttgcgcggtcggcttccaccgcacgccagcacgccccgtccaaaccagccggtggcccaccggccattaagaaaccgactccgacgtggccgttccggtttcggcaccgaaagtccgtccgtttccgttgccaacttgccaatacccaccgacccggcacgccagtccaggtcaggtcagacaccttcggcttggctggctcagtggttcgcccaggtcgcctgcctcgtgctctgccgtgccgtgacggtgccatgtcacgttcaaacggcgaggcaaaggggaggagggtagctgagcacacacgcggtccgtgcttctgcaggcgaaggtgacgccgcagaagactagtccaacggggcggcttccacgcataaaacggctccccttgctgcgctttccgtttcggctctcccatttgtctcgcgctcgctgtctcgcgtcagcggcggagctctctagaaggagcagaggagtcccccccaagcgatcgattcgatcccctccgccgccgatcgcctcgccgaagtctccgaggtgtaagcccgttcgatctctccctctccctctccatccttgtttcgatctgatccgtggaatcgcttcgctggatcgccggtagagcttcccgtgctttgttgtccgggtgatttttccggggaatttcgcgctgttttcgtggactgtttgtgttgacctcggcgtttggacgcttgcggttgatagctgtatcctctcatgactagcaagggaattcatggcgtttgtgtactgtatgttgtatagtctgatccttggtcgggttgtatgctgcagttgcagacagcagagcagttccaatatcacttctggagatgatctcaaactgcataatacctattctaatactttctatttcctttctaacaatccgctgcgcagctagttgtatgttacttcagtcgatacttgcatcatgcatccagaattccagacaaatagttgtatgttacttcatgttgtgttttttcctttgttaacatgaaacctctgatgtgtcacatcgtgattgtgtttacctttattgcgtagttttttttaaaagatccatactgccttactgaaatcaaagcgaactcaaatgaaaattctttcttattttgcatgatcatacattcagtcccaggtgccacttctaatggttagtcccatgttgtgttttttcctatacctgatcagttccctaatgatatgatctgtattttattggttgttcgttggcatgttgtaaatgtttagtgattgctacttcattttttttatcatgcactttatttgggcccaggagtaagctcggtggcacttaagcaaaacagtgcttaagttaatatgcacaataattgatttttgaatgcattctgaatactgatatttgttgcagaaacacttgagggatggctgaagaggatatccagcctattgtctgtgacaatggcactggaatggtcaaggttagttaattttcctgccacgctgtaaaactgttagttcgcacaattgggatgttcagattctcttttgcctgctaatacatttgtagcacccaacgaattgatcatttcttcatgtggaataggccggttttgctggtgatgatgcacccagggctgtctttcctagcattgtaggcaggccacgccacactggtgtcatggttggtatgggccagaaggatgcctatgtgggtgatgaagctcagtcgaaaagaggtatactgacattgaaatacccaatcgagcatggtattgtcaacaactgggatgacatggagaagatatggcaccacaccttctacaatgagctccgtgtggctcctgaagagcatcctgtattgctgaccgaggctcctatgaaccccaaggcaaacagagagaagatgacccagatcatgttcgagaccttcaactgcccagcgatgtacgttgccatccaggccgttctttcgttgtacgccagtggtcgaacaactggtatgatgattgctgtacaaaaaaaaccatttgattttaacatacttatctaaaaaaaattgattttaatatccaatgagtagtcgaactgcgctaactagtttataaatgcaggtattgtacttgactctggtgatgggtaagtcacactgttccaatatacgaaggatttacactcccgcatgc

SEQ ID NO: 61428 - DNA, 1357 bp, Oryza sativa
ttttgtaatttattttgttattagactacgtctaatacttcaaatgtgtgtaacaaaacttttcacatctagagtttcaaggccaagtttaatacttcaaatgtgtatccgtatatccgatgtgacacgccaaaacttttcaccttgaagttctagggcgtaagagcaattcagtaaacgcagcaactcctgtgcaacacaaccatccgaaattcagaattgtgacgcttagagagctggacccaaccaacagtccaacacagatatacatgcagctgcagcaccaattctcgtaggtgttattttgcaacagaggccgatgcactgaggtctacaagaatttgcagcagaggctgctcgtaggctagtagctgatgccattgggggagtacaaaaatatcagcattcataaacttcactgtttttcatcagcatttctgcagaatatgtttcggttctcaggacttcaggagtattgaaacaggttgtgctgaaaactatatacattaaaactttcaaacaaaacaaacaccagcaattttcactggattctttttgtttataaacaacaaaataattaattcttcatagatttaatgacaaacaatcatggaactaccaaacaacactggaatacagaagaaaaacaatactggaaaacagtttagatctcatatcacagttcaaacaacacataatacagtcaaatatggtgataactgatgagcaacaacacagtaacaatgaagccaagaggaagaatggtgtcttgtgagagggcttatgcctgtaccagagtaaagaaaaatgctgaagaggaacaaatgaaagctagtaattctgaactagcagtggcccatcgcctcattattccatacaaaactatgtcgggaagatgttgaaataaacatttcaagcatgtctcaaatcaagcaaaatggaacaaaactctgaagaaagctggatccgtaggataagatgtagatacctatgagcacaagatggcagcaatcctaacacatgacatgggtttcaaactgtgaatccgaacttgtattgatctatatatttccaatgtgttccctctgaaaatgttataataactaataaactaaatgttaattccccagccaatcacttataaaactcaaacatccaggtaaagaagaaactttctcagaagccaataagatagaactaactcaggcagtacagcttatcaacctagatacagtaacttgctcaggacatcaacaaagaaggctgaaacaacagtacaattattgttatcaccaaacacgttagaggtacggttattagctcacctcatttcttaactcaatcagtctcaagtggt

SEQ ID NO: 61429 - DNA, 818 bp, Oryza sativa
aaaacacacgttcttgatgataagagcaagttcaatagtatagccaactactggctccaattcatctatagccaatctaatacatattcatacaatagttacatactacactatcaataactggtcccacctgtcatacacacattatgtattggagtccgtattacagctggctataaatctgtagcccgctacacttctctctcctcatttatcttcttaaaatatatttgtagctagcttatagcctgctattgtatctgctctaacagaggccagaatgttcgggcctgatccccacgaggccaatgtgtgtcaacatgctgtagctgaaagcctgaaatcaacaatgccttgcacgcgttgttgaccaacctggacgcgtgcgccgcttgtgcaacagtgcaagtcagtttcggactcaccgcgcgccatgcggttgttgactgttgtgaatgggggtagaaatcgcccgcgtagcagccgcgcgaagccacggcgagctagcgcgcgcggccgcggccgcggaacccgccgtgcgtgtgcgcttcgccggatggtagcgttcatgcgcgtgaaaccgctgaccttgggttccatcacccacgcgaccttggccggccgtacactggctgcgcacgcatcacttcccgtccgggattggaaaaagtacgcaccaaaggtccctcaacttgtcaacgagttataaaattgtgtcctaaccacaaaactagatatacgacatcccttaacttacaaaaccgtcaactttagatccttctatgggtttgatcccggttttatccgatatggtagct

SEQ ID NO: 61430 - DNA, 15207 bp, Oryza sativa
gagggagggcaaatgggggggaaagagggagggaatcacggggaatatttcccccctcttgattgcacgcgggacggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcgcgcgcgcggggaggaggccgaatgggccgcggggaagaggggagagagggaaagggatgggccgagccggcccaagagggagagggggagggaaagggaactttttagggtttttctttttataaaaccattttaactttgtttatttcttcttaaatattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcaaggatgtattttagagtcgttttgggacgcgacattcgagcatatcggctttgcatcttctcggaggttgttgatgtggtctaacccctcgtttgataggtagctgatgttcaacaatcgatcggctgagtcctggcatctcataatactcccaagcaaagcaatatctgaattcctttaacagctctatcaacttggttctaaattctgaagataagttcttactgataaatctcggccttggtcgatcacctggaccaatgtcaatctcttccaaatcatcggccgacatgaaaccctgtccttgcttgtcatcgagatcatctactatgtccttggtgtagacgtttgaaccctccacgacgccctcaaaataatagcttgggctctccatcttcaattggctgtttatcacaatcggacacttttagaaaatctccatcccaaacttttctagataagcaatcgagaccatccatctcccaaagagctaaattggcactggcaacgttgactgacctgtcggctggcacgatttcaatcttgtcgccttgccactgaatcaagcattgatgcatggttgaaggaatacaacaattggcatgaatccaatccctaccaagcaacaagctgtaagaacccttcccaccgatgacaaagaatgttgtagggacagttttgctaccgactgtcagttccacattcaaaactcctttggtttctgatgtattgccaccaaaatctttgagcgctgttgtcgaaacaacaactgcatacgttgaaagacgtggttactcaacggtggttggaaagaaagtaaagtgtattgaattgagaatttttcttaggatccccctgttacatgaccctaggagactatttatagccttattacaggttcttgctactagggtttaggttatacaggggaatttacttggctgcccttatgaaagggacatttatgtgggtatacagtgtaattgaggtacatgggctcctaatgggccgtcaggcgattgttggctcaaaggccactgggccttcgtgaggccgaacttgctatggcgaagtcgtctcccttcgacatacactcttcgccttacatccttcgcccaagaggtctttggctctgcgaggcacccgcgctattctccgcccttcgcggtctttgctccatagtcttcaccatgggggcttcgccccaaccgatcttgacgtcttaggcttgaatccttactggtcgcatggtttcggcaggtttggtcgaagggcctcatgccataccgccaacaagcccctcacgggcaagggtgagataggagcttcggccgagaccgtgcagaccatgtggtatggtatgtggctccccctttcgaccgatgctcctgccgaaacctatcttattcgtgcaaagaaagtgtgttgtgttttttcggttggtattgttttgtagctttcgcctcttgcggatggtggagttattttttttatttttcccgggccgaaaggaacagtaatgggctttcccttcatgggcttattactgtgcggctcggtcgatggaaatttaccgtttcgcctaccctcgcgacacgtgacgctttattactggtgggtaggcgaaccattgcctgggtgggctatatattctctccctcttttcccttttcactgccacacttgtcattttcactgcgcgcgctctcttccaccgttctatcctttcacggcgccccttgacccctcatatctttcgcccgttctctttgttcgccactgcacacacccttcgccatggctcctcgcaagccaaaccacgggccggattgacgacgacaccacagcctttttggggatttctctcatagatgacggcgagctggcgaagttggtcagctctggggtgttggttgaggggcaggctttcgcccctgggaaggccgtggtaccgaagcccgtcgacaaccagacgtggtgttcgccggcttttttgagcggggcttcggtttccgtgcaacatgttgttgccggagatccttcaccttttccaggtagagttcccacagttgagaccgtcggcgctagtccggattgccatcttcgactaggcgtgccggacctccgggtttgaacccagcgccgaactcttcggcgccatattttttgccaccatgaattcgaagatggtggtgaccccggccggaacgaagaagacggtgttcgggagcgtgaacttcaacgttcgccccaagcgctccgatctctggcctgtgaatgccgccatgtcgaagtgcgatcgccactagatggcgaggtggttctatcacaccatccccttcgaggctgggtccgagtcggcgaaggccctccgatgtcggcgcatggtgattgcgccgaaccggaaacccaagatcgccgtggacggcgcaatggaggcacggttcgccttgctacgcaaggtctgctcccgcctcagctgccgcgacttggtggaggagttctgtatgcttcacatttttcccctctccctgtcgtggcaagtcacggttgaccaagacgaagaggtcgacggtttgccgaagctggttcttcctgaggggacgaatggtgagaccacgctttcgctatgcacttctgtgttttgctattttcccggttcaacgcttaatatggctacaccttttattttcatagtgttgactctcgatcaggccgacgctgaagcctggaagatgatcggcgatgtgtcggtcatcgagtacagccagctgctcacacgacaggctgccggtcgggcgaaccttgtttatgacggcgaactgcctccccgggcgaacccccacaaggccgacgacgatgcagggccttcgcgaaagggacgcgtggacaagtgaaactggcccctagaaagcgatgggtccctgcttgctccgattctgacgccgacgacgaggatgacgtcgaagagcgtgacgacgaggaggaaggggaggaagaagagggggcggaggctgcggccggaaaggctgcgaacgaggcggttgaaaaccgcgccgagacccctggctacactcctactccaagtccagggcataacgagaccggggtggagtcgaatagctcccaccttgatcgaaaggatttggagggagcgaaggtgctggttgcgttttcggcgggcaaggtggcgaagggggtagtccggttaagaaggccgccaagaagaaaggactcgtcgatgttgctcgtgtttttagcgacgacgagtcttttgacgaaaccccgacttcgcccgccagtcgcagcttagatctttcgaccgcccccgttgtttcgatcgacgctggcggcgcaggtggcagtgccgccgctggggcctcagcctccgctgatcgtgtcgtgaaggctgcagctagggttttcggaagccctttgcgtctgccagttgtttcgccgctagagaagccgaaggggaaggggggggcccatcgaaacatctgcctcggagtattctctcgcggcgccccacttcgcccccggcgattttgagacccgggcggaacttattccctttgttgagggggtaagcaaccttgtctctcctgccggcaccccgagcctattcaccgagctgaatgagttcgacgaagggtgttctgctattaaaagcttggcagttcgggtatgctattcgctctctcttcttgtttgtctttattttcatattacagatcccacaactaacatttgctctcttcatccgttttaccttacatccaaattcttgcggctcattgttcgacagagcgaaccgtgcgggcccatcttgacggatttaggaaccatcttcgggccaaggatgatgagattggccgcaagaatttggagatggaggccctcgccaacaccctcaaggaggcaaaggtggaaaacaagcgactccaagccgaactggagaagggaagagaggctagagctgaggtcgatcgcctcaaggccgagcttaaaaaggaaaaagcccattccgccgcgctaaccgactattacaatcttactgagccgaagatagaggctcttcgcctggaggttagcaaggctgaggcaagcgctgcagaggagtcgcaacggttttcgtgggagatggcgaaagccaccgagtccgcaaaaaggcatgccaaactctccgccttgccctttccgacatgggtgcgagggtgcgaggagtccctgccaaagatgcctctatctttgacttttcggagtggacgcaataggccggtggtgcggtttcggactacgccactgcgtacggtgattcctgtgcacatgtatcggcggcgttcactatgggccttctacagtagtttggctgtgagcatgtcgccgagttccctaactatgcgaagggggactgggaggttagtgcacaggacgtttcgcctacgctccatgcgtggcagaagcagttctggcagaaggatggccgatccactgctaaggcgcgccttttggagcaactggcgaaggccgaggcggcagaccaaggcgaaggcaaggatgcggcagaaggagggggtggaggcgatgcccaggatcacccagagttgtgaggccctccgccctttccttagatttttgtagtttttcttcttgcgtttgccgtgaaaggcgaacaatgtatatttggctgatggccccttacccttcttattgtagccgaaaatgaccttttggatatttggaatgtatgacttagtcttagtcactttttatggtcgatgcctttggtgcatgtgcttgcgccattttcgcattacgtaatatttgctctttttcgcccattcttactatgcaattcaccttttgccctatctgcactgtttagcagggtgttcgccgaaaattgtgcattcggcccctctctgggaattggcaaagcaaaaacgagaaattcgtggtgttgaagggtctgccaaaagtgcgatgctcgtttcggcctgtttatcgcgagatggtaataaatggccacagctataaggtttttaaggttgctggctggctgcgggtgcaccccgggcgaaccttagaagattacgatcgtgttcatacaaaatgtttggaggatatggttcgcttttggcgaagtcatcagaagaccgatcgacaggaggcgatctcccagcgtcgttacagtctagtctgtgtttcgcccccttctccacttagggtcgtgtatgatattagtagcgatgatgatcctagttcgcccaaccattccttagagagtgaggacggttgtgggggcgaagatataatttatctgtaggctgggctgcagagccatcgcttttctttacttgtaccatgttgtatggtttgtattcttggatgtgtattttcctcgaagtcaataaagatgtgctttatttccttttcactattttttgcattgtcacttctcgtgctttcgttaggtcggaacatgtcggcccctttgcgtgtattagcgaaataggtctatgacttttcagctttcggcttccgttttcgatctgttttattctacattgaaggaagcacttgtgctttcgttttgatcgaatgtaacggtgttcagttagttgtttctcgaaacaagatgttgcggtttcaacgttcggcgagcggtgcttcggccgattcgtttcgccccctggcattttcgctgatcaggcgtttgccttagggtttttccacagattatcaatcacacaaataagaaggcgagagacacaaagattttatactggttcgggcctccagggtggataatagccctacatccattttttttgtcttttttttcattttcctcttttttttgcatttttgtgtcgaagggcttacatagtgccgaaaggcttacataacaatatgtacatttttacatgttggcgatctgggtgccacccgttctacacatagaaacgctggagagaggcagcgttccaggaatggtcgaactcttcgccttccagtgtcgccaggcgaaaggagcccgtcctggacttgtgcttgatgaggtacggtccttcccacttcgattcaagcttgccaaccgccactgggttcgctttcttccttaggacaagatggccaggcaacagctccgtcggtcgaacttttttgttgtaagttgccgatgtgcctgtggcgtatttgcgcatgtgttcaagtgcttcgactctcaccccctccaagagttcgagcgacacttcgcgcccctcttcgcccccagagaacatcacccttggtgatgaaagatctatgtactagaattgccttgtaaggggagattggaatatctatgatcctaagagtgtggtgattgttttggtgattaatgacaacccattgttggaactaactatttccatgagttggtgagattaggttattccggcatcaagttaaaagattgaagctagaagatggacattataccttgatgaggagtaagtgaagacattgatgatgcgggggtatgaaatggctatctatggcaaaccggtgaagagaaagaaaggctcagctagaagatggacattataccttaatgaggagtaagtgaaggcattgatgatgcggagtatgaagtggctatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttcccccttcctctcttgggccggctcggcccaactctccctccctctctctcctctccccgcggcccatcggcctcctccccgcgcgcgcgccgctgacaggcgggcccgcccgccaccctcgctgacgggtggggcccacctgtcatccccgacctcgcgccgcgtccgccgcccgcccgtgccctagcgccgccgccgccgccgattccgccgcctcccgccgtccccgcgcgcattaaagtggggggaatcactccccgtgattccctctctcttttccccctcttttctctctctctctccctcggatccgtttggaatcgctcccgcaatcttcgccggcgtcttcaatggcggccgagatctccgcgcccgtttcctccctctccggccgcgctctccccctcccgacgctatataagcgttccccgtgctctcctcctccgtttccgccactcgccgcctctcctccccgtcggaatcgagcccgcaccgtcgcaccttctctccgccgtcgccaccgagctccggttcgccgccgtcgtcgctccggacctcctccccactcggcgtcacctccttcggcttcgccgcgtccccgtcgacctcggccacccctccgcttcgctcgccgaccgccggagcaccgtcgtcctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctctctcggctgacgcaataaatgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggggtttagtagagtaaaagccttttcttttccgtcggtcgtgtagatgctgcagcttcggaagatccgctcttcgtggaagttgaagccggcgtttgggaaagcgagcaaggcaagtcacatcatccttgagcatattgaatcccagtttacaaaattatttttaatttaaattaatgcattatcgctttgtttaaattcccgcgttatcactgttttatttagccatgcctatttacctttgttatgaccatactattattgttattgatattattaccttgttcaccctagaataaacaaaaccccaactagtggaccctctatttatggttccactagtatgaatttaggtagatgcttcgctgattaataggacaacattaggtggttttataattttagactttgggtgtattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcttgtcccgggtgtcccagccgtagggggattgggtcggtactcttgtttatggctaggatgggttgggaactatgtcacgtcttccgtccgtataccgtggtggtatgtggcacgtggtaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaatggctttgggcaactaagtgacttttaaatgctgtttactgcaaaacttaacccctttattattatccccttgtactcccttgcattaattatgcatctccggcgtggcttgctgagtactgtggttgtactcattcttgctctatctttctcccccccttcagtaagagaagctttggagaagaagtcttaggtggagtcttggcttataccccagttgagcgcctgtgaagatggagccgtaggccgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacactatttatggcaaaacggtgaagggcaagcaaggctccgctacaatggaccatgcgtggggtgaaggtcaagcaagaggcttggcgccgatggaccgaatccggtggtgaagggcgagtgaaggctttgtcatgatggtcgtggtggaccgtgcgaggccatttgaagctatgagtaatccgtatcaattataagaagaccgcaagatggaatgccgaggatcaagaggatttggttcttcgatgaacatcaagtcaaaatccaaagtgggcattgatcaaagcaaaggtataatttatttgggactaatatgcttaatgagtgtaggtgagaatagtcccaatagcgaaatggaattgacgttgacaaccctcaaggtgaagcaagaagatgacattcttagtggtgtattagtcccaggttgcttaggagtgggctaggatgcttggagaccccccaaaacaaagcggcaagaagacttggagccgagttagactagtttactttttcgctttgagtttaggaaaaaccgtactattaagaggggttccaagtgtggttctgagataacacaagtgctcttagtggtgtccaagtgttgaaatatttttaggagctgtttttgaaaatggctctactcgggacagagagtcccacctggaggttctgtccggaacttcctggcaccaaggtgaggttgaaaaatttcataagtgctgcccagaagttcctggcacttttacccggaagctcctggcaggtttccagttcaaacttgtgagtaacggctagatgacgtcacctagccgttatatatatggatctcgtccccaggtcaccctttggccattccactttagttcttgtgttccctaacttgttctagcatctcccaatgtgattttgcttcctccacccaaatcttgtgtacttcttgagtgagagagtgattttgagggtggtggtgaggattggagaaggttttgaaggctaggatgacttgagcacttggggtatctcgttgggctatcatttgaagcttgttactcttggagggtgacctcctagatggttaggtgtcgcccgcgagtttctaacaaggttgtggattgacccgggcaagtttgtgagggtgctattccacctccgaaaggaaacgaaatactcggtgagtggaatccgaggtgaggtttaggatgtcgtcttggtagagcaagcctcacttgtggtgttcttttggtgttcaagttggggatcttagtggtcacttgaaaccaaagagaagtacctaggggtgttggcttgaagaccagagacctcttcctaggccttttcttggtgaggtaaggggttaatcaagacccggctctttggagctcctcaacggagacgtaggattctcggtggagaatccaaacttcgggaaacaatcgtttgtctcctctcactctctttatctttgtaattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgatttaatttacttgttgtgaggtgcttgaaatagcaattcacaactgctaggaagttcctaggaagaacctcggaagttccgggtagctttctctgcttgtgagaaaaagctgccaggaagttccggaccttttgccatgaagttctgggccctgattttaaccgctgtgatttgaattaaattttaggagcgcctattcacccccctctaggcgacatcaaggccgtttcaattggtatcagagcctaatctccggattggcttaaccgcttggagagaagatgttgggggatggcgagaaaagtgtgaagggtaacatggttgatagtcaagatgctacaatgtcaacacgaggtgaaactttccttgaacttctcatgctagatggttcaaattacatgtcttggagtactcgcatgctttatgtgtttagggtcatgggacctcaaatatagcgagttgtagatgtgagcatttctcctcctagtgatcaaatgatatcatttgaagcataatagaaatgcatacatctcaatgctcaagctactaatattttgtttagtgctttgagtgaagatgtgttctaatccatcatgccacttgaggatgctcatctcatttggaacacactcgaggagagatatgacaagtccgagtgtgatgaggcaaagctcgctatagaagaaccacttgtggagtgctcaaattcatcgacaatttgtaaagagcctcaagtgattctatccaatgagcaagatagtcttgccacattcacctcctcaccaacacatgtctccattaaaggtaatgaaatggtgagtagcgtcaatgtggatacttctacttcctatagtgcttgtcgaactaatcttttgaaggtagaagtatgtgggaaaaaatggccaagtgaagaatttacatctccaagatgctcatcttcacacttggatgaatattcttgcatcatggagaaatcatatttggagaaagaaaatctagagcttaaagctcaacttgtggagctcactagcaagcatgtggacctacaagaaaaatatgatgagcttttgtgctctcatggaaatcttgtggattcacatgccatgctagaagtaactcatgaggtgatcataataacggtaaaatcctatgtgcctcatgttcaagttgactttacatgtgctaactcttgttgctctcaagcaaatatttttctgcgcactacatgtgacttggattatgtagggaaaaaggataaatacatcgatcatggatttgtttgcaatgctcaaccttctcaagataaccgtgaaagcatgctgaagaagcttgagaagggatcaaccgtagcttgcaccaagttctatcaagaagataacaagtccaacaacaagagcaaggggcaagatcaaagcaagaacaaagcttccattacttgcttcaagtgcaagaaaatgggacatcatgtgagagattgcccttggaagaaacagaagaagttgagcaagaatgaggatcttgctcacagttcttcaaatccaccaaagagggacactttgcctcaagttgtccttgcaagattgatgatgaagccacacttccaagaaagacatcaagaatcaacagaaggaagtgctacggttgcattgagaaggggcatgaaattggattttgtccgcacaagaaggatgatcatagcaatcgatcaagcaagaggcaaaccggcaacaagcaagtcaagaagcaagataaaagcaaaactcaactttgctacaattgccgggcaaagggacatattggtaaaaattgtcccattggtaaaattcctaagccaaacctctcatttcatcacaatttgcttaggaaggccaaaaatggcacttgtgctactagggtgattagttcgctacatgctagcacaaaggccatttgggtccctaaatctcttgtgactaacatccatggacccaacgtgatttgggtaccaaaatatgcttagattgtcaattaggtacttggaggtgcattggaggctcaactcatccttgaagaactaactttgtgcaatgagcaaaaaatggaatcaaggatgtgaataattgttctacattaagaaccaatgtcatctcggtaacaagtatttacattgaaatttctatatcctaaccttgtgtaggttattacttgtgtataatgtctatcctttaatggtgcttaattgattggcaaatttgatcttgagtaatgttttggttatctcatttagggggagtgttataacttctcatatcatttgcatcccttaaatgtgttttgattaaattgatgctataatagtcttcaaaattctattttggttaaaaagtaaaaatctataaagttagttgtgaaaacttggttttgtttgttcaaaagggttccttcacctaattgagaggtattttaaaagttgattcaaacaaaaatgagttttggcaagaaaattgtcacgaccggaattaacccaatgggcgttccttacgtgcgtgtattattccttgtcccaggaggcaaggtacaccaaaagttgatacatttcagagtttatcaagcggaagcgtaaatagttaaattattacatgggcagcgaaggcccagcacacacaaagacaaacgagaagcagcggaagactagggcgacgaccacatgcgcttgacggctggcacgagctagacaccaaagccttcatcttctaggggctcctcttctgggtttgggaaaaattgagcaagactgagtacaaccaccgtactcaacaagacacacccacaagtacagaataaatgcaagggagtacaaaggagttatactataaagggttagggttgcagtaaacagcatttaaagatatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacgaacgga

SEQ ID NO: 61431 - DNA, 6968 bp, Oryza sativa
agcacagacgctgcggacctgaagcgtccctgcggccttgaccagactgcgcagctggcgtaggaggacggggcacacgggtcccttgctggctctgctgttgctgcggctgtgggacgcgcaccacgaattgaggtcggggcgcggagcgaggttgttgctgctgttgctgctgcgaggacgatccccctggatagggattggtgtagcggaccctttggttagcaccctgttgattgcggacattcgccaagcggcgcttgtgcgactccagttccttgtgcttggcttccaagcggatgctcttgtccaccagacgttggaaatccggatagtcaccggagactagacggacggacagctcagggtccattcctgccaagaacttctcctgcttttcctcatcttcccgcacatcctccagggcgtaacgggccaggttgttgaactcatgcaaatactccatcacggagcggttgccttgcttcaactctcggaattcccttttcttaagggccacgactccggcgggcacatgggttctccggaaagcggcggtgaagcgagcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttattggagctagagaaggttggtggacggatgcggaggaactcggcgagtttacagtgttgtgggggtggtggaggagcattctgttgtggcggattttggaggtggtggaggaaagcagtcatcatgttggcctgctgggcgaggatttgggtgagaatagcgttggtgtctggtggtggtggtggaggcggaggaggaggtggaggtggactgccatggttgttgtggttgctgccttcgggttggttgccatcaccggtattagcacttctcctggtcgtcaccatctgaaaaccccacacaggaccagcaaacagagagagctgacaattaaagctaaccacccacgactaccataattcttgaatttattactgctattaaattagttcattaaagttcaagttgcttaagcaaataaaataaagacaggctccgacacagttataccacacaccggcataaccatgccccacacgactccaacaagaagacaaacgagaaagaatacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctagttccttcttcagctgcagattctcttgacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgaagtcgcgggctcctccgcggcgagggtggtagcggtagggcgagtgctgcaactcgtccgggtagcgctggtgaagagtgccgatggcgaggagagcggcgttctggcaagcggcggggaaagaatctccacccgcggtgactgccaacgaagtccgctcgggagagccagtgaggatcactgcagtaacctcccaagcagcgtggggctctgcatcgtcaccctcctgctccggaagcggcctgccctggtagtccactccatgtggataccccaggacaacgcacatgccccgcagctccaagacgaaaccagtcaggtccagaccacgacggctgatgctgccggccatctacaaacaaaaacaaaaagaaaaacaacattttaaaggtcagattttggcgataaatgaagcaacaggacagagagagactagaggattttcacaaataagacaggatttttttttatttttgaaaatattgctaaggcttgggatctacggctcgtcctagggtcaaaggtggctctgataccacttgtcacgaccggaaataacccaacgggcgttccttacgtgcgtgtattattccttgtcccaggaggcaaggtacaccaaaagttgatacaattcagagtttaacaagcggaagcgtaaatagttaatttattacatgggcagcgaaggcccagcacacacaaagacaaacgagaaacagtggaagactagggcgacgaccacaggcgcttgacggcagacacgagctagacaccaaagccttcatcctccaggaactcctcttctgggtttgggaaaaaattgagcaagactgagtacaaccaccgtactcaacaagacacacccacaagtgcagaataaatgcaagggagtacaaaggagttatactataaagggttagggttgcagtaaacagcatttaaagacacttggttgcgcaaagctattttgtaaacacgattctagaactatacaatattatttatcaaggccgtgaacccacatgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggctggaaccctcgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaactattttggggattttgaatagaaggagcggtgtgaagccaattccacaataaccaaaccattccatagtgtccaggtgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaaggttatatgctctttaaatgaatatttgtgaatttcttcatttaaattttaatttaaaattggatttattgcgtcagccgaggggaggggcgcgcggaccgggtccacaggagtggggcccacgcggcagcctcacggtccacggtggaccgggtgcacccggctcacaccggccggcgccgtgggtcccatgcgtcagccgcatccgagggcgcgggcggctaacggccgggccccacatggcagccgcgggacgcgcccgaaggcggccacgccggcacagccgacgggaggtggcgcactcgtgccccgatggtcgccgccggcgaccaccggcgcggcggagcggcgcccgagagaggggagggaagggggaaacgaatcggcggtccacggctcaccccgggtcgacggcgacgacgggtacgacgaccggagcggagagaggcggcggcgcggctcgggtcgacgggcacggcggcgttccggcagtcggcgaccgaaacggagaggtggacgaggtcggcgaggttgcggcgaacccgaagaaggcgacgccgaagcgggagaaggtccggggcgacgacggcggcggaccggagctcggcggtgacggcggagagagagagcgacggcgcgagcttgattccggcggagagagagagcggcgagtggcggaaacggcggagggaggcacggggagtgtttatatagggttgggagggggagagagcggccggatgagggggaaacgggcgcggaagatccggccgccattgatgcgtcggcgaggttagggggaaagtttccgaacgaatccgagggagagagggagggaaaaatgggggggaaagagggagggaatcacggggaatatttcccccctcttgattgcacgcgggacggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcgcgcgcgcggggaggaggccgaatgggccgcggggaagaggggagagagggaaagggatgggccgagccggcccaagagggagagggggagggaaagggatctttttagggtttttctttttataaaaccattttaactttgtttatttcttcttaaatattatttgtgctctgaaaattccactaaaatttatttacgcattttaggcttttaggaaatataaaaaaaatcctccaagccttatttgacttttaactttgcacattttaattgttggaggctttcacaaggattttaattattctaggcataatttcaaggatgtattttagagtcgttttgggacgcgacaaaaatgattttagcctctaaatctagatgctaagatcttgtttttgcttttaaagtgtgtttatgtcaaaatgtatctgaaaaggtttttgcaaataatccttttgacaagccactagagttggtcatttcaaatctttttggtatttatatctattttatatgataaatgatttgaaattatttgatctcaaaattcacatgaaaatttatattgaccatatttggtcctattatagcatcgagtgagtttagccactagaaccatatattgtgatttatattggttcatggacgtatttcaaactcataaaaatcaaattgtctccaaaacatctcattttgctcaaaattgcatttgggtcattttgttggaacttcaactttttatctttcttcgagcaaggaattaaacatgaatcctttaaaagtgattttattgatgctaggtcaattgtgaacgaacatatggtgatcctcaaacaaatccctcacacgagcaccatggattttgatggttttccaaaaactcggtttttacctttggttttccaagttctttaaatttggtgatgaaatattaaatattttggttatttcttgtttcatctgatttcccatgttgttgtgagctcgtggttcaaatttcgtgaaattccgagtttgtttgggtgattttgagcaaaatcttgaaagttctcgcgtgctgattttgtctgctaggaagttccagacaaagtacaaggaacttccggtcaggactctctgtggagacaaagagggccgataggaacttccggacaaattggtaggaagttccggtccaacttgcctcaaaacattgttttaaaatattggtttaaccttaaagtttgttttggcccaaaaacgtttagctcaagcttccaaaatttaaaagttcaaaagtttagatgacatgttttctaaaagggtctcttttggtaaaaattcaaaattcttatttgacggtccaaaatttgtgaaaaatgtttcaaagggcttcatcttttatttcaaatgttctaaaaagcttttggagtgaaatttttgtttttggaacaaaatgtcatttatccaacatgttgttttgatcatatttggtctatatttgcatatggtgggtttaagcaatttgattaatgttctttgtgaacattggctcaatttggtatttctaacccatcttaagtctttccaaatgtcaaacttcataaaaaatcttttggttgaaattcattgttttaaaagtcattctctttatcgaaaactcatttagtgaaattaattttggagaagtttctctcaagttcaaagatcttttttgcaagcttgaattatttcagactttttctctcttttctcaacttgtagaaattttcagtaaaacttgactttgagctaatttgtgatctttatatctcaaaatgggttgtgttgttgtgatttggaaagagcttacattgtgactttcgattctctatagttggacttcactgccaaattttgtctaaattatcaaag

SEQ ID NO: 61432 - DNA, 5439 bp, Oryza sativa
  unsure (1)..(5439): unsure at all n locations
aactaactatttccatgagttggtgagattaggttaagttccgccatcaagttaaaagattgaagttagaagatggacattataccttgatgaggagcaagtgaagacattgatgatgcggggtatgaaatggctatctatggcaaaccggtgaagaaaaagaaaggctcggctagaagatggacattataccttaatgaggaataagtgaagacattgatgatgcggagtatgaagtggctatttatggcaaaacggtgaagggcaagcaaggctcggctacaatggaccatgcgtggggtgaagggcaagcaagaggcttggcaccgattcaccgaatccggtggtgaaggacgagtgaaggctttgtcatgatggtcatgatggactgtgcgaggccatttgaagctatgagtaatccgtatcaattagaccgcaagatggaatgccgaggatcaagaggatgtggttcttcgatgaacatcaagtcaaaatccaaagtgggcattgatcaaggcaaaggtataattgatttgggactaatatgcttaagtgtaggtgagaatagtcccaatagtgaaatggcgttgacgttgacaaccctcaaggtgaagcaagaagataacattcttagtggtgtattagtcccaggttgcttaggagtgggctaggatgcttggagaccccccaaaacaaagcggcaagaagacttggagccgagttagactagtttactttttcgctttgagtttaggaaaaaccgtactattaagaggggttccaagtgtggttctgagataacacaagtgctcttagtggtgtccaagtgttgaaatatttttaggagctgtttttgaaaatggctctactcgggacagagagtcccacccggaggttctgtccggaacttcctggcaccgaggtgaggttgaaaaatttcataagtgctgcccggatgttcctggcacttttacccggaacctcctggcaggtttccagttcaaacttgtgagtaacggctagatgacgtcacctagccgttatatatatggatctcgtccccaggtcaccctttggccattccactttagttcttgtgttccctagcttgttctagcctctcccaatgtgattttgcttcctccacccaaatcttgtgtacttcttgagtgagagagtgattttgagggtggtggtgaggattggagaaggttttgaacgctaggatgacttgagcacttggggtatctcgttgggctattatttgaagcttgttactcttggagggtgacctcctagatggttaggtgtcgcccgcgagtttccaacaaggttgtgaattgacccgggcaaatttgtgagggcgttattccacctccaaaaggaaacggaaaactcggtgagtggaatccgaggtgaggtttaggatgtcatcttggtagagcaagcctcacttgtggtgttcttttggcgttgaattacgggactttagcgctcactacaaaccaaaaagaaggccctgggggtgtcggctannncccacatacctattcctaggccgtttccttgatgaggcaaggggttaatcaagaccccgctctttggagctactggtcggggacctaagaatatagacggatactactaactctggaaaacatatattttgtctcctctcactctctttatctttgtgattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgataagtacgataagtccaaccattgcccatgctggcttgtggtaagtacgataagttcttctagggcataccgcgaaccggtccttaattgccatgggtgcgactagcaaaaccatgcacccacagcccaccattcagtcgcattttagttggataattacgaccatgaagcatggctagatgtctcgagcacgcagctcattctgatactaaaaaggtctaatactgtaattatcccatcaactgagctagtggtaattaagcatggctaagcatataattctagctaggtcacataagtaacatgagctagtcgatttattacccagggttgacaaaggacagatatcaagtaaacatggcacaagcaagcagataggtaatacccggatcccatgtaattagcaagacatgtatgtttatttgcaaatggtcaaacatttataaattgggatcaacatgctcaaggggaatgtgtgacttgccttgcttcttcaaaacaatcttccgaactcttttcctcgcgaccgtggacttccgaaacgacggattctacacgctagcacgcaaaacgaggaaaaactctaataaaaaccaaggaaacagtacataaaaagtaaacaaacatgtagatctcaattttagatgaattttgcaagttgaatggcccaattcggagttcgaatgaattagatatgaattttagaagttttgagccatttaaatgaatttctagaactaaatacaatttattgtgcaattattatttatttttacaaaggaaaaggggactgctgccgtcagcaaggggtgaggcgcggaccgcgtccacgaaggggcgggccccatacgtcagcgacacaaggggtaccggcccaccgtggaccgagtccacggtggcgaccggccactcggccgcgcacccaatggcccggatcggccgagaccgctcggacggccgagtggcacggccaggcaggaatgcacacaggcggcagcgaccgccaagcccagaccaccggcgacgacgccagcgacgagcggcgacggcatgagaggcggcgaaagagaggatggggaggggatgctcaccaagcggcacggcaccggagagaggcgagatggtgacggcgctcctcgggcttgcggtggaggggttaactggcgccgattttcatggggagagtgggggaaatgggtgcggggtggatgtggtctttcggtagtggattggggaagatgagcgatggacggggtgtgacaacgcgcggcgaggccggcggcgcaaacggcgcggcacggggacggcggcagcggcggcagcggccgactggagggtcgccggcgagcggcagcgcttgggctcgtgtgaggagagcgggagagagcgcagggagctcgggaaaaatgaggaaatgggagaggaggactcggggatcatttttatagcgcggggagctcgagatcgaggacgggaggggcggatttgaaggaggaatgggtgccggcgacgtgggcgaggtggagctcgaattggcacaaaaatttggggaaaaatgggggagaggatggaggagtgggcggcaaccacgtccgcacggtcggacgtgcgcgcgggaggcaggaggtggcagttttagcggtgacgtggggcgacccgggtttccatgcggttgccggcggagaggctggaggaagggggaggagctgacaggtggggcctcaggtccacctgtcggtgagggaaggagagaggaggccgggaaggggttatgcagacttagggggagacggggggccgagctgggccggcccacgagaaggaagggggaaatgagggagggcgagcggaccaaggggaggaggagggggattgggccagggcggttcaaaaacaaagagggggaatttttattgcttttatttttattttaattgatgatatgaactttgtgactttaaaattaactattgagcttcgaaaattcgcgggaaatttcagagagtatttagggcacaaagaatattacaaaatattctcggccaatgatttttaagggaaaattttaatttcccccataatttcacttgattaaattgctttaacttttatttaatttctagaaaatcgggggcgttacaaatctaccccccttacaggaatctcgtcccaagattttgggatggctagaaagaaagctggtgctggcgggctgtctgactgatctgctgacacatgctgcctctttctgattcaactgactgattgctcgatgaaccaaacctgcataagcttgctgttctgttgcttcccatacactgaatagaccgactccgattagtctgaccttgaccaaaattgctagtgctcatagaatttcttttctttggactgaaccactagcattgtctcccttagtaacctgtgagctcaccaagcatactagaaacttgcaaagctttcatgaaaccttgtatgtggacttgcatgaatgacagattctgactttattttaacctacttctgacgggaaccacaggtatcctaagaggctgcttgattggtctttcggctgaactgcaactgttcttggcactgcttgcctaagctgaacagttgacttggcctcacgggtttaccctggaatccaatcagataacctgagaccggtgtaattctgttgacgccctataattggcttcttcaaatattacccaaatggctgcactgagttgaacctccaaatgaaacgacgacgaggtgagccaacactcatctctgagacctaccccccttacagagagtagtcttactttcgcctgactgggatcaattgaactgttgtctttgaaatgtaaccaacacttttccgatttacaaagagccctggctttgaaaactgaaaacttcatcgatcaatcaaaatagagcaatgacgatgcactttcattctagcaagacttggaacttaacccttagctgaggataggaaagtccacataaaagagactctcacttagctcatgaacatattgactcttgactaactttcccatcagttctaactgctggcttgattgtcctgcttctggcctgacttcggtgtcgagttgcatagttgatttctgaaaactaacctgaccgactctgcattggaactgatgtaacttgaggagctcgagatcgaggccgggaggggcggatctgatggaggaatgggtgccggcgatgtgggcgaggtggagctcgaatcggagcgaaaatttggggaaaaatgggggagagggtggaggagtgggcggcgaccacgtccgcacggtcggatgtgcgcgcgggaggcaggaggcggcagttttagcggcgacgtggggcgacccgggttgccatggcggttgccggcggagtggctggaggaagggggaggagctgacaggtggggcctcgggtccacctgtcggtgagggaaggagagaggaggccaggaaggggttatgcagacttagggggagagggggggccgagctgggccggcccacgagaaggaagggggaaaggagggagggcgagcgggccaaggggcggaggagggggattgggcc

SEQ ID NO: 61433 - DNA, 8046 bp, Oryza sativa
acgagtggaacgacggcgaagcacggctggagcgacggcgacgacaacggcacaaggtctcacggcgctagggcgcttccgacggcgagagacgaaggcaagggtggccacgggtagcggcggacttggggatccttttataggggcaagaaggcggtggcgaaggcccatggcgaccggcgacgagaaggaaaggttagggttcggaggagagagaccgatccgaatcgacctcgaatccacggatttccaaacgaaattagccgatgattccaaaagagaaaaggtggaggagatcccggagatcatttcccctctattgatttcaccggagaaggaaaaggcgcggccgaacttggaaggagacggcggcggcgcggcgctagggttcgggcggtggtggcggcgcgaggaagacgaagattgacaggtgggacccacctgtcagcgacagcgagcgcgcgcgcgcggacggctgcggactgggccgacttgggccgggggaaagagagaggaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaaacaaagtatttaatgaaattttatctggccccattttatattggaatttattaattaaaattaaatcttctcttctagccttttaaaaataattccaattaaacaacaatttatatatttaggatttttagggtgtgacacgtacgctcgacgggggattcatttgctgaatggcatcgattttctcggggttcgcctcaatgcccctttcagaaacaaggaaacccaacaacttgccgcgcgaacaccaaaaacacacttatcaggatttagtgtcatacccgccgcgcgtaagttgtcgaaggtctcctacaggtcggacacatggtcgaaagccttgcggctttttacaacgatatcgtcgacataaccctctacatttcaccccaactgcttgtaaaggaccttgtacacctgcctggcgaaggttgccccggcattcctcaggccgaaaggcatcctgaggtggcaaaaggtgccgaatggtgtgatgaaggatgtcttggggatgtcggccgggttcatgtggatctggtggtaaccggagtacgcatccaagaagctcatgagttcgtagccagctgtcgaatccacgagttggtcgatccgtggcaaggggaaatcatccttcggccatgccttgtttaggtttgtgaaatcgacgcacatgcgatatttgtcgtttgatttccgcaccagcaccggattcgccagccactcggggtggtcgatctcttgaatgaccctagccttgagcaatttttggacttcggcttttgctgcttcttggagatcaacggacatcttgcgtagcttctgtttccttggcttggcatccggcatgactgccaggtgatgcatgatgagatctgtcgaaacacttcccacctcatcagggccccaggcgaagttatcaatgtttttcttgagcacctctaggatgttctcaacctcttcttcgcccatgtcgccccccagcgatacaagctttgtgggatcggtatcatcaatctgtatcttgattaccttgccgtgaggggcgggctttggcgcgtgcttcgccggatcatgtggttcggcctcaacattatgcacagctctgttgattatggccaaatcgccctttgaagcggccgaaggctggagccccttgaccacgatcactcctaccgggccaggcatcttgagcttgagataattgtggtgggaaatggcttcgaacttattgaaggtcgcacagccgaagatggcattgtagttgtacgggatgtcgacaacgtcaaacattattttctcttcgcgtctgtttttgcctgtgccgaaagctaccagcaattgcgcttggcctagaacttggactgactcaccgccgaaaccacggagcgatgccgatgcttgggtaagggctagggtcggtaatcccatcttggcatatgctccagcgaagatgacatcggccgaactccctccgtcgactaagattcgttggacctcgaagccagctatctcggccgagatcaccagagggtcttgatgcgggaacattactccttcggcatcttccggcccgaaagagatttgctggttcagatattgtggggccccttcgcccgccgaagtgatgttgtggaccatttgatgctgcatcttcttttgtcatttcgacagctgattcggcgggtcggcccttgtaatcacttggattactcgacgctgcacatcttggcgctgttcggccgggggtgcttgttcttgaacgtcttcgcgaggtgcttcgacagctgctccctgctgcggccttggatcttgcacgttgccacgctgccgaatgtttcagcattgctccgtggtgtgcaaagagcgtccgtggaaggcgtagtaaaggtctttttggaccttcttgcgaacgggctgctgatggttgcttgcttgctgggaatcgaactccttgcggagggcttgaacttcttcgacagccatcacagccttgcccgcacggtcggttctgaacttcctccaagttatgggagcttggccttgccttggcggttatccttggttcgccggctgaggctggcgaacagcgagaggaggtggttcggcgacctgagcttgtacttgggctttggcagcggcgatggaggctttatcatactcagcttgaattgcttgccatcgcttggaatcctcttcgccccatgcgtacacgtcaatgatgcgaagcaggtgttcaagcgtctgcggctctttgttggcgattttttttgtgagttcgccctcgagtatcccggccgaagcggcattgatgacagacgcctcggttatgtcttgtacttgacaccgggcttgcaagaagcgacgcatgtactcccttatcgattctcccgacctctggcgaatgccgagtagatgttgctgcgtcttcggctcctcgtaggtgactcgaaagttaaggacaaagacatcgcgcaattgctcccatgagtagatgctattagctgctaaattgaggtaccaagaacgggcgatgctgtttagagcaagatgtattacctttgccttggtattttcgtcgccatgagccgcttcgatcgcagactcatagatagagaggaattcctttgggtcaatttcgcctgaatagcgtgggacgggtgggaacttgaactggggtgggattggacgggtcttgattcccccactcagcagtagccccttttcgccccctgccctgttcacggcaccttgctacggatacggtgtggcgaaaggcgaagtcacggcctgcgcgtgaggttgggccacggtgttcggctgcccagctccgattggtgatgcttggtgagctgccatggatgggtcgaatgttggctggggccatgccatggcggactggtttggtgcttggtttgccacgaagcctagtgttggtgcttgcggcggaacggttggtgcctgagcaatattgttgaagtcgaactacggtccttgactccaaggcaaagcccccagacccggctgattcgacgacaaccaactaggcgcaccatgacctgtactcccctccggctgggccgaaggggctatacctgaaatgctgtggggttggctaaattgttgaatgaaagcttgaagctgcgcttgcagagccgaagccccttctgccatcgcttgtgacacttggccaggcggttgagagtgtgcttgggtagtgaccggctgagcttgcagttgcacgtgagggcccggatgtactgctgcggtcgaaggctgcccagcgaagtatactagcgcttgcgtggcttgtggtggaaggggttggatcggtgcttgtggatagacttggggtgggatgtagcctgccgaatactggaggattggggccgaagcggccttggcccgcctcgctgcctcgtacgcctgctgctgttcttgcatctgccgaagcatgtcttggagtcatgtcatgttctgtcgcatggcttccatgtcggcttcggcttgtgtttcgggatcagggttgacttgtacagcggtgagcgcagtcgaggccgctgccagctgcgacggagcggcttggggcaccagcagtttgcttgtcgaaaggatctccgccctggtttggagtgcccttgccgccgctgccgccttcgctgcttcagccgtgttcggcacctgccccaacgaggcggcaggagccgaagacggtagtagcggcgctggtgccgaagccggtggcgctccgccatcttcggcgatgggcgccgaaggctctgctcccttttcggcggccatcccccctccggcttcgctttcctttcgccttgtaaccttctccttcacgactctcttcggtggcattcgctctcagtggtttcgcttggaggtctccacggtcggcgccagctgttttcgaaacgacaactgcatacgtcgaaagacgtggttactcaacagtggttggaaagaaagtaaagtgtattgaatggagaatttttcttgggatccccctattacatgaccctaggagaatatttatagcctcattacaagttcttgctactggggtttaggttatacaggggaatttacatggctgcccttatgaaagggacatttatgtgggtatacagtgtaattgaggtacatgggctcctaatggtccgtcaggcgatcgttggcccaaaggccactgggccttcgtgaggccgaacttgctatggcgaagtcgtctcccttcgacatacactcttcgccttacatccttcgcctaagaggtctttggctctacgaggcacccgcacgattctccgcccttcgccgtctttgctccatagtcttcgccatgggggcttcgccccaaccgatcttgacgtcttaggcttgaatccttactggtcgcatggtttcggcaggtttggtcgaagggcctcatgccatactgccaacaagtaccatgtttgtcttgatgaaatcctcagcatttctacctagcttcctaaatgtagcataaggcatcaaatttaacgcagccccaccatcgaccatcatcttagaaatcggcttcccattgacatagccgttcacatataatcccttaagatgccgattctctatcccttctggcttctcaaagactgcttgttctggtaataaaatcaatttagccgatttttcttcaactttatcaacatcggcttgtttgactccaaattcagcgggcaacgtgaaaaccatgttaaccgatgcagtcaccacactttttcctttagccaatctttttgcttcatcggctgtggcttcatcggctgcaggaacttgaatcttaacacgccactcctgctttggcttcgtcttctttagctgatgattgatttcttgctcaacttcctgaatgtcacgcccataaattcactagtaatttccgaactaatttgtgcataaaaccctcgtccaggaatcagccgaggtacacaaactgacaatttaatatacagattcatcaataatacaatgttacatacttaaaaaagaaaagaaaactgcagcggaattacggtctagcgaagctccggctccactccctcaggcagctcaactggggtataagccaaatgtcttctctatctggattctttttcttccactgaggtttgattgattattacaatgtgagcatatgacatactcaacaagtcacacagcaaatatgcaagtgcacaaggataccaagaatggcataatatagggctcatttgcaaaagcagcatttagcaaacattttagaattataaaacagtagagtaattaatcatcaattttaatcaacactgaacagcacacccatgctgctcaggcccaaccatcctgaacaaccatacccggctgtacagatctatctcaatccaggaatgtaccattctaaaccaggagctaatcaaattattaccagttatagcatcatttattatggtgagaagtgtgagactaatcacaaaagacattgttagacccgcccataacctcgggcacggctattcgactagttttactctggccagaggtgtaccactgtacccacaagacacagccccacaacatgtcaccatgcgcctcaataccaccacgatacctcggaaaggagctgtgacagtacccctcgcataacacaatccaccacagcgcaccgttcctggatcataatcacccccttataaacaaggcatggactccccagcgacccccgtgggcttatctccgccacttctcagtctggtccccgcaatgaaccatgctatacaaaaggtaaagccgttgccacgctggcttgtggttggcacggttaatgtttcacaaccaaaactcgtgaaccgatccttaattgtcatgagcacgaccatcaaaaccatgtgctcacaacccaccattatcaagttttagtcggcaaattaattaactaaccaatcacgattgaccatcgtgagctaccattaaatatccatcattaagtaatagtgaacattagttatcccaatcgtgtgctaatgtttctaagcatggctaagcaattatgtctaacatctagctgaaacaatatatagagctcaactagtcaaattgtaacccgaggtaatcaagaaatagggtaatcaatgcaaattggccataacaaaggaataggttcacaccacccggtgacattcgaatttaaatataggaccaacatgctcaaaggaattgtgtttgggatctgtgtgacttaccttgcaataatcggtcttcaattaatcttcttgaacacttccggcgcactcgcgaaccttcgaaacgacagaaactacatgctaacacgcaaaacgaggaaaaagactaagaaactccaaataaacagtacatataaagtaaacaaacatgtagatcatgattttagatttattatgagacttgaacggcctcattccgatttcatatgaattagttacgaattttacaagatttaattccaattaaacctattaaagaaaaagactattccacattaattaaacaatttacaaatgatttataactaagataaaagattggaaacaacctccgaaaaagattagattatatttggtagatgatatatattaaaaagaaataatatgccactaaaaagagggaacggatatatattggttttggacggctgagattaatcttgcaagcgaagctcaagagatactgactcaacgagtcaattctacgtgacatgggatcactcaaatgatcaaccgaaaccggcgaacggaaccggcggctctgaacggctctaaactaaaggacgacttaacatggacgaacgaacgaagcacggggaacacctcattaaaacgaacgagcgaacgactcaacaacggctgtgactaaaccggtgagctatacacgattcacagtaaagccccggtacagcaaacaataggccggtaggaattaagggatgcatctacggctagacaacttggctaccgagcaacggctaaagcggcggctaggttaaagcggcacacagctgcgacatggcggcactagggcgacttggttcggctaggcggcggtgactcggcggagtcacgcagttagggttagggcgatggcacagcgacgacgacgcacagctacggcagagcacgacagcaaggcgcagcagcggcagcgactcaacgacgacttagcgagacggctaccgagcggtagcaatggctctactaagccaggaacgcggcagcggtggcaacgcaacaccagcagcggtggcaatgtggcttggctggcaacagcaaagcggccggcgcagcagcatgactgaggcagggagcgacactaaggctttgatagtg

SEQ ID NO: 61434 - DNA, 676 bp, Oryza sativa
tgatcactttcagcattctccaacggaacaaggcattgtttagttccaaattttttcttcaaacttcaaaacttttccatcacatcaaaacttttctacccacataaacttttaacttttccatcacatcttccaatttcaactaaacttccaattttggcgtcaactaaacacacccaaagactgattaaaacaggtgtcatacccgaactgtgtttagttcacgctaaaattgaaagtttggttcaaattggaacaatgtgacggaaaagttggaagtttatgtgtgtaggaaagttttgatgtgattaaaacaggtgtcatacccgaactgtgtttagttcacgctaaaattgaaagttttgttcaaattggaacaatgtgacggaaaagttggaagtttatgtatgtaggaaagttttgatgtgatgaaaaagttggtagtttgaagaaaaactttggatctaaacacggcccaaatctgctagtagagcatagagatagattggtgaaaagagtactgtaaacaatgaacagggattcttgggaaaccagatctctccacaatattatgttatatacagctcatgaatggtccagagcagcagcagattacaaacgatgccagtacattttgacaggtccgggaaacaaagtgaagacattgaaatcaaag

SEQ ID NO: 61435 - DNA, 2873 bp, Oryza sativa
ccccctttgtaacaactttccagttgacaaccctcggttgtactgcactaagaagttcaaggaaaaaccgtccatttgataagctcttgtcctgagagaagataagaaaatttattaactggagttatctaacaacaaattaaaactaattaaacagaaattaataacaccttgaagctttccatttgagatgttcttcctgatgctttcactttgctgtttgcccattttagtatatcagcatcagtaatttcttttccttgggatccttgggagtgggatctcagtctattcaacaattgaagcatattaaatctcatcaattgccacagaagtgctgaaaaacaacagatatggcttcaattgtgtgctaaacagataacatcaatcagaaaccactaaaaagacttgattcagtcacactcaccaacaatcaatttcttgttaccctgaacaatatcattcccagctaaatttactaaggaaaactttaactcctttccgatttttaccacttgattgcaattctccaatttcctgaatggtagtttaattggaggtttcgaggccagcttccaattgacagatcctggagaaactttgtccagtacttcaagaagtacccatctgcatgagaaaggatgtaagtgcccaattcatttggagacagacacaaatgctcattcaaataatctcatacccatggcgaacatcttcaaaaacattgttcacgtaagagtcaaccccaagactgttgatccacatccgaaaggacctttcttctctcgataatagaacatcatcacgtgatgcagtctgattgagagtaacttgtctggtgtcactagttagaccattcctgtgcatcatggaacaatagcattcaagtgataagcagatgaccaattcatgggcagctagctaagaaacttttaaagtgaatatacttgcacatggggaaaataccttagctagctttatgataaaaaaaagaaaagttaatgcctttggagaaacaagaaacatactacttaccgatgctggaatatttgtgccacaaatgcaagattcaaattggcagaaccctcagtgatatccttaggagtcaagtatcttttgcaatccaacttctctgcttgttcaagtaccaatttagccctctcactaggatcctttgtctctaatgtggtttcaggggaatgctctggagcaagagcttttagaaggtaagcatatgcttcaccatcctgtacagaactaacgtatgtgaacattggagattgaagtaatattaattaaatgaatgtagtttgattcacttttcccacatacgcatttagaaaggggatttccagcataagagtgagtcataaataattttcaaagccatctgttgcttagtcaatcaacccaaatgcaaagatgttgcaagccaaacagtggattagcacaagggcagcttcttttatcaaactgcacataatcaattaattataatgtcactttgttctatgtcatatgcaccttcacatctgtagagaaattgctgacggttttcttgaagccagcttttttcagatgatggttcatccaccgaagtagcatcttttctggtgacaagctcaacacttcatctatatcctgcataataatcagtaaaatgaattttgttctaagaacatgtgaattaaattaatagaaggacagaatgtttatttaccttgctgtcatcaaacaattccaccagctggggtgtcttcttgagattcagatcagccaaaagttgaatctgatgataagtgcaaaaagatctttatatgatgaggcaggagtttaaccatagtatgtcaaacatcaaaatgcaaaactcagtgcaacatttacctttatgatttgagatatcaatccaagaattaaatgaggctgcaaaaaagaagcatgttaaccacaacttaacttttagtgaatttcttgaattaaatagaagaagtcacaaagggaaggcggctgaaaacatctgacacatggacaagcatatcaaagaataacacatacagcaaatgagcaaggaaatatgaggtggaaccaattagcaggttatacagcgaaggataaaatggtatgcagcaaattagtggtgacaatgactaattgacagcatactttgtacccaaactacctagcacctacagggcattaaagtatttcaatgtagtcctgaatgaaaattagtggtaaaaataatttgcatagactacaatgcaccatgaattactaaaaagaatttaaagtagggaatgcgttgcatacccttccctccaccaaatcttgtgtaccaatgtttacaactgtacatccaatggccttggcagagttgaggcacagggtgtgattttcattcctctcccatgggttaagaactcttttcttatttattgctctctcatcaatggtcccaggtacagctaaattgatcaatttactgagcaaatgatccataaatgagcaaatatcagctatgactcaagggcagtttctgttcaacgagtaaatggatatgcaccctttggttagctgtaaagaccatctctcaccatagcataacaccgtccctgacaagatcgaacagctggttgtcggtaggctcgattggtaaatacttcttcagaaacgggtcttcacgaaggtaggtgttgatgtgcgccacataagacgacttctccgcctggttgagattgtgcagcaatgtagtggtactggatttgaggaaagatgacgcggttttgccacccccgccaccaccacgtgcgcattttttggcgctcacccttgactgcagattcaggtattcctacaaacgcaccacacataat

SEQ ID NO: 61436 - DNA, 2088 bp, Oryza sativa
acccactatttaagtcttggtctctggttgccacgaatattatatactcacagctatgtttttaatgggattttagtataggaattctcattggtttctgtctttgagtatgtattagggagtaaatttattgatttgtgtatgtaaagtaatgtctatggcctatgggtatatgtctttcgtgtaattgcagagagaagcacacaaaatgggaaatttgtaagggaagcgtcagatacagtcccagtgtttacaagaaatgcagctgcgttgctctgaactcaaacaggcagttcgatcgaaacaggaccctgacagagtgacagaagctcaaacacgcacactgacataacacatagcataacatcaacttgaactgacaaagcgtacgtctaacacggcgttaacacagcaaacaaccgggacagacagggcaacaatatacaaaagaaccctagggtgaatcaaaccaaaaaaaaaaatgagtggataagacgcaaacgagacgaaaaaaaaaatgtccacttctgctcccaacggtgacgacagtaacacacagcatgaatgccggccggccggcgcctcacccttctactcggcgaccaccaccggaaaaacggctcagctgatcattagctcaacgccggccactctcggcgtatgtcgaaggtgtagttgatctccaggtaacatttccggtcgtcgtcgaggaactgcaagaataaattaacaacacattgctgagcgactgaaccttgcaggtttcctgaagcagctgatatctgacaaagaaaattcgcgtcatgcgtaccttcgtcctggccgagtaggatcccctcgcaaacatgccggacggcgtggtctcctccggcgtcacgtacgtgtacggctccggctgggggctgaacgtgccgagcatctccttgtggctgtcaactgcacgccccaacgggaggaaccaaaaccatgagtgcgtttgcacaaattcaaacgcgctaaatccatcggattttataaaattttagtagtaattaattgttcatctattggagacctaattaaatgtttttcgtgtttgggtatacctttgatgccggtcttccagacggcattggtgtagcggaggccggagacgatgttgttgctgacggagaaggtgaacttgagcttgtagagggagccctccttgagggtgaaccagacgcccttggcgttgggctccaccggcagcggcaggaaaatgtccggccggccgggcgagaggatggccaggctcatgatcttcacgtcaggctccaacgtctctgcaccgataaaatcaagcgtgacaggttcagacttcagacctcattattgggtcagttctttttgggacattattgcatcctaatggccaggacgtgtaggccaaatgattggccgtagttttgagtttaaaattctaatggaagacaagcagatgccgaatgaatgatcatcctaaaaccgaccgtgaagcagctagccatcatcctcggattatttggttaaacaaccacaaccatatgaatcatggtttattcaacactagtctaaaaagcatagacaaaaagccaaggttcgctagaattatgcgatgcaaaaatgtgtctttttaggccactattcaaaatccatttgatcttaaaagcaccaacaccctagcatataaactaacaacagaaatgcactgttccccagtattaagatcagaaggcattgtcaatgtcatgatcagatgaaagcattagttcaagcttcaattaggagcccggaccagattcattatcagacaagccgaacatgcacggcaaagtacaggagttattaacaggaccatctaaccggtgcattgaaaacgccggacccgtccagccaagcccaacatatttcactttttcttttgctgttctaccgtattttctacgtacaaatcacaaatgtacggagtagaatgcaacacggagctcacgggggcggtgcatgcatggatgaatactatagacgatggatgaatctagtcgtggcccatagaacgggggctaagcacggacaggtacacaggtgcat

SEQ ID NO: 61437 - DNA, 1775 bp, Oryza sativa
aactttacatccttatgcactctaggcgtcatacgtttctaacagtgagaggagttctggcgctcccgggaagggaaaaacacacacactcctacgttgcttcttgttgttgaacccagtccatcatgattgttctcttatgggtatcctcatgtagtattgccaagccagcctctgaccatccgaaacgggcatccgccatccacctggccatccgaaccgggcatccgccagcagactgcttgccacatcacacacctaaaagaagaccactacgcatggatactgcctccgctcagctatctactccactaggtctatacccatatgagaagtgcggttgtacgggggtcgtttcatgcttaacttcatggctcggtccttaattgaccagggacagcactagcattttccggataccacccaaatcctccagccaccctagtcgaaaacagttctttaactttattttcctttcacaaatcatgccaccaatatcatggcaatgtggcgctcatgtctccacatgccacatctcaattaccttcccaaaggtaattgcccaagcatatagcatttgataaatatgagtatgcatgattctagaatagcatttctaagcaattgtcataattgactagagacttatacgtaaacatggtaaacaataattaaggcatggcataatcacaagtaggatgttcatcattgcatgcaattttatttgtaaacaaaataatttcgcaattgggatcaacatgttcaaagaatagtaatgacttgccttgctcaaagtcttgcggatctcgaccttcgcttggatccgcaactccctcgggctctataattacgtgcgaaggaataatttgaattcaattagaatccaaatgaaatccaaataattcacacaaacatcgaacgcgaaacaccctttctaaattgacaacaaagttcgcggaatcgctcaattcgaattgttgggtcattttaacctaagtcattttgtgatttgaaattacgtcctaagaattcatctaattgtttagttcttaattacatttaaattactaccgcgaattgattacttaaagagattaccaaaaataatctataagaattcatctaattgtttagttattaattacatctaaattactaccgcgaattgatttcttatagaaattagaatagtctataataatctatgattatagtattattttgcaaatactacactttagttaatcctataattaattcctaatattttaaatatcctaaatctcctcctaatttcctatttattttccttttctttttctccctttctttttctttttccttcctttctttttcttttctttttccttttttctctcttctctcttttctctctcccggctcctttctcccttcctctcttcttttctctttctccctccctctctcttggctttttgccctcccggcggcgatggcggtggacgcaagggggggaaaggcggcggcttaccgacagcggcggtcggcggcgacgacggtgacggcggcgcaagccccgacgcggcacacggcgtggtgcggcggcaccgagggcggcccggcggcacgaaggcagcggcgcggcggcacaaagacggcggcgtggcggcacgagaacgacggcgcggtggtgagggtagaggggaggaggagggaatggagtggggagaatggggaaggtggggtttttataggggagagagggggaaaagggagagaaggagggggggtga

SEQ ID NO: 61438 - DNA, 4585 bp, Oryza sativa
aaatatgtatgcggagtgttccagggttttggcatggaaatactatgaactttggaatagtagtatggcagtcaatcatggtggtttttgcagcacgtggagtcccatatctatttggctccttccttgggtagccgtcaccccgctctcccccgagatgcagagttgcccaatgatgccgcgccggggcccgaaaccggtggagacgcaaacgcgggaggtggcggtggcggcccccggcagccgaagtcgccagcgatccatcatgatgtcgcgcccgcgaccgcgcgacagcatcacccagacacacaccccgtattccccgttccggctgccaccgctcgggggcacgtcccgcgccgcgccgcgcacgtccctgccactcactcccgttccgagagaccgccgtgcccaagtgccaacccaccgcgggcggggcatggtgattctcgccgtggttttcccaaccgtctacgcggcgcggtggcgtccgtggcgtgcggcctcttttccagtcacgagcggtaaaaagtggcgcggctttgccgaaaaggccccagccgcttggcttgcctgccgcccgctcagctcccgcgtcccgaccggagacgacacgagggcgggtcaaggcgaccagacgaatcggcgcctctgatgaatcgcgctatgctttcctctgcgctgattctacagtgaaacctgcatcgatgccacgtctccgtgccaaacctcgccgtgtcttcggcgtggtttagttcccaactttttcttcaaacttctaacttttttatcacatcgaaacttttctacacatataaacttctaacttttccatcacatcattctaattttaaccaaacttttaattttagcatgaactaaacacacccttctagctctagatgattatggtgcgcgctcattgcagcctgatgccactgctgggcatggcaaagcgaaatgaccgacgagatgcttattatacgttggatctgtcctcaggatcagcacatgactggtaaggttagtttggtgctaccgtggtggtggcccattaaccacgttttcaagaccagacagtgcttgctttaaaaatactcttagccactgaaaccattagcttagttttgacttctacacttgacgccctcggtttatttcccaggtttaggacttagccgacacaaaaacgtttggcaatatcgatctatcaaacaaggatacaattcagatgagtttataccaaaaatattctatttttgatgcaaaaatttggtttcgaagtactcctgatgcaacccaaccccgctctacatatataatggtagaccaaattcggttttacacttgtacatatatacataagcaactgtactgtgctgtttttctcaagtatgaatgtgaaatatgacagtatccaaatggagataaaaatgtttagaaatacagctctaattaaaaaacaaacagactggattttcactactcagaagataaggtaagaacaaacctatccagcgttgccaggctaggaacaccgtctatttagcaactaaactgagctgctctaagaggcaaagagaatcaagattgcaggaatttctgctaatatcaccagctgttgagagctctgctacaagcaggccaaaatagtattcagcttggaagagcagctgaacacctgttggtgtacagtactatcagttcatttgttttgcctcaacattggcaaaaccctgagcaatcagtacataattttgcttacatttcgcagcattgaggaactactgaagagaagacgatgagaaaaaaaaaatgaagtctactgaatactgaaaaattgtgtagatggactcacttgcattctagccctgcctccgctgctcgcctgggcttgtttttgcgccggcttccaatctgcctgaatccattagtcctagttgattcatcactgcttgatcgaacactggaattactctcttccaggacaagattggagctttttttcagctgcctgcctctcttgttaccagcagcagatgcagtggtgttcttgtctagccttgatgccttcagcttaacatcatcaccttctactttttcgccatcaattacattgtctacaaaattttccacatctacttgatcaatcttatcggagaagcgcttttgtggccttcccctcctctttcttgcaggcatagcttcttcagcgccgcttcctttgttttcatggctccggacaatcgttagcttttttcctgtgcctcttcctctacccatctatccaacttagcagtgacaagatttattcagacaatcactgaagctgcaggctctactgaagttgctctatgtttttctctagttgctatttggaaggaaagtactcaatatttcaccgagatacctcgcgatggcgacaatccaatcaagaagataggctagaaatctgcagtcgtaataccaagaacaacatgctgttacatctaactagttcatgatgaaatgggttcttggggtgcagaagcaataaagtttgaggtctattgagatccatatcaataaagaagttgcaaatccagatcaagcaacataaatatccagatgaaaactatacaaaacagcaagcaatacgcatctatcaagataagtttaacaaaaggattttttttttcgatagagaacaagaaacataaaacaaggaccgattcaatatcggaaccattctttccacggatgacaagcaagaaactcaccttccatatagctggcgtccactccaagcagcatcatgcatcccatttcttcatgtttggtagccaaaaaagatggaatttttcgcaggtgctacaggaaaagaaacgctgggtatccaatggatcggcggtaatattcggtttgcgatgccagaagtacccgcggatcgggaggtttcagcaaagattgggatgtggtgttcaggaagcaggagaggactcagggctctacaaatgaacaactagtgctctggggtctgggagttctggatggttgggctccaatagcttctggggtagcagcagcagctgcactggctggggtttgtgtgtgtgagagagagagagagatttggttcttctcatgaagcttttttaatactacctacgtttcaaaataagtgtagtcgtgaatatccatcttatttgaaaaatttatgaaaaaatttaaaaaattttgttacacataaagtactattcatattttatcatctaatagcaataaaaatactaatcataaatttttttcaaacaagacgaacggtgaatagtgcaaaactgcacttattatgggacgaagggagtactgctactcctgtactagtactactactgaggagtcatttgctgtttgtttatgcttttatttacagcttaccaaccgttgaaaaatactgagagagagtgtgtgttcttggcttcttgccattttccagattaaaaaagcaaagacagaaggatccctagccctagggaagcggtttacttttaccatgatgggatttttgtttccatgtttctggatgtttaaacacctaggacagccagtagtaactcaaccgggcaacacctgacaccctgacgtccaaggtcattttgctttcaaagcgatgccacagttcttgattggctccagcttccaggcgagcaatgctcctgtactgaacaggtgtttatttcagatagagatcaatattttgttcatggcctttacctaagaaaacttcgtgtttataattcatttgaacaggtcaacacagtttttgttcatctctactccgtactgtgcttcctagtgcaagtcatgcagatgccctcatacttctcaaacagtgctaagttaaaaagtttagcagtatagtatttcagagtaaagaatgatcaggtctcttctatttactgcaataccatgaagagacaaatcttagcacacttcagctgctgcagcaagtggctgtattaaattataccgtatcctgacacatgctatacttttttattgtattatctcttttactttgaatttgaattcatctttttatacagtttcttatcaaggtagccaaccaggaggttgtactgatcgctagtgcaatagcactactgtatctctgtattactgtactgtgtatcttgagatgattctctcaagcatttatacagaagacgtacatgttcctcttgctgtcaggtcatcattatataccttctcccaattaaccgtccttcaattctcaccgctaacttgcaaacgaggcatgcttgttttgacaagagcttgttgaacaaacggaatttatgaacgctgctagtactcatttgaacaaacggagtacattataaaagatatagtctatcaattatattattaaattatattattaagacagtttttaaaggagaaaccacgttcgctgtgggcaggggtggatccacagtctaacgtccggggtgatctgacaccgatgacatccagcgaaatgcgcggtgatgctcaaaattctaccagctgtgaccccggcataagatggtaaatgaccccagcc

SEQ ID NO: 61439 - DNA, 4971 bp, Oryza sativa
  unsure (1)..(4971): unsure at all n locations
cctgctgccaaaattgagaagagacttgctacctggaaatgtagccatttgtcctatggggggaggtcaatcttgattaattcctgcttgagtagtatacctatgtatatgatgggcattatttactgcctgagggggttcatcagaaaatggattctttcagagcaagatttttttgggaaggtttagagggaaagaaaaaatatcacatgatcaaatgggaagccctgtgcagaccaaaggattttgggggtttgggttttgttaacacaaggataatgaatgcggctctactttgcaagtggattttcaaacttgaaactggggtagagaatccttgttgtgatctactgagaaggaaatatatggtagaaggagggggttttttccaatccaaagttgaggggggatcacagttctggagagggttacatgaggtaaaaggctggatgaaacttggtagctcatacaagcttggagatgggaaaaatatatccttctgggatgatatttggttaggggaaacaccacttaagactcaatttccatatatattcagtgtatgtgctgatgataacaaaactactcaccagatgtatgttgaaggggagtggaaaatctctttgagaagaactttaggtgaaggggagttagaagagtggggtcaattacatgctttattgcagaacatcgaattgaattcaggaaaagattccatgtgttggaatttaaacaaaactgggatgttttctacaaaatccctgtatcgagaaataagttttggggggattaaagactacatcttacaagagctgtggaggtgtcatattcccctcaaagttaaagtgtttttctggcttatgctaaaaggaaaaattcaaacaggtcatcagttaaagaagatgaaatggaaggggagtcccaactgtaaactctgtggagaaatcgaggatacagatcacttgatgtttcaatgtgcgctatctcagtttacgtggtgttgtttcagagatgcatttggttgggatggtatccccaaatctagagcagaacttttgaataaactgagtggtcagagcggtgattcaattcctgttttgctatctttgtttgctgctgccgcttggtccatttggcttttgcgtaatgactgggtgtttaataataagatgattgttgatgcgtcacatttacctcacaaaattgtgtctttacatctacagtggagaagcttagcacccgtgaagaagaggagtgctttggatacattaaggggcttgctccttgccagtatccgaaagatcggaggatcaaatacttgatctaatgccagggagttccttgtctgattttgctatggagtctcatttagtaggacaatgttactagctgaaagaaactggcttgttttggttgtgccagcagcccacttttgntngntgnaaggnccccnttngnccnggnnttggctccagttcttgttttgtctagctggaatccccagtatcatctttttcccttttcctttgtcgttcgatgtatgaactcttatgctttttaatgaaagctgggcgtcagcctttctccaaaaaaaaaaaaaagtccattaatggaataacttttttcagggatgcatttgtaaaataagttctcaaaaagaacaaaaaaatcccgaaacatttttagccacctttcctgccgaagcaatggttgcaaatagcagagctttatgtatacacaagatgatcactatgatgatcaacgcccagactccagaatgccttgcacagctccaccctccatgctgaaattcccggtgctaaccatctccaaaccagccaccgacgactccccgagtaagctctccatctcctccgggtcatgctgcgcccatgggtgctgcatgaccttcctcagccggccaagcttgtcggcgacatctctcatcgacggtcggttatcgccgatcatctccaggcactggctcgcgaggtcagcaacctcctcgagcaccccagcattctcatcagtctgaatgtgatgatctataatgtccatgagtcttccctccttcatggcacacaagaagctcaatgaaaggctcttctcattttcaggaccttcaaggttgaaggccattttgccggtgagcagctccagtagaacgacgccaaagctgtacacatcgctcttatctgtcaattggcacgtctgcatgtactcgggatctaggtacccacaggttccttgcaccaaggtgacaaactgggcctcatcagtcggcactagtattgaggctccaaagtccgatatctttgcggtatagttctcgtccagtagtatgttggaggtcttgacatcaccgtgaatgattggaggcgatgctgatgaatgaaggtaatctagtgcttgggctgattcatgggcaattcgcactcgagtagaaaaggggatgttgcggcagtcattgccgccatgaatgaagtgaaacaaggtcccattggggataaactcatagactagcattgggacctccacttcgaggcagcagcccaggagcttgacgatgttcttgtggttgatctgggacaggatgagcatctccttgccaaactccttcttttgcctgtcgtcaatcatcgacatgcatcgtttgatggcaatcagacggctgtccttgagcatgcccctgtagacagtgccatggccaccgcggccaaggacgttcttgtcctcgaacttgttcgtcgcttctatgagttctgcttcagtgaagattgtgaaggcagtgctctgcccttgctttaagcctatctcctgcagcagaagcatgccaccgtgctgttggaaatacttcttcttgatattggccagtttcttccgttcacggaccaagtatgagcaggtgacgatcattgccatggcaacaattccaacacttaggcctgcatattaatttatcaattttttgttattgcaaactcagttgtgtgccaaaaaatctataagattagggaacgacaacttactaacagctagtatcaccgttctggattgtgaggggcttgaacaagtaaaactgccaggtatgttcttgcaacggccagggcatggaggtggattgttaacatcacattcattaatatctacagacacagtaaaagtagcatgatacttagtgtttggctctacaaagattgaatcatcatgggatcaatatctacagacacagtaaaaagtattccctccgttttaggttataagacattttaactttggtcaaagttaaactactttaaatttaactaactcaatagaaaaaaaatatgaatatttacaacaccagcatagtttcattaaatctataattgaataattttttataatatattagtcttaggttaaaaatattactacttttttctataaaattagtcaaacttaaagtaatttgactttaacgaaagtcaaaatgtcttataacctgaaacggagggagtagtatatatgtacttatatatcaacaaaattcaatcaaggtaaattggcaatacagaccttggcatccatcgggaaggtacggattgccacggtagccttcagtgcagttgcagaggtaacctgtagggccactggatgaatcgatgcacatgctgtttttgctacggcatgcgtatctatctcccatttgcttggcaacctgacatgtctcattacccacaacccagttcaagaccaccgggacactgccattgtgctcgtcccaaaaggccgttgagttcaggtatgctgttcggaacctgaatgcagcagcctccatcaccacagcgtagccacagtagcttgccctgtccgtgatgcttctgttgttgtaagacgttgtggtgttgtataaggggttgaattgcacttcgtggtaggaaatgttgttgctgagtacggcctggcagcagccgatgccgacacacgacccatcttgagctgtgaagctattatacggtgagcactgagacaagcacccgatcatatttagcatctgcatccaaatcccggttgagtttatggatgatatatattaccacaaaaacgactcttttacagttttactccagcgtatcgaagattaaattttaaaactggcagcagcagaatatatatggtgaatttacaagagagatcaactcacggtagagtagcggctgtaaccaaacatgtttgcggccgtgttggcaccgatgactatgaatatgttctccttctgcgagatggtgaacggagaggttgtgaggttcaggagccagttcttgtagtccatattcttggttgagaggttgtagcacatcgaggatatgtacgttgatttcatccgaacctgaccatagcgcagcgatatattcagcaccggcgtggtgccatataatgccacatccccacgtccatcctctgtcttgctgcagctaagcacaaagccttcaatggcacagccttcgccaatcccaaatgggtatagaatgtcaacatcaccacacttctttaggcacctatcgtccggcaatgatgcgccgtctgccatgaactgtagggagatcacgaggcctatgaacagcagcagacgcattgctagtttttcaactgggagcttgtagtagcagtccatagttgggttcgatatgctacagtttcagtgctgatgaaatgtatatgcaatggacatcttcgtctcttatttctctaaatatagtagcttccacaccctacttggttatctttatattgaacttgttataattaattggtcaaacacaactatataattaattatttaattggtcaaacacgtgctatagtatggttctgccttctcaatcaagtaggaaaaatcttctttctgagttgttttcttctattttgttcttcgcgagctgggatgagatgcaacttgcaatactaaacaattcttagatatctttt

SEQ ID NO: 61440 - DNA, 982 bp, Oryza sativa
ccgatgaaaacagtttattcggtaaactaaatatatatgctcatatttataactttaatttagtgataagtgtaatcttttaaaaatacttacaagaataaggtgtgtattcactattccgcgccttgagagcgcatgcatttataacatgtttatcaacaaaaacacaaaccgaatcttcagcagctagccgagctaattagtgaatacaatagtaccaccctattacatgataatagagataccctttcatgttcatggcatctgatatgttcatggtttgtatagtatatcccagcagctctaggaaaagtttctgttctccattgccaaccatcttctattgacttgtatattccagtttagacttgggcgatgcactttgtgttcagagattcccattcgtcaagtcctcactatcatggctgacgttctcattgggatatcgcagtattgaatctaatcttcttctcagaacagttcagaatcaaaatggttcatttacaggtccacgtggattcgttgacgtcactgccgaacagacgaaaagaaaatggttgtagcgtgctgtcatgcagtaacgtcgtctgggggcgaataggaatatacaattattaacctctctaatctgtaatcagtgagtagtgatatgaatatatggtttagggaaacggaaatcagtttgatgtcatgaaaatgaaacatgcagatagttgtaaatttgtccagtgaccacttcgtacaagctagaaaacatatccagaaacgatgtaaattgccgttcaagtttcgcatatcgatccattcactattgaccaataataatgctccgttgaacgaactaaaagtgcaccacagttgcatcaagcagaggttaagagaaatgctgctaattattgtggaggaccatgtattaattagtcttcggtattttgttgtattggagtaggtgtatgtctcgtataatcctaactttatgggt

SEQ ID NO: 61441 - DNA, 762 bp, Oryza sativa
tggatcccccttttttttcggcgtcaccttcttcgggttcgccgcaacctcgccgacctcgtccacctctccgtttcggtcgccgaccgccggaacgccgccgtccccgtcgacccgagccgcgccgccgcctctatccgctccggtcgccgttcccgtcgtcgccgtcgacccggggtgagccgtggatcgccgattcgtttcccccttccctcccctctctcgggcaccgctccgccgcgccggtggtcgccggcggcgaccatcggggcacgagtgcgccgcctcccgtcggctgtgccggcgtggccgccttcgggcgcgccccgcggctgccgcgtggggcccggccgtcagccgcccgcgccctcgggtgcggctgacgcgtgggacccacggcgccggtcggtgcgagcccgggtgcacccggtccaccgtggaccgtgaggctgccgcgtgggccccacccccgtggacccggtccgcgcgcccctcccctcggctgacgcaataaatccatttttaaattaaaatttaaatgaagaaattcgcaaatattcatttaaagagcatataaccttcaaatggccataacttggccatttgaactcggaattggaccgttcaagtctctaattcttccttaaaaagtcaagaacccatttttgtgctttgttcctgcttgctatatggagcttatcagagtaaaagccctgtctttcccttggtcgtgtagacgctgcagcttcggaggaccgctct

SEQ ID NO: 61442 - DNA, 1331 bp, Oryza sativa
gcgtggagcttgattgcggatgttgttgcccgcattgttgttgaagaactgacgctgcggacgaacaacagacgaagaacctccctgtcgcatggactggggtcctaaagtaagacgcggcctctgactatcccttgttgtgccttgaattgagcaatccggcgtttcttctgctccatgcggttgtacttgccctcctggcgaatagccttatccactaacttctggaaatcatgataatccccagtcatgagtgggtaagaaagctcatcattaagtccttccaagaacctctcatgtcgctcttcatcagtgcgcacatcttccggagcataacgagccagacgattgaattcgtgcagatactcagtaacagagcgagacccctgagtgagcgacctgaattccttcttcttgagagacaccactcccgatggtatatgcgtcttccggaaagcagcggtgaattcaagccaagtgataggttcagtagtagtcctgttcaggcggaagtgatcccaccattcagaggcaaggccatgcaactgatgtgatgcaaatgagaccttctcctgatcggtgcactgaagcaaatccaacttcttttctatggcatgcagccaatcgccagcttcaacaggattagtggtactagagaaagtaggcggcctcacatgaagaaattctgctaacttgttctgaggaggtgcatgattatttccctggttctgctggttctgaagttgctgcatcattatgttcataagctgtacctgttgagccaggacttgggcaagtgtgggattctctccattgttgttgttattgttgttgttggggccattcccgttgctgcgagtgagcaccatctggcatgggcaggatcacaagaagagaaaccgggaaaaactacttaggacagagaattaatttaacttttattgatcttaagtgagtttcattattacaaaactaaagactctcacaccactaaactcaccaactacctaacactcgaaagcaaacaaacgcatggacttacatcccaccactgatgtaaatcacatgcgagacacacacaaccaaacttaaaacaagcaaactaacacaacgatctaagacaactgtttgacaaggcattctagttcttccgggcatcggagttgattgaaggctcgttcggctcgtcttcatcatcttgagttgctccccactcgatcttggaatgggtgcgcttggattcttctccttcatcatcacttacgttgacgaccggaggattcgctagggctggggtaacttctttctccaccacacggacctttggcgcc

SEQ ID NO: 61443 - DNA, 5817 bp, Oryza sativa
gttctcgaccaacggtgtagcgattctcccactatttccacttcaagtggtcgagttacgactactacctggtcctcgaccagaggtgtagcgattctcccactacctctacctcaacaaagttgatatcagtacacaataatgccaagtgttttacccagagatcccttaccacgacgacacctagcgttgaaacctatgctattgtccctttacgccgtcttgacaaggcctccgaggaacctaagggatcttcggctgggaacgcccagagccgataaggccttgtcagatcctgtagagacaaaagaccatgtaagatctggtcgtgtaagagttctcgccgtgcgtattaaccaagccgtgtaatcggaaattgagttttccaacttcacggctcggggctaggatcagtgcttgttcaaccaaggcaggtcaagggtccaagagccttatcctccgagaacgattctccaacgagaaggctgggggctagggagagtgtatgactctacaaactgactgatcgaagtcggtaagagagaagacgctcatacacaaaacattggtcggtaaatttgattcatttttagttttccatgcatattataacatgtcaccctttgagcattcactcgggggctatttctatttgatattcttttctgagtattgatttcaggaaaattctattcggcattgttgaagtctccatgtctctatggttctataccaagatcgactaaggcgagtacgaccaatgttgataaggctccgtcgcagactctgcgccttctcgatcactcgagaacagttggtggatctcgacaaggaatacagactgaagagatggtgtacccgccgagataaaatttcttgacttcaatccaaattctcgattacagcaagacgggagacttagttgtatgctctgtactttcttggttgacgtcggagattgactcagacaaaccctttaggtacccgcacgaggctgataaagcaagtctaacgttatctctgaactcaccgagaacggtcacttgagctcgataacagttactccatggttagcggccgagaatatgaattcgttcatttgcattgaagtcggggctactgtcagggttatggatactacatacctactagtagtcgactacatctcggcaggacccaccacgtaccatgtcttatacggaaactgacttcggatatggagggagttccagataaggaaagacaaccagagttctacatggaaacgataagtactcggattgtatccatattggtttccctagttctatttagacaaggggacacctatgggtataaatacaagaccccctaggaggagaggggacacgaccacctcaatcaacacccaccacaatctacggaacaacagaagccaaaacatacaagcctacatacggcaagacaaaacgccggatatcgacttcagggataagcacggctagtcccctatggtgtctccggatactatcaggagagacgaaagcgttatctctgatctcgctgggcatggattcgaggaggaagactaccctattgtcgactacgagtcagaccttcagaccgtcatgtcgacaacagttagataggttacctcacatattgtactggtgtaattatggtgaataagagcaatatcggcttcggctaacaggatgtagggttattacctgacaattcaggggcccgaacctgtataaaaatcctcgtctccgtctcttttacctcagtctcgcgtatatcctagtaccaacgatccccatacaatacaaataccggaatcgcgacatcaaacgtcgacacttcctacaaacgctctcaagccgccatgtataactcctataaatgcttctaagtcgccacatagcgttttaataaatttaaggaatatctaataattcttaaaaaggaaaaccatagagtggacccactttaaatccgtattgtgtatcaccagtgcacgttgtgtgcacgtatgtatgccaagtatatcctttccttactcctcttcatgctatattatgtagaaaatacataatacatcattagatcattagattatttaccacaaaatttatagttcaagacccaaactaactatatttagtaaaagaaataaaacacatttatacggaaaatcatatagatattttaacaatctatttaacaacacatatattttaatagaacaatatgcaataataaacaattttaattagaaaatagatatttaataagtacataactttgggttgggtcattattatgtttgtaaatatagataactcaagttggtgaaaccattgaatctatctcaaaggaagcaaaactcctctcctcctaatgtcagacgtacatgtgcacgtctcctggaagcaagatcacgatatatacatatatctaatctatctttattgatccatatataaatatatgtataacaaattatgttaatatgaaccaattaaaaggagggctagcttaatggtccattattaacaataatattttttaagatttgttaaaaaaaagtcccaaaacattcaatttaaaaagaaaaagcatcgtatttttaatttgaacttttagacatattttctaaataaactaagtctacctcctttttaaatgatgaagaagaaaataataattacttatagagatgaattaaatattacgtagtatgaagataacaaatacctaataaaaattatttaagcaaagctagcaaataaatttatgaagaaaacgtacttctaaagcttggcaagtgttatatggttgattttcaatccttaagtttttcaaatacatgcttatgatatacatgcccgcgtgaatacgcgggctaccatccttgtttttctaaaaagaaaaaaaagaaagagtccttatctgctttgaattctcatattttttattttactagaaaaaaatacacgtgcgttgcagcgggtgaaagctattttaattttattgttcttatacggtctagttaaggtgaaactcgctgtagaagttcacttagatatatattttattagaaattcataagctgcaattaaaagtccgatcgttttaagttagcatgagagtttttttaaagagaattcttatacgactctttctatattttcaaaaacgaacgaacttaaacccgacttaaaaacaatatgtattttcaaaagtgatcaaacttaattttgtatttccaaaatcgactcatacatggatgacttaccaaagtgccggcaaaaatatttttaatttttataatagtagatactttaagtaatgtgagaatttctaaactttaataagttaatagattggcaacgatgttatcgtgtctgcctataggaggaggtgaacagcggcgaatgctcattttctattcatcctccgccactatcggcgatgctatcgttctgtatgccacgccaagctatcgtggtatggcggtgacggtggacagacgacgatgacaccagcggatggacggacggcgcgtcttaagcagacaaacggaatggcagtttggcaccgaactacagtaagaaattcgcatgccggtgtaattgggaaaggcgcgcaaattactagatgacgaataaaaggtgtccgtatttaatgtcaaattatgaaatttatcccgagagcgacacccaaaggtggcaggccgcagcccgcaggcgtggtccctggctggtttagttgatatattttttattcaaaactaaaatttgaaatcaacgagttcaaagataacattgttttgtgactttgattaaattaaatcaatcaaataattatatatggatatgatatttgtgccgtgctcttgataaattaattaatttttatttgtgtgcatagataaagactcgtaatagcgcttaaggggtcattttggattgatgccaaaatatgcgctactaattgtttggcaattgaaatagtagtttgattggtttggattagagccgaagcattggcaatacacatacataatttggtagcactctaaaactttcttcactgtaacaagcattttggtaacaaatggtagcaaaccaaacacatattatatgaattctatcctaccaaagaattggaagtgccaaaatttacctaaatttgtgcactaccattaaatcgataggatagagaaccaaatagacccaagattttgtgttgaaatcctaaaatcataggtttgccactacggttaagcaagtattaattataagaagtgtgatctagttatagatggccaaaaggcccgccctgcatggcccggcccaggcacggccggcacttcgtgccgggccgtgccggcccatgggctgcgcctcccgcccaggcacggcccaccagccgtcgggctgtgtcgggccagcccgaaggcgcgggtggcccatcgtgccttttttaaataagtctattttttgtccctcctgtttgggctgtgacatatatatagcgaaaataagtctattttccgtccctccaatttagactgtgacatatatatagtgaaatactacctctgtcccagaatacttgtcattctaggttgtttagcatgtgctaaggttagaagaaaaagactataatacccttaataaaatattatatagttagatgttgaatggtggttgggggtatgatggagacaaatttgaatttgaagtggttgatgtgacaagtactacttgcaagtgacaactattttggggtgacgctaatgggcgactaatcgcgcgcacctccaggcgcgcgaccactactagtactaaggtacttctactactagtcctcctaatcgcacgccccaggactccagggctgtgtttagttcagcgcaaagtttgaattttggttgaaattggagatgatgtgattgaaaagttgtgtgtgtatgacaggttgatgggatggaaaaggactgaagtttggatcaaactttgaatctaatcacaacctaggagtagtactaccatcttaatctaagcactactactactagactacaattactactcatacagtgatactactacctattactagtagtagtaagtaatactactagtactactattctactactactataaaaaaatatacatgtataaaaatcctaaaaaatacgtatatataacctaaaaaatacgtgcatataaactttatatatgtgtatacaaactttgtatacgtatgtataaaaacctaaaaaaaatacatgtatacaaactttatatatgtgtatacaaaattggtatatgtacatataaaaacaaaaaaaatacacgtatataaagtttacatacgcatatacaaagtttgcatacgcgtatacaaagtttgcatacacgtatacaaactttatatacgcgtatacaaagtttgcatacatacatatttatacagaaaaaagatacggaaaagaaaaaacggatattatggaataaaaacagaaaaagaaaaagagagaaaccgagaaaaacaaaaaaaaaagggaaaacacggagctcctctcgcgcggcgcgccgtcgccgccccctctccgcgcgcgccacgtgtccagtcgcacggagaggggtgcgcgcgaccgatcgccaaatagcaatttcgcctattttgggacaaattttaaatgcgaaagagacaagtattgtgggacggaggaagtaagtctattttccgcccctcctctttgggctgacatatatatatataggtaaaataagtctattttacgtccctattctttcg

SEQ ID NO: 61444 - DNA, 740 bp, Oryza sativa
agctaacaccaaaacgatcgaaaagtgaactaatagctagctaggaaatgataatatgtagtagtagcagtagtagactagtagtagtaatgtaggtaggaaatcagatgcctggcctgcccttgtatgccgcggaatggatacgttttaggccggtttaatccctcgaccgccgccgcattgccgtgtcaggtgtcaccaccaccaccagcagctgctgctcatcatctccgttctgcgagatggatcggagtaggaaggcggccatggcgaaggctaggagctcctcgatgaagcgtcggtttgcatggagaagaagaaaggaggagatgtgtggtggtgttagagagagagagagagagagagagatagagggagggagctgtgggcgatggtgtccaggcaccggcagcaaggcagctgcgtcgtcttaagaaagagcagaaatggcatggagccctccaaagcatctgatggctggccctgtatgcgtatttatttatgtaggggctaaaggcatcttttcgcaagacgtacactgcacactgctctcattttttgcaagacgtacgctgcacactgctcttatttgagagagagataagagatagagagagcagcaacagcagcagcaattttttctttaaaaaaaataatcgaaaacgcagcaaatacaaccactccctcagttctcagatgcataaggttcacaaaaccgtttgctgaccgaaaatcgctca

SEQ ID NO: 61445 - DNA, 1740 bp, Oryza sativa
gtatcagttttactaaaggggtagtactcagacatctcacgaactgttaactttgtttttacctctgcatatcaatcaatggttatctacgaagccagcatgtaatgatcgtatttgtaatagtcttgtctttatttcaccaatcaattagtaattttatagttcagtatattggctagaaagactcatgtctgttaatctggaaatgcccaattggcaggaaggagcatcccttctgcgctcatagctggttcttgcctggcttttacatctgctgcgctggacgttggcggcaacactaccagagtggacaatggcaaagagtactatccctacacagtcgagaataagcccgctcattgactgaagttctgtacgtgtagcccaagtcctgcaaaaccgtcagctcggtgaattttgaagctgatgcttactttcatgtctgttttgttgatgtactagctcctttgcaaatccttggcattgttgtgctcgagagagacctatacaacagtctcggaataaatatttttgcttgctttatcgtgatcatcgatcacaataaacgccttcacgatgcttgaaacatctggttttgcttgctttctcatgatcataaatcacaataattatttcctagcctcgaacatcatgtgatactgaaattttcatactgggatactggtcctcccgtttgaaatcagaaaatctagagtgcggtgcactttgggccaccttttagtttcacattggaccacccttaattcaatcttttcactttagattatctaactttagtttgttacactttgaaccatgccgactcttttctctagacatgtctatcctaggtggaggatttcattagcgtgccacagtcaacatcctggaggtcgttgatgtgttaaagtggaggtttgggggtgatctaaagtgaaataaacataaacttagctagtccaaagtgaaaagattgagggccagtttggtttgtgaccaatgttggccttaccaaaatttggcatgacaggtaaggccaacatgtgtttggattgaagccaaattaactaatttggctattgaaatggcctatgttatataggcatgccaaaatttggcttcaatccaaacatacacaattattggtgaggttgccaaaaaattagcaagcctaatttaggcctcaaaccaaactggccctgaactagctcgtttgggaagcttctcatagctacagcttctcccagaatcaaaagcttctcaaatagtttagtttttcgtctagattctgataagctatagttgcataatttaaaaaattgaactataagctagaaactagaaaaccagaagctagaaactagaaaacctagttttttagattctcggaagctagctacttcctccgtttcacaatgtgagtcattctagcatttttcatattcatattgatgttaatgaatctagatagatatatatgtctagattcattaacatcaatatgaatatgagaaatgctacaaatgacttacattatgaaacggagggaataccaactagttgctttttgtaatcctaagctatccaaacatgccctagaaatggtcaaaagtgaaaaaaaaagagggcccaaagtgaaattcacccgaaaatcttaagaaagtgggacatatagacaggataaattatgcaacgaagtgatacgttcttcttccccgtgttgctcgcaggcatacctcc

SEQ ID NO: 61446 - DNA, 6595 bp, Oryza sativa
aatcccaaatgggtatagaatgtcaacatcaccacacttctttaggcacctatcgtccggcaatgatgcgccgtctgccatgaactgtagggagatcacgaggcctatgaacagcagcagacgcattgctagtttttcaactgggagcttgtagtagcagtccatagttgggttcgatatgctacagtttcagtgctgatgaaatgtatatgcaatggacatcttcgtctcttatttctctaaatatagtagcttccacaccctacttggttatctttatattgaacttgttataattaattggtcaaacacaactatataattaattatttaattggtcaaacacgtgctatagtatggttctgccttctcaatcaagtaggaaaaatcttctttctgagttgttttcttctattttgttcttcgcgagctgggatgagatgcaacttgcaatactaaacaattcttagatatcttttcctctcgtgcccccggtcgctccgtcccagggagagatttttgataataaaccactaaatacgcgcgccattgcaatccgcatgtcttctctaatacatcactaggagtgctaattttttgatttcataccactttctctcattcccgtcattttttcttttttttttcgttttctgtttttcccttttctttggactgttttacccctggctccacctgtcaggtaaaagagagagggagatggggttttatctgctgctgtgcgccggttgccctgcccttgcctcttctcgccagagagaacaaaatggcatcaggagtacgcctgctgccctgctgttcctcttctctgagcaggatagtggcatataactgttgcatatattgctgcatgtatagtatatatgtgtatacataaacggttgctccggatgccaaaattttgacagcttgtaagcaaaattttgacagaatgtaccctaaattttggcagcatgtaccttgcaatttgtatagcatttgacacaagtcaagaaagtacccataatttggtcacagataaaaaaaatggcagcatgtacccataatgcatataaaatcatttcagaacaaacaagttcaatagcaaacttgagaacatcatccagattacataaccatttggcaagttgagagaacaaaatgaaatcaaccagctttgtcccatgtttcacattacaaaagcatccagaacactaaatattatatttagaaaagcattcattttttccctttctttggagtgatcttccttgcagctctagtagggcctcggaggggttgccatttgactcgatccttctccaacaacattagtcaatgccaattgccttcaatgaactgagtgttagtaaaattttgagaatcaatcataccattgaactaaagaaaaatcataccttctagtgacaagcccaggactcatattgctggaatcattgattgcaaccttttgtcttttgggtgtgctagaacccgctgcatcactagttgaacctagtggtcttccttgtttggcacgatttttcctaaaaaatgtaaaacaagttaaatgatctataaagattaatgtacaatatgctagaagtaaatgtatgtggctacctttttttcttggtaccatttaaaggacattttgaggatgtttgcctatggcccatgttaagacacctcttacattgaatctgccaccttcctttggtcctaggtttgcttcctttctcaaggcacccaactatcctattctttctttgcctccctacgtccctcatagtgagaggtggcagcaacttgaaaccaatatttacttttggccattgggacttatctggaagtggatgaataactcctgcatatgccagcttatacttttccactgaataacaaggatccaggtaatcagccattcttgggtttctagctgatattatgagagctaatgcatgtgggcatgatttgccagaaacttgccactctctacaagtgcatgtatgttctgtaagattgacagcatgcctactaatatcatgttcaggagtaatctccgccatttctgcttggtccctattaccttgcactaccttcaagtgacccaaatctctagtcattgcattcagttgacgaactacaatagggagcatcacaccatctagtttctcacctatcttcctccgtctcgcaaatagatccattgtctttgctctgatgccttctgcaagatctgcaataggacgatccttcatatccttgacccatttgttccatgactctgctagattgttggtgatgaagtcacattttatcttttctgagatcttgtcctccacattaacaaacaaaatcaactttctatcactcttcctaacaaacaatgcatgggctacatccatattatccttaaacagtgtttcctcaccagtgctcatgtcgtagccacttatcacaacatgttggctgctgccccattttacccttgctgcaagatccttttccaagctctccaatgtgcactgatgataatccacaacctattcaagccatttacgcgccacttcaacacaagtaccatcatcaagtttagctataaactgaccgaactgaacacacacgctaaactccacatcatggttggtcctatcacatacgaacaagaaaaacgagagtaaaaaatcattagttcacctgctaaccaaatatgtcctagttttgctccttagcccgttagtgcaaataatggagatgtggagagttatagcattacctagaagggagttcacttggaatcgaggagcttgccgcttgcgccatgatctcttgaaccgtgacccccttccccctctctatcttcaaaccctagggtccggaggctggccggcggcggggcaaggaggctagctggcggtggcgggtggcagggtgatggggaggctggtggcggcgcccggcgaggaggcggcgcggcgacgggactggagacggcacgacaacaggacgggagtgcacgcgctctgcgtccccttcccgatccccttctctcgatccctctatctcttttacctcacaggtggggccaggggtaaaacagtccaaaaaaagaaaggaaaacagaaaatgaaaatgaaaatgaaaaaatgacgggaaggagagaaagtggtatgaaatcaaagaattatcactcctagtggtgcattagagaaggcatgcggattgggtggtaagtttgcaaaggcgcgcatatctagtggcttattgtaaaaaatcggcgtatgaagccgcaccgccccctcccttcccctgctctctcccgcctcgccgccgctagagcagctgccagcaaagccgggtggaggcaaggaaggcgacgacggggctttccctctccctcgctcgtgatcaaggcggttggggcgccgacaggagcgaggcaccggcgacaatgtccagttccagcgctgccgagcatggatccggccctcccttggccggatctggtgctcctaccggcgggagtcgcgggggacagcggccctcggtctggcgatggggatggccggtttcgttgcccattggctagatccgccgccctcccagccggaagcgacgaagccgtggtttgtcaaggagaggtaggaaccggcgcgccctcgccggtgcggagacggtagccgtggcgggaggccgacgacggaggaaggagtccgatgcgtgccatcgtcagcgggggatggcggcagatataggacgccggtgatagaggagagagttgggaggacggcgatggaggtgggagccgggcgtgaggacggcggccgccggctgtgcccaccggtggttgtgggaggctggtgatggcggcagtaagaggctggcaccggtggcagcgggaggaaggtgcagccggcagggtgaggccggcgcgggtggcgccgacagctgcgggaggtcgactcggtcgaggcgagctattcatgggcaacttggtcgaggcaacgacgacaacattgccataaggggggtgttgaagccttcggcaagattcattccaggcgattgttctcttgcggcggcggcttgccgccgtaggatggtcacgttttaattaggtttttttttcatgtccaagggtttttttttttttcgggctttcctttttttgtcgatttggtttgttcgttgccttttttttttaccgatctcagttcgatccaatgtgctgcacacgcacaatgcccctccggccactaccctagccaaatcctagcgccaccgcgatatcgatctacctccctatgcttttttccttcaactagaaaaatgtccgtgcgttacaacgggtgaatgttatattaatcttatcattattattattattatacggtttacttaaagtgaaattcactgtgagaattagcttgtatatatatatttccagaaaatcatgagctataattaggagtccgattaattatctcaagttagcatccgagttttcttaaagggatttcttatacgactcctttgtttccaaaagcaaacaaatttaaaacccgactcaaatacaaatctgtattttcaaaaacgaacaaacttaaaaaccgactcatacacgagactcatacacgagtaatatatcaaagtaccgataaaaaatcttcaattttataacgtatcaaagtaccagtaaaaatatcttcaatttttataataagtagagacagatagaaagatacatagatagctagctagatggatagaagaaaaaggaactcgtgaaaatcccgtgggccgatcgtacgcacacagtttttgtttaccttttttacatgtcttgcttatactacgtacgtatacatgggttattagcgcctgcttatactacgtacgtacatgggttattagcgcctgtaggcaggcgtttttctcttttttccaatatatctcttgcatacgtgcgcgtactgagagagaagatattagccggttttagcatggagtaattagttaatagatccgattaacggttgataataaagggtccaccaatttaaatggaaatcgatggttggatatttttcttttttcttagaatttctatgattttgtctaatttattagagtgccatgttgcagcgtaggagcgtttgtagagtaccacgtgactgtttgagagtgtttttaagaagtttaatggacttttagtatagaataaataggtagattgattgcaaaaaattgttccgcacttcttcctcattattctctccatgatttcccctttcaattccattttaattcttcggatttgatctccattaaagatggccgatcggcgagcttccctgaactttttatcttgagttttgctaattttctctgattttggagaaacggaaagaggagattgagtagataaaaaattctcaactaattataggacatcgagaaagattcggccggatttgatagggagtgtcggctccggcatcatatgggcatggccgcacgggactatgttctggaggttgaagattgtagtcagccatgcgagctgagcctgtgactccacttatacttgtgggttgggtcgaacagagatagaccgagcggagggaacatttatacttgtggctgggtcgaacagagatagaccgagcggagtgaaggaaagaatggcctttcagccaaaaacatacgaaggattttcattatttttttcaattactagaaaaaatgcccgtgcgttgcaacggttgaaggctattttaattttattattgctatacggtttaattaaggtaaattcattttgagaattcgcttggacatatattttttctagaaaatcatgagctgcaattaggagccatatcatcttaagttagcatgtatgttaaatttttaaagagatttcttatacgactgctcatgtatttccaaaagcgaacgaatttagaacccgactcaaatacatatctgtatataaaaaagcgaacaaacttaaaaaccgactcatacacggatgacgtactaaagtaccagcaaaaacatattcaatctttataatagtttcactgtgagaattcgcttagatatatatttttctagaaaatcatgagctgcaattagaagtctaatcatctcaagttagcaacttagcatgcaagattttttaaagagatttcttataagacccctcctgtattttcaaaagtgaacgaacttacaaaccgactcatacatggatgacgtaccaaaataccggcaaaaatattttcaatttttataatagtaaaatgtacggacgaagaaatcacgtttaactttaacttttttattaagtagtagagattatagttttatagtgatttagttatttttaattttggatcgatcatgaaatattcacacacactgtagaatatccatatatttttagctttggcctatttcaattttgaactttatttttaacctttgagtaggtgcaaagccgcatgcgtgcaaagtcatcagtcgagcgtgtgagtggcttgatctctggatggcaatcatggcatgcagtcgaaggcttgcatgt

SEQ ID NO: 61447 - DNA, 2109 bp, Oryza sativa
gcgtgccactgtggcactgtcactgtgcgagagcgatcactcccccagcctcgctgctgcctgcaagagcatttttctcaccggtactacgcgtcctacacatacatgcacaatatattctactagtacttgggctgtttgatagtttgatactacgggggatgggagtcctaccaaaaccaaaaaaacttagcgcacgatccgcacatgcagtcgtcgctgtctgattttcccataaattggggtcggattattagtacttgcgcagacagggcagggaccagcctcatttgcctcgctttttctgcaatctgcattgccattggcattgccttgcattgcggttgggctgttgcccagtcctcctcgagtcaagccagcccaccaccgcatgcagacggtgcagcagcattaggagatgaccacacgggcttactagacgagcacaacctacgagttgcagtttgccggctgacgcgtggggcccggcccatttgtttggcgtgccacgccacagtgctgcctcccttctgactagtactgtggtgactactgatggatgatgtggtgagtaggagagtaatatactgtacctaaggagtgctcctccgtaaaaagttctagttataaatttggatatgtggctgtgtgttcaaatttatagctacagttcatcttttttagggtagagtagtactccgtaagagtagaggtggcaatgggtcggatcagacaatagacggaacattaacacgtccggcctaagacttgatatcccttgtctaggggtgaaaacggtttgagtatttttttatatccagacacatttgttttaaagtggttcggaaaattttctatatataagacgcatttgtgtttagattagttctatatatgttgagtatatataagtacatgttgagattagagaccaaatgaaataggaatgcgtcaaaatcagcaatagacacatatatcaggtctgacatgggttactcactggcataatataaaacccatatgcgctcaaaagaattttggatatcggatcaaacatgtccacgggtaacaaaataaacctacgctcatcgggtgggatacccgtgggtatcggactagaattgccatccctacccagtaaattgctaccactagttccttaattttggatgcgcggacacatgctggcctaaaacaatgcaactatgcaaggctagagcttagagtttagcaccctgcccatgttctttagcttttcaaaagctccccattggtgctcgagtttgtgctctccttgttttttccccttcaaaacggattcacgaacgctcatggttcagagttcagactagcagtaggcacaggactgtacattggatgatgccttttgagtagttgaggctgaaagcggagatggtacccaatggcggccgataccagtgatcgcggtaagggttgtcgtcgtcgtcgtcgtcgcgggcgctccgctgctcgcacgcccgcctgtcgttttgctcgcgtgcgtgcgtgcgtgcttgcctcgatcgatcggtcggtcggtcggtttgtcgcctcggcacgcaggcgcagccgcgcgcagcgaccgcgtcgtgcgttcccttgtttgggatctcgccaaccacccgcatcacaacgcggctcgcatcacgcccgagacacgcacacacgggcgagagacgccgcgcttgccgggttggttgcctggtttgactccgtttttttttcttttttttggtttgatcggcagcacagcgcctcccggcctcaaaattactgtagtaccacgagatcgatctcgacccgtctcgtcgtcgtcggctaaaagtaaaaattctggatccatccatgccaaacaagtaaaaatctggatccatgcgaaacaagtagtcgaggttgaatcggatggatgtgctcagacagaggcattgccagattggctgcttgcctgctgcaaggtactcaacagtggcaggatggcagggagctacgctacgcatggtccaggtggtctggtcgcgaataggaatggtggaatgcgattatggctgtgtttagttcactgtgaagttggaagtttggttgaaaatt

SEQ ID NO: 61448 - DNA, 5506 bp, Oryza sativa
cctggtcaaggtaaaagttatcatgatgataatatttgcatgtttttcatatgttgctgatccaagcttacttatcttaataccatgcagctgagactaaagttgcacctgttacaccccaagttgaggatcttcttgatggtttgtcctcaagcacatctctttctggtcagatcctactgccttactattatctaacattatggagcactacaaatgattatgatatttactgttgctatgcttgcttgctcaccagatgagaatacagcttacccgccaatcacagctttccagagtgcagctttgaagatcactttcaattttaagaagcagtctggaaaacctcaggagactacaattcatgctagctttacaaatttgacatctaatacattcacggatttcatctttcaggcagctgtaccaaaggtattaccttcaaactgttgttttggggtcacctctgatgctcatattaactggtcagaaatggaatttttagtaaaaaagttaggacttaagaaccaactatttatttatctgttttaatttctgtataaaatttgtataactattacttggcttgaaataccaaaaaccatctattgaggaggttatttatttgcattttcctttttctgacagtttgaaactctgtgtactggccatttaatttttaaaagaatactttaatctatattttcaagcatcattgtgatggctgatagcctgttatgcacatctgtattcttttggtttcctttaatatcgttattagaatatataaaaaacgtttgtaaatttcaagggagtgggtgacatgatacttttagttgtttttgctattcactttaaccttgaaattccatcattcagatgagtttgtagtttgctttagtagttgtgaaacatacaaaatactcgaggcttatatttcatttctgctgaatttggatttcagtttatccagttgcgtttggaccccgctagcagcaacacgcttcctgccagtggaaatgattctgttacacaaagcctcagtgtcacaaataaccaacatggacaggtaataaaggagttgtgccccgcagaaacaaattatgacctatttctggtttctttgatttaatagtcttctttaaaagcttgaaagagcatatgtaaccataacgattcagttttagctcagtagttaagttggaatattataagtcaagagttaatccatgtgccaaggttacatgcttttgtcataactcctacctatatgctgccttttgcctttgtgccattgatatttcgagcttaattacatctcaactctccaagtaaaaactccatttctggagatctaccaattacaggttcatcttacacgtatcaaataattaggtttaaaatacagtattgctattaggtgcactggctgtatgcatgagtaacagaagatgatgtgtgtttttactgattcgcacaaccaccatgaatagctgcctattatacctgtcatgtttccatgcttttattcagtatgatccgtaagtatacattgttcgttgctgttatatctggaattagttgcgtcatctatgcatattttagtgcatcatacaatatcaggcgagcagaattaggattttatgatccatcactaaagcttcccgtagtcagtcctaccatcctccacatagacaactatttggtgcacaaacagtccatcactaaggttcaatattctttctagacttgtgattcctaatctccgtttctgaattttaccgcacagaaaccccttgcgatgcgtatccggataacttacaaagtgaacggtgaggacaggctggagcaagggcaaatcaacaattttcctgctggattgtagtttgacctgtgtctataatgttgtgatagctcttccaactgctgcaagcaaaggcgagtttttctttttacttttttctgctcttccccttttgcttgccttctagtgagttatgtacacgacttagctggttttggccattcattcttcctttctatattgtatagtagccggcagcaattaatgctacatcttcagttttggcaaaatgtattcatatggtgctgtatatcacttgaggataactaaaattttcagcctccccctcatttcaggcagcaaaggaatgtgttgtatcatgatattgttcaatgtaattatttgtttttttgggtttacgtacctgttccatggtaaaaccccactggcatattttggacaactggacattttttttggctggaaagactttataatctgcacaaaaggaaaagaaaaccatccagaattggtttattgttttatccggtggcagattatttcattacacaactatcgggctgcaatttcttgataaaatatctggaatgaggactcccgtcatctcttcccagatgcaatgcaagccgaaattgtggaatgataaccctgttaactgtcacagacaaactcatcatgaatcggaggagatgctcgacaaaatatgacctggtaaagcactcgagtctcctggccatcgaggtacatcctgtgaaagctgatccccttatccatgattcattcatcggtgtctcagcatcagcaccatccctgaatagttgcttccactgctccagtactaatagcaggactgttcagattccagaaagcctcctttattgtcatttgacaccttgccttgccccatgttttgcctgatggatggggtgcccgtctagtgtgtgcattagtgtctgtgtgtctgttcggtcatcaccactcacaagtcagtagcaagcagcgcagcacaaaatttcaaacctcctttggaacggaggatctttgaaggattttgcgggatttgaaataattactggcaaaatcctataaaaattatgttccgaaggggaccttgccctttaatccaaaacaggtactagataacgaggtagctcggcttgtttgagttcgttatatgagccatgcttgttgaccctggctggcttgtcttgttaaccctgacgagcttaaaaacctagctcggctcgttaatagtaagttctatcttgtttatgtcaacatttataattttaaatttgtctatttatcgtatactaacatattgatgccagatactttagatgtaacttaaaatactagtaagtatatagtgatcttttatactagcgagttattaaatgagtcgcttgtttagcttacaagaaaaatgaaaactagctctgctggactcattacgactatagtttgagccgacccattgtcataagcttcggcgtttttttccacccctagtccaaaatatgccctctcttaccaagattgccatgctttgcaaacactcgtcgttacaagttttcaatggaacccgccaaacttttttctcccattttggacctgagagcgcacacgccctgagcactatcacaagattagtacagctaattaatgttcatttaatatcggataaagacacataaccacactcactcaggaccagctcttcacatgctgcagtttgcaggcgataaaccctcccttgtaccgaagtgaacgagcactagtgcacgagtacttagcctgtgtctatcgctttcggccgtttcgaaacgctcccgtccaagcaataagacgagacgtggctgagatataacacgattaattaatgtaagtatcttgcagctttaatgcaggcttgaatctttgatcgatagcagatgctgccttcagtttggcggatgcgtccgccctacctgtcccggaagccaatttaattactcccccaaagccacatcataaagcacagttttagttgataattcttcgccaaccttttgaaattgtagtcattgggtataggttttttagaagtcatttgctttttttattttcaatacaagatttgtttgaaagtgttctccactggaactaagataaaaaaaattacttcagttaataaagtttctgtaactaacttgttctttttttatcactaactaacatgtactctctccgtttcacaatgtaagtcattctatcatttctcacattcaaattgatgttaatggaaatggaggaagtagtactgtagtactgtattttttttttcttgaggccaacactggtaggcttaaactggcatgacttgtgtgtttctttcctttttcctttctctctttgtcatcatcaacaggagatcctgaaaacaaaaattaataactacaagatgactctaatggttgttgcttggcaggaaaactgcgaagaaaaattagtttgatacaatcctgaaattctgcaacagcagctcaactgctcaagtattatagaaaggaagcttaaattaagcctaaatgctaaaccgtttattttcaatcgtcagaaaacaatcctatgcgtcaatgcgtgtaaactaacgatagcttgagttgtggagaacttgcaaagtacttgaagataaagcaaagagtagtgtacaagcagttgcttgctaagacaacaagaatctactattaaaacaagtacttgttcttacttaaatgtttgatcaactctaccacattggctgattggcccacaggcatttctttcagggcaaagtgcagttattccagcgttgcaaatggtggatatccatagcccataggaaataaactagtatttttgttcataaatttagcctcttttgtttagtattgcaactaccaatactaattctgcagagtaagaaatcctctatatgaagctatttgttcatcatgaacacacgaggtgatgcaatcgaacagcaaaagtagaatggaacgaattggctatgaacagattgattaatacggtgttaaaaagatgagcagaattagctctgaaaaagttttgcaaattgcaaacacaccatggaaatcagcatcaggaagccccggggcttctcctcggccacggcagccggccgtccaccgccggcgagtcgtcggaggcgagcaccggcagcttccccttgccttgccgcggccactgccaaatcttggacaccgagaagctgtcgcccttgctgccggcgccgatcttcttcccgtcggcggcggcggcggcgtcgttgccggccgggttggcgccggcgagccctctcagcctcgccctgccattgccgtcgccgtgcctccggtgtacggacacctgcaagctcgcctcggcgaggacgtactggtaggagcccatggagaagcaccgcctggcgtccaagctgctgctgctcgactcgccttcctctcgcgtgataatgccaccgccgacgccgacgccggcggcggcggcggcggcgtcgtcgcggtcgtggacggggccgaccgccctggagaggttcttgaacttgccgaggcggacggggaacacggcgtactcctgctgcttccggtcctcctcgtcggccatctcgtcgaacgcggcgtcgaacagagcggcggggta

SEQ ID NO: 61449 - DNA, 8949 bp, Oryza sativa
gaaggggcgacgtcgtcccccagccaaccacctcgccgccgctgccgcctcgcctccgcctcgcctcaccgccgggtgggagaggggagagaagctgccgctgccgctcttacccgcccctgcgccgccctgcctcgccgccgccgcctcgcctctccgccgccgcgcctcctcctccgccgccgccacgctcgcctctccgtcgctgcctcgcctcctccgctcccgtcgcctcgcctcctccgcccccgccgcttgcctcactgccgccgcgctcgcctctccgccgccgcctcgcctcctccgctcccgtcgctcaactcgccgccgcgccacctcgcctcctccgcccccgccgctcgcctcctccgctaccgccgccgcgctcgtgtcgccgccgcactgcctcgcctcgccgcgccgtgtgaaggaggagagagagagatagaagagataagagagagagactgacaggtggggcccacctattttttaataaataaattgctgactggactgccacgtagaccaaaaccaccgcggattgggttgaggggggtaattcgtccggtttgcatagttgggggtgaagaatgtccggttttgtggtttaggggtgtaattcggacaaccgcgataattcggggggggtaattcgtactttttcctttaaatttaaatattgtctagtttgaaataattagtatcccaatcccaacgcgattctgattatctcaatactagcgcgataccacccaaaaaagatcctaaaccaacacgtatcattttacccggttagtatcgtagtatcttaccatacgtatcccaatagagacaatcttgcttagagcaactccagcagagttgccaaatggctctctaagctaaaatatggtaagtttggtgacaattgcactccaacagcttgccaaccgatggctcccccactgaccaaacttgcctagccagaaccagcttgccaagcataggccccacgcggcctttatccccccctgccccatctctctctcgccacactgtttccttccccacaagcagagcgcccgccatcggtggttgtgcactcgggctgtctgtagttgcgcgtcatagccatagtcaaaggggactctgccaccgctgtatatggaggaaggggcggagacaacgtgggggcgggggggcggtggggaagacccccctacccctaatagaccattagagcccccataataccctctaaaattttaatccatatatttatagatgaggggctaatatagactttgtttgaggttgttagaaggaccaaaaggctaagaaggccaaaaaaaaaatcctaacccaaccctaaatctcacttagttgctcttggtcattttggtttagcccctgctataatttcatcctagctccgccacttgcaggaggattctactgccattgccatcatccgatttttgctgctgatgttcgctctccatttttcatctctgtgagctccaacacctctactcgtgagctctgcccccaatccacgcgtgggtggataggataagctgttgccatcggtggcgaggatgggagggtgtggcggtgggtcggctcgacggtgagagagggaggtaaggagcgacagcggagtggcacgccttagacaccgcctccacagcgttgccaccgcctcccctgctggcgtgagcaacaacagcagtagcgtcgccgccgatgtaccccatcgtcgtggttggcctcgtctcgcctcgccccgtcatcgcccgcagtctcttgcgtcgccgtcatcaagatccgtgcgcgccctgccatcattctcttgtgcactagggagaggattggagagacgatggaagaagaaaaaggaagaggagaatgactggtgtggtccattggtatctagagaggtatgtggagagtttgttggagcgaagggcaaatctaactgtaaaattttggcaagctggtcaaataggtatttagaaagacaaaaatgacactctgttggagatgctctaaagcaatatgcacccaaacatgttgtctccaactctattggagagaggtgagcccctgttgtcatgtctgccctagacttaagaaatttcacagttttcccccgaatatgaacccaagagtaggaatctttgttttcttttacttttttttaaattaatacagatataaatttataaacaaatatacatgtatataaaaattttatatacgtataaattttatattcatacgttatacatataaactttataaatatacctataaaagagctttgtatttataaactttatatgtatatttcttaattggctaatataaaataggcaaattttgctatagaacattgtgccttcacggttttagctgtaggacaccgtacgagtgacttttgagggaagacactcttaaaagttagatatttatgggtggacatgacacctattaaaataataatttccaactaaagaggagagagaaattgcgtgaaatgtcaaaaataatagtggacccacatgttagctctcccatgagatagacagaagagacatgagaggtgacatatgggtcctgtggtatttttgatatttcacgtgatttctctctctttttcggctggagtttattactttaataggtgtggtgtccaacatcaaatacctaaactgtgaagtcacgatgtcttgtagcaaaatttgctaataaaatatatacactcaaatgtgcataaagttttcatgtatatatgttttgaatttgtttcaaaacttatacttttgtatatatgttacttacggtacatctagaacgattgagagatagaagatatccagccgcgagccaggagcgaggcaggtggggcgagcgcgccgcgcattagagcagctacaatagtggactacaagccagctataaacatattttaaggatataaaataggagagaagagcacatgtgtgtatgacatgtgggaccagatactaattgtgtagtacatgtgtataggtaactattgtatgaattatctataaaattgactatagatgatttagagatagtagttggctatactgttgtcgaatgacaactacgtcacgtcgaacaacgtggaacttggatggatgttttgaacagtaaagtgatgtattgtcttaataaaatttttgggatccctccattacatagccctagggggctatttatagccttagtattggcttacaccttatagggtttatgttgtatggggaaatttacatggttactcttatgatagggacgttaacatgggtacacagtgtcttttgcatctatgggctctaatgggccacttaggccggtctggcccatggctaacgggtccccatgggcctgtcagccctctagttctcctttacataagactccagcttgggtgaaacctttgtgcttcgcgacatggccttcgccattcgcctttcgcccatgtggccctctagagccgagcctttggtcttcgcccacacgcttcgtcacatggccttcgccatgtaccttcgccttggtcgaagccgacgcctctggtttgatccttcgtcggatggatggtttcggcagggttggtcgaaggctctcgtgtcatgcctccaacatatactattaaacttgctcttaggcgttgggatgggctgttgtcattgatggcgattagcatggtggctccgcgcagattatagggttagcacggttatacttttttctcaaataatagcacatatattttcaccttatatgtaaaaaaaatattaaaatggcggccaaattttaaactttggcttccaaaccggcaaatgtcacatattctgaccggtatagtaattcatatgccgataaatcaaacatcatgaatcatttactatattttattaataatacaataaatcaaagatactaatatgtgttatatttgttttctcttctcccctcatctttatctttgtactattggttgtaatttcgagaatgattaaactcggtcgctcggtgcagagggagccggatcgggcgctccccccgcgcacccctccctccatgtgctgcatgcagatcctgggccccaccacgtctatgctcctatctgccattgcaacaaatcacccacatattttggaacccctctattaagggaattcggtttattttttgttccaccaaaaatgtttcacctagtgtattcacaatgtttcactatgtatagatctaatgttgcagtgaactaaaatactccattgcaacaaaaaaaacccacatattttggaaacccgctattaagggaattcggtttattttttgttctactgaaaaatgtttcacctagtgtacttataatgtttcactatgtatggatcaaatgtaacagtgaactgaaacattctttcgctatttgctgaaacattatttctatataagttgaaacaatacccgatttaaacgagtgaaacattttcgatctatttagtgaaacaattccgatatacctggtaggacatcgtgcaacatttaaaaataattcaataaaaagctaaaaaaaatttcgtcggaatatatccatgtgtggtcttgttttgaagatttaattgcaacgaatttaatggtgcaatcggatcatgatttggatataagtagtttaagagaaaaatcagtttaaagtagtttttacacgtaaatctggtgctgacgtcaacgcccgatttttcttcaaatcgatcgggcacccgagccgtagactcatccttgtaatttcttattatttaatgatattctttcacctattaaagatggcatattgcagcaacagagagaatagggataagtaatgtgtccatactggtagattgtatccaatattaggtagtaattatttttcttgcaaaaggacgcgcctacggatcggtcgcccgatctggggctggggaaatcgggcgctgacatcgacgtcagcgcccgatttacgtgcaaaactactttaaactgatttttctcctaaattacttatccaaatcatgatctgattgcaccattaaattcgttgtaattaaatcttcaaaacaagaccacacatggatatattccgacgaaaaaaataagcttattattaaattatttttaaatgttgcacgatattccaccaggtatatcggaattgtttcactaagtagatcgaaaatgtttcactcgtttaaatcaggtgttgtttcaccttatataaaaacaatgttttaacaaatagtgaaagaatgtttcagttcactgcaacattagatctatacatagtgaaacattgtgagtagactatgtgaaacattttttggtggaacaacaaataaaccaaattcccttaatagggggtttccaaaatttgtggtttttttgttgcaatgaaatgcttcgttcactgcaacattagatctatacatagtgaaacattgtgagtacactaggtaaaacatttttggtcgaacaaaaaataaaccaaattccctttgtagagagtttccaaaatatgtgggtttttttttgcaaaagaatattttaattcactgcaatattagatctacaaatagggaaacattgtaagtacactaggtgaaacatcttttgtggaaaaaatgggagggagaagtaggtgggtccagcagatacgcacatggggagaggggcgcgcgtagggagcgcccgatccggctcccccgcgccggtcacccggagtagagcattatcgaaaagattcgtccatgcatatgtccaatcggacatcacatgtatataacatgatttatctattatatactaaaagtccattaaatttcctgtcagggttatggataccacatacctactagtagtcgactacatctcggcaagacccaccacataccatgtcttatacggaactgacttcggatatggagggagttccagataaggaaagacaaccaaagttctacatggaaacgacaagtactcagattgtatccatattggtttccctagttctatttggacaaggggacacctatgggtataaatataaggccccctaggaggagaggggacacgaccacctcaatcaacacccaccacaatctacggaacaacagaagccacaacatacaagcctacatacggcaagacaagacgccggatatcgacttcagggataagcacggctagtctcctatggtgtctccggatactatcaggagagacgaaagcattatctctgatctcgctgggtacatattcgaggaggaagactaccctattgtcgactacgagtcagaccttcagaccgccatgtcgacaatagttagataggttacctcacatattgtactggtgtgattatggtgaataagagcaatatcggctccggccaacaggatgtagggttattacctgacaattcaggggcccgaacctgtataaaaatcctcgtctccgtctcttttacctcagtctcgcgtatatcctagtaccaatgatccccataccatgcaaataccggaatcgcgacatcaaacgtcgacagtggcgcgccaggtagggggactttggtgcttcaggatttcaacgagatgggttcaatagatggattctccaacaacaatctattcgacaactttggctgtggggagatctaacccgaccgaagtatatcccccaacgagatcggaatcatcgccatcaactagtcgatccggccagatcgatcaaattccaagatatcgtcgccgcggagtcaacccaatattaagttgctgatcaagccctccgcctgcgacatcagctagtacggctggtgtacaagcgtcagggattcatctgtacctgtgccccttgtgttgccgtgttctgctcggagttggtcaactggagtgtgcttgcttaatcatgtctcgtgcacaattatgggcacacacggccatactactacaggtcagcacgctcccagtcatatgtggactcacgtcctaatccactaaatgcatgggacttctaccagagatgttcggcataaaaaacaaagtaattagtagattaatttaaaaaattgatctactaattttgtagatatatacagcatatatctacacaggtacgcaataatctatatacaatttaccgtacctattttttctaatctatacaatattggcagatcattaatttattatgtttagctagagcgtgtttttatacaatatctattgtgcgagtgcttccgatgttaggccaactacggtctaacgctgggggctcgctctgttctcttctgtatgaatcattcttgtttacggtctacataatgcctgatatttacatctgctcgttatatcctgataataatagaagattcattcagttttttgagtacatactcgatattctctgctatatatctcgcattctagaaaatatttttcaggaacaattgagcactcgagtaggttgtggtcgagcacaccccattatcgagaacgatctcgacaaatgcagagtcgtcgcccccgacctaccaatgacctatctcatagcaccggccatggctggactattcgagaaaaggtggttaacggatacttcctcgcgaatgttgtcggcttgatcacccgacatgattgtgaacgaacatccggatatgctataaggtgggtatgtgagtcatgctggccacatgagatgcacatgtaataacccaactctagctcttccattggtgttcgagagataattctactcgctcgctggttcccgaaccagtacgtagcaatctctcgcaccgcaacctccattggtgttcgagagataattctactcgctcgctggttcccgaaccagtacgtagcaatctctcgcaccgcagcttccattggtgttcgagagataattctactcgctcgctggttcccaaaccagtatgtagcaatctctcgcaatcgcaccttccattggtgttcgagagataattctactcgctcgctggttctcgaactagtaaaaagtagcaatctctcgcaccttaacttcagatggtcgaggtacgactacagcaatagcgtagcggtcctcgcaccatgacttcggatggttgaggaacaactacgactggtcttcgaccggcagcgtagcggccctcacaccatgacttcagatggttgaggaacaactatgactggtcttcgaccggcagcgtagcggtcctcgtaccacgactccaaatgatcgagagacatctacttactggttctcaaccagttaatcgtagcgatctctcgtacatttacttctagtggtcgagttatgactactacctggttctcgaccaacggtgtagcgattctcccactatttccacttcaagtggtcgagttacgactactacctggtcctcgaccagaggtgtagcgattctcccactacctctacctcaacaaagttgatatcaggtacacaataatgccaagtgttttacccagagatcccttaccacgacgacacctagcgttgaaacctatgctattgtccctttacgccgtcttgacaaggcctccgaggaacctaagggatcttcggctgggaacgcccagagccgataaggccttgtcagatcctgtagagacaaaagaccatgtaagatctggtcgtgtaagagttctcgccgtgcgtattaaccaagccgtgtaatcggaaattgagttttccaacttcacggctcggggctaggatcagtgcttgttcaaccaaggcaggtcaagggtccaagagccttatcctccgagaacgattctccaacgagaaggctgggggctagggagagtgtatgactctacaaactgactgatcgaagtcggtaagagagaagacgctcatacacaa

SEQ ID NO: 61450 - DNA, 607 bp, Oryza sativa
ttctagcatatttcaatggatgtgattttagagtgtctagaaaataataattcattaaaacaaaagcttcccctccactataaatagatgaaacgcactatcaataacgataggcatgctagcaacaagcaaacagtgccaataccctgcataaagtcccttcagaccatgatctctccagatagaacaaccagcatggaacattccattatagtagttatacatcggagcccctggagtttgagaaatatttccttttggggcaggtaaaggccaagatttcttgggtggccttgggaaccttggcatttttccgcccttgggggtttttttttttcccaaatgacttcacatgcacatagataaagacccaagtgtatctcctgcaatgagcacaatgaagcggcataagaatttttctcgagttccatgcattccaatcagaaagcaaatttccagcagcgaaattccaatgagaatgcaaaattccatcagccagaaatgtttacattgcgtggaaaaaaagggcatacttctaaaaataaatattgatcacagttgataaaacctagtataaaaaaagttaggtaacgtcataaatatttac

SEQ ID NO: 61451 - DNA, 600 bp, Oryza sativa
tcctcatcatcctgaacctgacagatctaaaagctgcatgtagtgtcgtttgatatgaaactttggggtttgcatattgccgacgccttacgttttcacgtgcattagacccacagtaatacgttgggaatgtcacagtttcaccctactcagcatggaggtgatagtgattttcaggtgtggcaacaacagatgatgtacaagcaattgcaagagtttcagagacagcagcaggtacaacagcttgatcatggagccaggatgcaaccctcttttggtgtcaagtttccaaaggcttccccttgtccaaaaaaaaaaaaacccccccaaaaaacctttttcaactgatcaactctcggcaatgacgaatgaaatgccaaacaatgaatctacagcttatgcatggtcacatcaactacatggtagtagtgacccagggttggcaagcaattctcaaatgttgaatcctagcagtaacacaaattgggagcaatatggtggtgctcctggtgtagccaattttgtaaacggttcaatgttttcaaacactccgattcagcccatgagaccgatgggattagctgcacaccaaatgaaccc

SEQ ID NO: 61452 - DNA, 3449 bp, Oryza sativa
cggaggatcgggggcccctcggcgcggccggcgagcatgtcgatgagcgtcgggatctgcatgcagtgcgtcgtgctgaggtcgacgatgtgcacgacggggaacccctcgacggcctcgacgatggcggcgttggccgccgtgtacccgaaccggtgccacggcgtgaggtcgatgaagctggcgagctcgacggccgtgaaccggtgcacgtggagcgccgccgactcgacggcgtccgctaccgccgcggtcaccgccttgcacgccccggtcctggacgcccgcgacacgagcgcgcacaggaacgccgctgtgagccgctggttggagtccccgtccgccggcgcgatgttgttgagcacccacaggatctgctgcgtcagcgtggcgtcgttggcctcgatggcgttggcgcagtgcaccagcagctgctccatgcagcccgtgctgttgaggttccccaacgagatcttcgacgccgccgccgacgacgggaagtagccgctcccacccaacgtcgtcgtcgacgacgacgacgaccacggccgcgctcctcctcctcccctcgtcgcgccgacgtcaaggtacaaccctaaccctagtccatgcccattagggtgcagaggcggtggaggtggcgcggtgtgcgtgaactgcatcatgtagtggtggcaccagcgcggcgcaagcagtgcagagacgcgattagaaaacagcggagacgcagagctagtacactttgagcggtttgaggcacggatttggtgcttgtacaaggcatatatagagggctgtgcacttgttgctcggaggcgccacacgtggtctcatactctcatcccaagctgccgctgctagctatatactgctacctagctaagccaaattccattagaactttgggaacaacatggatccaagggagggaatggagagaaagagaagctggccagtgatctagtacaaggaatatttcagtgaaggatcgatcgagcagagatgcaactgtagatggtttgtactatctagctggggaaaaaatggcaagaaactaatgaattcttcgatctcccatgtacttaccatctacaaagaaggatatatcgagatctgagagcactgttatggtagctaattaaccagaagctaggaataattagccgatcgagatggcatgcggttctagctagctaggagccagcttgaattcaagattcaagctgcggagatttctgcttgattgtctacaagagaattttatctaggatcgatgaactagcagatcagggagcagttgggaaagcgaggagaggatagatggggaatgctaggggaggggaaggggaagggaagaagaggttacaagtcactaattatagagggaattatgtagtggtttcttggattgttctggatggccagctattcatatatttgtctatatagtaactagtaattatcaagatcgctagcatgtcacattatgaacaatattttataattactctgcttggtaaaaatatataatgcctgtaaaataatgtataattgtcaacacgccaaattaaaggttaaaatgacatctagtggcccccgttttttacaagtctgatagcccattcggacttcaaaatcattcttattacctcatctgaattatctctcattttttctgcaatgatttaagctgtctatgatagagtaattttgcttctctctaaaagatagctttgtcgtatttacaaaaggagacatgggttgtcgtgattgtaatttattcgattttctttggaaaaaaaacttaattcagagaacgataaaaaatatatgagttaaatataacaacatactgatcctagcctcctacaaaacacacatgctcgtgtgagtgtacatctacctgtattgtgttgcacatagctagctagtataaaattgtgaatataaaaaacttttctatagattaccttttaaagaaagaaagtatggaggcaaaacaggagttcgatcataattaagtatcataacctcatggaggatgacgcagatcgacgtacggttgaaccggtgcactgtacagttgcgtgtaaatatgtacgctaaggaattttatgcacatattaaatttttgtaatccgttttcaaaaaagaaaatgtaacccgattattttagagagagggagagagagatagagagatcacggggcatatcatggtgaaatgatttggtcagttcgcgttgggccctacatggaacaaagctacaactagtttagtaattagagagagggtccattctatttaatatcctcattgttgcaactggaaaacgactctttgtatggatctaaacttacgcgtccaagcactggaaactattcagctgaagaattttatagaccaggtatgctgctctgcagcgcgtagacacacacacacacacactaacaattcgaccaaattgattgatagatggcacttgtgacatataagttgcttataatagaatagtaggcttacacttcgaatatttccatttgttcttaatttgccatagaataagagtgcatttgtttaaagttaatcaagcaaatcatcttcttagttaattacccaatgtcgttatgattttttaaggctatctacataaccatatcctcgatatgcctttagttaagtgcatgttaatttgcgtgccaatgtcggtctgtgtcattgctagttgttggaaaccatcgggataaaattccaatagttatacattactacatctgtctcatagctaaaaatagatacattttagaatgaaggtaataagatttcttcactacctgtgttaatatcggtggtgctgccactactttatagcaattagatccaaaacaagaattcagatataggatcataaagtggtagaactactgcagaaacttttattggttctgcttattaaccagttgtaggcgttggtttctcagtcggaaccaatttaagagtactaatgcctaatagcataggtgccggtttaaaatacgatacttataaaactataagtaccggttattatactacaaccatcacctataaatccgaactgtgccggttatgctatcacccagcacctataaattagaatgtgtcgggtatttacttaaaaccggcacctattaagttttataaatatcggtttttcaataaccggtaccaacactcataaaatcagcacctatacctattaaaaccggtacctattatctgggaggtatttgggtaaatactatagatatcggtttttttttaagaactggcatactctagtgaaccaatgttgcgctataattaatctcagttaggacgatccattattaccacagttgtaatgacagaggatgtttttggtagatttcaaacatacaattccaagggaggtgtgagcctatcatcac

SEQ ID NO: 61453 - DNA, 1411 bp, Oryza sativa
ggttggatcaagaatgtgctaattctgctcgtttcttttgatcaccatacttgtcaactcctgacgagctgcttagctgcaattcgaggcaaatttcagaatcttaaacgaactcgaaccaaaacacaaacaccaaaaaaagctctgattcttttattcttcagaaaaggagtaactgttttgtcaaaggaaaatgcgcccgttgcaaacaaacccaaagctgactgctaatatctcgggccagcccacttcacgattatctgtcctgaaaagtttcggcccagtcacctatagccgcctataagcccactagtccctgcaacgtctaacatatctcccttctccgctaatcaaaatcaaacccatccaacgtgctgtaaaacgttagtagtaaaacgattttgctatatatttattaaaaatctgttaaatgtaaatacaatataattgtgtagtataattatatgtaactataatgctcataatttttatatatgtaactttcatataattttaaacggtaagatttatttcaagatttgtgtaagttgggatgaaaaaaataatagtgtgcgcatgggtgagaagattcggtcttacgacttccggggcgcaaaaataacattttaccgtgggatttttgaaaggtagatacaaattgtattttagttacactataaactatgattatccttgtactagtatttatgtatgtgcataataaatgtatagctagttccgtagtaaaagaaaaaacaacatctctccttcaggcgtccccaccaccccaacggccttccgcgcagaggccaacgggccaaacccctcttgtgggccgtcttgtactggcccactacgcagacagcgccgtaccgtaccgtacaagcttctcgccgcgcgcgcggtgcggcccagcgagccacgtgaacgaacgcgttaagttcatctaaggtcccttaatttgtcgacgaatccgattttcgtccttcaaccaaaaaaaccagttacaactggtccctcaactgtcaaaaccagtgcagatgaggtccctcagcggtttggatggtggttttggctgatgtggcattgacatggcacttacgtggcaatgtgagctggaaaaataataaatctcgtgggacccacatatcagtttcacccaaaaattaattttaaaaaggtggggcccacgtggcccccacctgtcattctcagcctcctcttcttcctcatctccccatctccctctctcttcaactctcttcctctcctttctcgcgacgcgcgcgacggcggaggctcggctctggcggctgtggacggaagaggtaggggcggcgggaggtggacctagctgtggcgaccggcggagaggaactgggcatcggcagcggaagcggagtctcgaagg

SEQ ID NO: 61454 - DNA, 3148 bp, Oryza sativa
attcctgcagccctgagcaagaaagagcctgcatagaatctactacagagttcatcagtgtatgcaaagaaattaacttctcagaaaactactgattgtggtgaaaggataacaataggattgtatccacttgaactgatagctagatcgaatagtgcaaatcaagccatagtgaaagaaaatgatgtacattcagattcagataatccacatagaggactattgggctgaagaagggaatcggaagactcactttcagctgaagcactctacactctgcactctcacctgcaaaagagaggatggcacacgtccgtgagaaccgagtgcgtggtgtgggcagactatgaaccttacaacggcggcaccactggaggcgcggcagagtgccgttggaaggcaggaccacagggccgtgacgggatggtgatacgagccgaaaggcatattcacgggggagtcgactgtgtgcggcagcggagacaggcttcatgacatacagatccacggcgccggcgagggcagggcgcggtggtgtgtggcggcggtagggaggagcggagcgaggagcgcgcggcggagtcagctccgttgggggcaggccacgatggagtgtgtcagcggcggggaggcgcggagcacgctggagtcagtggagcacgctggagcgtcgtgtagtcatcacgcgggggatggggccgaggtcggctccggtcgcggcggtggacctcagcgccggtgccggcggatggggccgaggtcagaaccggccgcggcggctccggctgcagggaaaaagcagcggctctggcggtggggatgcggcggcagtccacacggggaagaatcatatgctccggcggcggcagtccatgcggggaggatatccagcgaggatgcggcggcgcagcggcagaacatccggggaggaggaggagctagcgaggaggaagagaagcgaagtcttcgcgtgtggagcgatgtcttcgcgagtggaggaggagtgaagtattcggcgtggcgtggatggatggatcatgcggtggtgaaatcaagcgcgcagatggacggtagagatcgattcgagtgatttggcctgtaggattggagggggacaactgcttctttttatattagtactagtgatcgtgcacgtgcaatgcacttatgatcaatatttgattgaaccatctacctacattgatgtgtagaatgtttaaaatgttttatgtctagttgcacacagttaatcaatgttttatgtctagttgcacacaatgttttaaaatgtttaaaatgttttattgaatcttgaacaacccaattaatcaactttgtataaataatattgtaactccatagtattacaaataagcaagtgctaactgctaaggatctaacataagaaacaaaaactcttaaatggtcatctcttaattcgtatgatccttgttttcaaccattttttatgaacatgaaaaatcctagaacaatactacatgagcaaccaaaactccatttagtgtccatagttctcacaagctccatttatcctttaaggagtgtatgcctgccattctgtcccaaaggaggcttaccttgctccaaaacagatttggtccaccaaattatagttttcacagcgttcagtgtcactgacttcaaataatagagcttcttctccttaatctctagtgatggacgacaacttgcctctcgatcactactattgttagtggacgctaccaattggacaataggactcccaatatcacttctgtcaagagtaccgatccaaccagtttattgcataaaccaacttcaaataccagaaatataatgaatattttcatgattagtttgatccggcacctcaaaaacttccttcataatctacagttaatttccatagtttagttatgagccttcatgttgtctatatcggggatggagattaaatttaagtcatctacattagaagctatgaaatttgataaaaaaaattaggattcctaaggatgatggtaactaaacttattcaagataaggtggcaactggagatttgattataaaatttatattcttgacgaaagctatatataacttaaaccaggtcacaaaaaatgattctttattagcaaaaaatctactcaataagacattagacatactttggcattccaaaatacttagtagtttcttccagattgctacatttatagctaataaggaagacataattcaatacaaatactgagagtgcacaaagtgaactggagaagtaaaatatcatctggtatgaaaacagagttcacattattccagtgctaaaaaatagttcacgcattgtgtgaaaaccataaggaaaagcatttagcaaagttgacaggaaaaaatgttttccccaaacaaaacagtatcaattggggatttaaatccaaagcgtgatcatttacttcgcttcagttattcactttgtttattaaactaatatgcatgaatcaatttcactctgtttgttaaactaatataaaggagtcaccttgcatattattattccttcaagcctcattactcctcattcctttctgttgactcttctcactgcatatgcacctgatctcccttgcacatgtaaaataaattgaccgagccaagtatcaatagcatgaatccaacaaattcttgctatagagctgtatataccgttttccacggctatggtgcaccatatattcagatggaaactaagatctgaactaaattaaaaaagtgtgaacttgcctgtgaacaaattgtacaggcacaatttaaatactttggaaacagaattgtgcaaaaggaaaaatataataacctctccattatggacacctgctctgcaacgggtaattgtctaaccagacagtaaatgcaaaaattggctgagaacatacaaatagtaagcttcttggagaaaacgatcaaacaaattctgacatacaaaaagtaagcttcctagagtgataattttgtaagatgcagtgcaacattttaattacacgtgaaaaagcaaacctccagtgaaagatcgaagatactggtgctccaagactgtggacctaattccagataattcattcaggtcaggaataatttgaattgaca

SEQ ID NO: 61455 - DNA, 4932 bp, Oryza sativa
tatctccccgcaatattttaaaagaagaaatagataaataagtaaatattcatatgatatacattttgaaagaaaatcatgctaaaattagaagtcacaaagttgcagaggggcgataaagtactaaacacatatcggataaatatttatgcatacctagaatttgttggcaacaaactgctccaataaagttttaatatataatacttcatttagcaaagcgaagaacagggagactaaccaggatactacaccttagtttaacttagtagacagagcatcaaagaatgccttcatcggccattgcactgtccttttgggaactccaagagtataatattatccttcttcaattcatatccatgcaaacaacaaagatctcaattcttcagttcatatccatgcaaacaacaaagacctcaattttaatgaaatggttagctgcttgctcatcttgtccctgcaaatagtttacgaagttcatccctttatgtccagggagaggcattagacaatatacaaaatgtacttcaaggtattgctttagatcgattgcagcactgaaacacaataaaactggttttgcttcaatgataacattggtgcaatattagacagtactgatgctccctgcgtataccaaagaagctccctgtgtggtccattgaattaggatgcagagaagagatggttgacctgaattgcaagaaaggggtagtaaagggtgcttgggattactaacctgatttagggatgaaccttgtttgataattgctgttgtctacacgctcgtgaaatcatctgaaaatcagcggtagcaggattgtgaaacgccagatgtggccgatggcaagctcctactgggattgcaacgccatgaggggatacgatgccttcgcaccacggctgcaaatccattgataggggctgcacaggatcaactgaaaggatgcaaatccattgatatgttaaaatcttcaaactctacggccaatttctgattggcaattgtgaatgatcaagaaaacaaatggtgatccacaaattgacacatcacaaaaacatgtaaaataggagaaattggtattaccttagggttcagggggaacagtgttggttcctttagttcctactcaaatctgacgggaaccaatcagcgcaagatgaacctatgaagtggattgcggcgacggcggaaagggaagaaatcgattccggcgagggcatcggtggagtacggcggtgtcggtggaaggggacgaccctccggcggcgcgaacggggaatgtgaggaggaatagggcggaggaggagcaccggcgggaaaagccgccggcgacgccggaaggggacgaaatcggttccggcgaggaggaagagggcggaggaggcggaacgccggcgggagcagcgttggactgaggcggggcgaggaggagcgctagtccagcgtggtcagcgcacgctcatcgcgcgaggaggaagcggacaatagctggcagatggatggatgggcgtcgctggcggatggatggacgatctggatcaggacagaggcagatggacggtagagtttgatcgaggtgatttcacccgtaggattagaggggggcaactcctcctttttatattagtatatactccctccttccctaaatgtttgataccgttgacttttttaaatatgtttgaccgttcatcttattcaaaaaattttgtgaaatgtgtaaaactaaactatatgtatacataaaagtatatttaacaataaatcaaatgatagaaaaagaattaataattacttaaagtttttgaataagacgaacagtcaaacattttttaaaaagtcaacggtgtcaaatattttagaatggagggagtatatagatatagatatagatagatatagatgtgtactcatcgtagtgctctgctctgcagagtagcaaacgattgcggtgatgcagatgtgcggcttgcgagggtgcagtgggccgtgggccaccagcctgtggcgacaacggcctgtatgctggcttgattgtgaagcaaacaggacaaaaacgtggaggcatgggccaaggcccaaggcaagaatttccgtgaggtattagcatctgaaccaagatgaacagccctctctctctcaaagaaagagaaagaaagaaacaaccaagatgaacaacgatccctctcgaaaaataaagaaacagatgaaaactggaagacaaagcaagttgttcatctagagcctcgtgcaacatttccatgttcacgttgatcacatcccttacaagctctaattaccagtaagttttagactactagaccatgccagagaagatgactacatgacaaaccatgtcgcgtaccgtaacacttggacacagtcacaacacagatgaagcgaacacaacaatgatcaccggccagagaaaaaaaaactgaatgaacatagcagagaaaaaaattcgagatgagttcagaatctgagaccttgtcttcgtcacctctcgccatgatatatatactcttctccattatttacaactttgtagcttgctgctagatgttctcgtttgatggctcttggaagttggaaaccggcttatgtagtgatcatgagccaatcatacaactggtctcaattggactggtcaatatgatggcataggaattttggaaggaggcgagcctgcaatctgcagggactcctttcagcttttcacacttttacagttttttcagctcggagctcgtactcgcagcatcctttgttgatctgtgcttttctttttggtgggaataactctcaaatgcttttcttttaggctcgatttgcaactcaatttcaactgtaagctaatactagggtagtagggttgaacctaattaaatgaacttattcgtttccctatctgagaccatgcaatatagtatctgtcttttaatactgatgtaatgccaatatatgggacaccgctgcctatgagccgttggataaagctagccgtggcggagcggggatagattctgttctggagcgttactactacactagacactagtagtacagtggtactagcatatgaaccaagatgaaaaacaattaaaccttgcacaaagaaatgttgaggaacaagacatgaacacgggaagccagaaaatagtcaagtagttcttcagatagagatgcatcatacggcatattatgaagttccttacatgttctagtggccaagcaagaaccacaaaggacgtcacagtggaacacacaacatccgtgcccatcaacaaccgagatacacaacacgactagctacatatgaagctactagtactagataacacgactagctacttaaacgccatgatccttcccatcgactgaatctggttgatctggtcgacacgacgacgaacacggtacacatcgatctaaccgtccatatccccgttcacacgcacgtaacgctgaaagacaatgagaactactccagttagtacaaattagcgaattactacacatttacacgtgacgagagaacaaattgtgtacacaagctcacttaccaggacggtgcacgcggcgacggcgaggttgacggcggaggcgacgccggccaccggccactccagcgaggtcgccgccacgaagccgccgtagctgatgtaggcgaggaacatgccggagacggacgcacaggtactgacggcgagcagccacgcgacccagctcgccgccggcggattcctcttcttcttctcatccatcagcagcacgctcgcgaggtgagcctgcgccgccaccgtgagcagcgcgaaggcgaggcaggtcttggcgacgtcctcgccgccggagacgcatcctccggtgatgccgccggcgccggggcagacggcccagccagccatcctggacgagaagaagacggccatggccaccatgaacacggtgatcaggtaggacagaaacttggcctgagaaaagaaaaaaaacgaagcagagaagaggcaatatatcaagcgtaagaacgcattttgagacaagttttgcagagaaaatctgatcagagacgagtttaggatgtaatgaaccttgtgttcgtcaccgctcaccatgatactcttctccattgtctataaacttgctgcttgatgtttctggttttggtggttcttggatagctggatgccctggttatatatatagacggtagtcttgtgttcatgaaccaaccatacaatttgattcaattgggtggtcaatgactcatttgttggtgcattggtaaaagttttggagggtggtgactggtgaacctgcagctgcaggactactttcgagcttcactttttgagttttcgtttctgctcctctttttctcatccttatctctatgcaatgtaatatatcagattttttgctaccgctgtactgcaaatttatgaatttattagcaacatagtacaagtatggtagtggtgtgtgtatccattgcacatgactggccccattgtcacctgtactgtactcttcgggtagcagtacagtactagctcgaatccttttgtgtcggaaggaaacgataaggtttgatttcactatcatatcaagattcaagcagcgacaaaaaatggcagtctgctactactgtagctgcaaacctgcaatgcagtgcaggtgcggcaacaccatagcctcgttcccatctgtcacgttgcaatgctgcacacaagtttcaaaccaattgtacgacgggtcatggacacaagtttcatggccttgtttggatcctccgggctattaaatagccgactggagaagctgtccaccgggcgccatcacatcatcgagatacatcggcgcctccatcttgttgtcgacatccacgatgataccttcgccgccggcgttgccatcttccccac

SEQ ID NO: 61456 - DNA, 1258 bp, Oryza sativa
ctattttatggttgccggctgagtactggaatttcgttagaagaacttctaagtttaaaatatggtgcaaaacaaagctggcaagtggcaacaaccgtagactccaagtcttggagtgcaatgcgtagccaaccagacaatcaccgacgcatgggtagatcagcatctggacggacttgctagtgcttctcagcttagcaacgacgcgtgtaaattgcggccatatagcctatagcaacatgcgaactaccgcttgcgtttgcgtggacaaaaaatggttttccatttcacctactacgcgcaagcaaccaacgggccaaagcaagcagagacggtggtagtactacggtgagctgcgtgtgtgctgtgcagatgtaatgcattttttccaccgacatgaattaactaacgacatcaattatcagcgagcataattgacacccatatatgtatactaatgcatgcactgtttggtactaatataatatggttccaatttgatgattaatatcattggcatgtgcaaacgtacatgattattacatccacaaattactacatgaagccagtatattatagatatttaaatccgagtacctaggaaaataccgtaaaatattcgatggaagagagcaagatatcccttcaaatagcctattctaacagggaattcctatatcttaaaattattttattaagttgatgagaaaatccataaacgctctacggagtaccagtaggagaaatagaagtcagtttttgactatccgatatagtataccccaagagagtttttacactagttacagtttgccttgcagtggtagtcacggattgtggagttaaaaatcacggcaaaattgaagttattactcacccgtgaccgtagcacggacgtacgcacgattccctgcacctggggggggggggggggggggccttgggccacggctgttgctgttgctgttgccgctgtcctccagcacagagcgatgcgaaattgattgttccaggctggtgttttctcccaccccttcttccatagtaccatacctgcttggctgcgtgcaccgcagcaacgagtgtaccccaaaccacgttattgtggatcgatcatgagtgattagccttttcacgggaggaatgcgtaaataaatgatggataaacctgcaggccagtgtcggtaccgcatttaattagggaatcatcgagctgtggtttattattagtcgagcggaagaaaagggatttgtagcg

SEQ ID NO: 61457 - DNA, 3599 bp, Oryza sativa
ggacttcttaactgagaaagaatcatgggaactttgcaaattcaaagcaggagttcctgacatatctggaacagaaaccgtggaaggaaaaatagcgaaaagatgtggccgtttacctcttgcactagatgtaatcgggacagtcctgtgtggaaaggacaagaggtactgggagtgtgcattgtcagagcttggagttcctaccctcttgagaaggccgaagtgttgcaaaagatatacatgcccttggaatccagttacaaccatcttgaaggggatgagaaaaaatctttgttcttgttgtgtagcttgtttcctggaggacacaaaataagtaaaaatgagctaacaagttactggacaggagaggacatcttcaacgagttcaatactttagaggaaaccaggcgaaaattacacatgaggatcacagatatagaagactcttttctgctgttgccaattaattataccaaatgtgtcatgatgcacgatatagtgagagatgtggcagtttttattgcctcaagattctgtgaacaatttgctgcaccatatgaaattgctgaggacaaaataaatgagaaatttaaaacgtgcaagagagtatcatttataaataccagcatcgagaaacttactgcaccagtatgcgagcacctacagttgttactgctcaggaataactcaagtctgcatgaacttccagagaacttctttcaaagcatgcagcagctggctgtcttagatatgagtaattcttccatccattctctgcttctctctactaaagacctagcagcggtccgaacactgtgtctaaatgattcaaaggtatctagaggcatttggttagtcagtagcttggagaacttgcgagtacttagtctagctggttgttcaattgattcacttccagaacaattgggaaatctaaagaagcttaggctattggatttatcatcgatggaatcccttgagatactggagggactaatttctaagctacgttacttggaagaactgtatgttgacacttcaaaggtaacagcatatctcatgattgagattgatgacttactacggctcagatgcttgcaattgtttatcaaagatgtcagtgttctctctctaaatgatcagatcttcaggattgattttgtgaggaagttgaagtcctatatcatttacaccgagttgcaatggattactctggtcaagtcacaccgaaagaatctatatctcaagggagtcaccaccataggagactgggtggtagatgcattgctaggcgaaatagaaaacttaattcttgacagctgctttgaggaagaatcaacaatgctgcatttcactgcactaagctgcatcagtacatttagagttctgaagattctgcgactcaccaattgcaacggcctgacacaccttgtctggtgtgacgaccagaaacaatttgcatttcacaacctagaagaactccacataacaaagtgcgacagcttgaggtctgtgatccacttccagagcacaagtaagaacttgtctgcgtttccttgcttgaagataatccaactaatcaacttgcaagaaactgtcagcatttggagttgggaaggaaatccaccaccacagcatatctgtccaaacctaaaggaactcaatgttcagcgctcagaaaacttgactttgtccttgttgcaagagtagctgctatgcttagtaatcttgagaggttgacactgaaaagcaacgtggctctgaaggaggtcgtggccgatgattacaggatggaggagattgttgccgaacatgttgaaatggaagaaactgttggaaacgaaattgtcagtgctgataccagatatccggcacatcctgcagatgtcggtgactcgttggatccagaagcatttcctagtctaactcatctctctcttgtggatttacctggaatggagtacttctacaaggtcggaggtgaaatcatgagattctcctggaaatcactagtaagtctcaagctgggaggttgccactccctgaaagggttcccaatccatggtgcaagtgctccaggactgaagaatgttgagttagtacataatggtgataaaagctggtaccaaacgctgatatcacaggatgcatctttggctgaacgattcaaaactacacaagagtaatcggccggtgactccatcttaatcttaatttatgtttcataaactattaaagcttgttatgtttcataaactattaaagcttgttgaaactatttgtaacatgtactattcctccagcatttccccccttcctatagaaactatgttatgcaaagtcaaaatgttgaaattataagcacataatgatttaatttattccataaataaattatgacattgcagatgtaaactagattgaacgcatcattagatctacacatgtaaactaagcagtaaaacatgaacagatcaaatgtgcgcaacatgtcgaacacgtaccgaggtggcggaaagaccggttgctcggcaagaactactcgcggttgcgggcgtcgacgaaggcgcgcagcacgcgagcggagaggaaggcgagccatcgcggacgaacagggagcagttgcgcgaagcgcttcccaaaaaccttaatgccgccttctcccggtgcaggacgtcgaagacagaggttccggagacctgctctcccgatcactggtgcacgccggcgagcgggatggagtagtctacgagtgacggcgcagtacagagtaggaggcaaaccctagattgatttcgcgtatgttgcgtgaaggcagcggctcagtttatatagagataggtcgcctgatcaaggcgcccgcgtaaccgaaccggataagtcgcgcgtaacctatccggactccacgccgttttcacacaccgaatttttcggaatgtttccaaaacaaaacaaatctgaatttcccgcagcaaaacaaaacagcaaaaggaggctgcatctacgcaagggtgagaagccaattttgcggaccattcgacgcgtacgtcatgcacgcgcgccgcctgccctgccatgccaggccaggcgaggcgagtgagtgcgcgcatgtgtttcccctcttctctccaccacacatgcttcaagtggctaggagggcatcctcccttttaaggaggtccccctctcctggaataagcaaggcggtactaaactccacatgcatgccatcccatgaggtgggcttttgtgattttccatagaattaatcttcgaatgggccttagcccatctattaattccaacaatcccccaccaaatctcaaaatcccactgagatttgccttttccaatgtactatttatataccagcggttcgatggagactgattaaggttgaacatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcctaggtctttagtaagcttcctagaagattcacccaaaatct

SEQ ID NO: 61458 - DNA, 732 bp, Oryza sativa
  unsure (1)..(732): unsure at all n locations
aaaatttgctatattttgggatggagggagtattcgtttcagttaccggcaattgaaaaccaattcaacaatttatctctgaaaaataaatgcgagtgcttttggagtttaatctctttttgtcaactacagaatgcagctgtgtgcatgaagcttatctgcatttatgtgttttctctctttttctttgcagaccaaatgggagttctgaccatctcctgaaaaatatttcttcgcatattgggttacgaaccaagattggtgctactgagttgctgatattttcatccaagttacttacccaagaatatcaaagtatgttccatgatcctttttatgtcccatttcattataaaccatgtcatgtatccccccataactgacaatgcttggacttgttacacttgtatgcttaaacaaactgatgctgtgatgcatgcatatctcaaagttactatttggtaatcttatttgtatgaatatttttttaatttgattttttttgtgatacctgtttttgattcgtcgcagtagtttctcttgcaaccagatgaaatcacatggagtttgcatgagcatagctgtacagtccctgttaaatgtnttaaaaagtggtttgcatgtacaaatttatcatctaaccttttctggataattaccaanttaacacggaaatgtgataagttttacttttggggtggtttccgggccctgacaaaatcctataataaa

SEQ ID NO: 61459 - DNA, 10576 bp, Oryza sativa
aattctttcaagaatgctctgcaggacagcatcttcgctaattaaagccaatagaagtcattaaggcatagccaacctgccttgcagctcacgagagtacatgcatcttcacttagagagggtatagattggtactctcctctagtttactaatggtttattcttcccaggttctaattcacgggatctccgatcacatagactgggttaccaccatagtataactcacatgggtctcaaacccatctccttcgatgcattgtctatcacatttcgtgatagtcccttcgtgaagggatctgccaggtttctagctgtttggatgtaatccaacgttataactccggagtttctcaatttcctgacagacctcaatcgtcttttcacatgtctagacgatttcatattatccttagaactattcactttgacaattaccgtttgattgtcacaattcataaggatacccggcaccggtttttcaacaataggcagatccattaatagatcacgcagccattctgcctcaacagtagcagtatccagtgccgtcagctctgcttccatggttgacctcgtcaaaatgatctgtttgcaagacctccacgaaatagcaccaccacccagtgtgaagacatatccactagtggctttgatctcatccacattagagatccagttagaatcactatatccctccagtaccgcaagatacccagaatagtgaagccccaattccatagtaccttttagatagcgcattactcgcttaagcgtacgctagtgatcatctcccggattagaggtaaaccggctcaacttgctcacaacaaaggagatatcaggcctagttgcactagccaggtacatcagcgagccaatgatttgggagtattccagttggttcctagcaattctcttgttcttgcgaagcaacaagctaggatcataaggtgttggagaaggcttactatcaatgtagccaaagcgattcaagatcttctccacataatagaactacaacagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcacagaataactccctctcccccaccatggcgatagtacacacatttatctgcctcattgactgcaaagcctgtagatgtcaatgttttgtcaaatttctcatgccattgcttaggagcctgtttcagaccatacaaagacttcaacaatttgcacactttgccttcttgaccttcaactacaaacccatcaggttgatccatatagatctcctcatccaactctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcctttagcaacaagccgagccttgtacttttcaatagtaccgtcaggcctaagcttcttcttgaacacccacttgcaccccacaggtttacacccatagggtcgctctgtcacctccaaagtcctgttagcaataatggaatccatttcactacggatagcctccttccagtagtctgcatcaggagatgcatatgcttctaaaattgacttaggagtgtcatccatgaggtacacagtgaaatcatcaccagaggacttagccgtcctttgtctcttactccttcgaggagcttcactgacatcctcctcagtgacatgttcatgtgtatgttcagtttgttctggtggtgtgattggactgggaattacttcagagggttggctcaaactactatgtgcatccttcattgggaaaaagttctcaaagaaggtagcatcacgagactccataattgtaccaacatgcatgtcaggtacctcagatttaactattaaaaatctataggcaatgttgtgatgagcatatcctagaaagacacagtccacagacttaggtcccagtttgcgcttcttcgttattggtatattgactttcgccaagcacccccatgtgcgcaaataagaaagtgatggttttctcctaatccatatctcatatggtgttttgtccttatttctgttaggaactctgtttaacacatgattcgaggtcaacaatgcctccgcccaccgtgccttaggtagtcccgcggtgtccaacatggcattcaccaagtcagtcagtgtgcggttcttccttttagcaatcccattagactcgggagaatagggaggcgtcctctcatgtatgatgccatgttcctcacagaataagtcaaactcgtttgagaaaaactctccaccacgatcaaacctaagcctttttatctttctatcaagttgattttcaacttctgccttataaattttaaaatagtctagtgcctcgtctttcgtttttaacaagtacaaatagcaaaatctagtagcatcatcaatcaacatcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaaaacatgctggaaagccgagacatcaagccaaaattgatatgacataaacgtgagtgccaaacattagcctcatcatccacactgccacaaatatggttcacagatttattgcagaaatcagaaagggaaaagcggaacaggcctccgcactcataacctttaccaataaaatatccatgtttagacatgactactttattagactcaaaaaccaacttaaatccgtctctagtcagacgggagccactaacaagattcctgtcgatagaagggacatgttgcacgttcttcagctgcacgatctttcccgaagtaaacttcatatctaccgtgccaacaccatgaatagaagcatgtgacccattccccactaggacggtggaaccccgtgcgacctgataagaagaaaacaatgagatgtcagcataaacatgtacattggccccagtatcaacccactaattagtagactgattaactgaaaaaacaataggtaaattaccatacccgcttcgatctccagtgttgccaatggtcacattagcagacttagaagtctggcttgtaggtgtcttcatccccttgcgctgtggacacttcctagccagatgaccaggttggccacacacaaagcaagtcctctcatcctgattaggattattgttgttcttcttctgcttcttgaagttggtggtctgttgagctttgtatttccccttctcttgttctgggccttatgcacaacattggcactgtactgcccaccatcgcccttagacacaacatctttttcccgagctttctcctcaacatcaagagacgctatcaacccctcaacggagtattcctatctcttgtgattcagtgcagtaccgaaacttctccaagatggaggtagtttcgcaataatgcacccgaccacaaatttgtcgggtaagacacacttaaggagttcgagttccttagccatggtttgtatctcatgagcctgttcaactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcattccacaaagagagtagtggcttcctcaaattgcttctgctgatcagcagtaagaattccttaaggtttgtcagtactcacccagaagcatttcatagctgtcagccatagagtgaccctgatatgccatctcttaaagtgcacaccggtgaatttatccggcctcagtgcatcggcaaaaccagccatagtaaaatcacagcacctataataaggtttttggattgttgaaattataagcacataatgatttaatttattccataaataaatcatgacattggtgatgtaaactagattgaacgcatcattagatctacacatgtaaattaagcagtaaaacatgaacagatcaaatatgcgcaacatgttgaacacgtaccgaggtgccggaaagaccggttgctccgcaggaactactcgcagttgcgggcgtcgacgaaggagagtcgcacgcgagcggagaggaagacgagccatcgcggacgaatagggagcagtcatgcgaagcgcttcccaaaaaccttattgccgccttctcccggtgcaggacgtcgaagacagaggttccggagatgtcacgcccggaaattcactagtaatttccgaactaatttgtgcattaaatcctcgtccaggaatcagccgaggtacacaaactgacaatttaatatacagattcatcaatataataacgttacatacttacaaaagaaaagaaaactacagcggaattacggtctagcgaagctccggctccactcccacaggcagctcaactggggtataagccaaacgtcttctcgttcgcaacttgtcttcaactgaagtttgattgattattgcaaggtgagcatatgacatactcagcaagccacatagcaaatatgcaagtgcacaaggataccaaagaatggcataatatagggctcatttgcaaaagcagcatttagcaaataattgaggattgtaaaactgtaaagcaattaatcatcaatattaatcaacactgaacagcacacccatgctgcacaggcccaaccatcctgaacaaccataccctgctgcacagatctatctccaaaccaggaatgtaccattccaaaccaggagctaaattaattaccatcaattatcacattattattaatgagtagtgtgggactaatcacgaaagacattgttagacccgcccataaccgcgggcacggctattcgaatagttttactctggccaaaggtgtaccactgtacccacaagacacaacccaccagcatgttaccgtgcctggccagacacgtcaccatgttgagtgattgtgacaagacccctcgcataactcaactcaaagcagtgcaccgttcctggatcataatcacccccttataaaacaaggcatggactccccagcgacccccatgggcttgtctccgccacatctcagtctggcacaccacaatgagccttgctatacaaagtgtccagctgttgcccattctggtttgtggttagcacggttaatgtttcacaaccgaaactcgtgaaccggtccttaattgtcatgagcacgaccatcaaaaccatgtgctcacaacccaccattatcaagttttagttggcacattaattaattaaccaatcatgattagacatcgtgagctaccattatcatgtccatcattaagtagtagtgaaacattagttatcccaatcgtgtactaatgtttctaagcatggctaagcaattatatctaatatatctagttgaaccaatatataaatccaactagtcaaattataacccgaggtaatcaagaaataggataatcaatgcaaattggccataacaaaggaacaggttcacaccacccggtgacattcgaaaataaattcatagttgaaataaatagagaatttaaatataggatcaacatgctcaaaggtattgtgtttgggatctgtgtgacttgccttgcaataatcggtcttcaattaatcttcttgaatactcccgacgcacacgcgaaccttcgaaacgacggaaatgacaagctaacacgcaaaacgaggaaaaagactaagaaactccaaataaacaatacatataaagtaaacaaacatgtagatcatgattttagattaattgtgagacttgaacggcctcattccgatttcatatgaattagttatgaattttacaagatttaattccaattaaacctattaaagaaaaagactattccactaattaaatcatttacaaatgatttataactgagataaaagattaaagcaacctccggaaatagattagatcatatttggtagatgacatatgataataaggactaatatgctactgaaaagagaggaaatgatttatatggctgagattaatcttgaccgagagttgaccaaggttcaacggatgcaagcgagcctcacaagataccgacttaacgagtcaattctacgtgacacgggatcacccaaatgatcaaccgaaaccggcgaacggaaccggcggctctgaacggctctaaactaaagaacgattccacacggacgaacgaacgaagcatggggacacctcgttcgaacgaacgagcgaacaactcaacaacggctgcgactaaaccgatgggctagacacgattcacggtaaagccccggtacggcaacgataggccggtaggaatttagggatgcacctacggccagacaacttgactaccgagcaacggctaaagcggcggctagattaaagcggcacacagctgcgacacggcagcactagggcgacttggctcggctaggcggcagcgactcggcagaggcacgcggctagggttagggtgacggcatagcgatgacgacacacagctacggcagatggtggctacggtagtgggacagcagcgacttggcacgcacgagcagcagcagcacggctgtagcagggagtggcacagcgacggctaggcggctagtgcagcggcgacgctagggcagcagctaagcgtggcacggcgacggctactcgacgacaaaaacaagagattaaaaactaatccgagggaacacggatagaagtttcaccgaaccaaagcgatcggagaggaagggtcgacgatgatggtctggcgacaacacacggagacgatgaagacgcaacacttacgcagcgacgaacagcgaaggagatggccggggatgagctccgatgggcggcgaggtactgtccacggcggcgacgactttccagcgatgagcagcgacaacggaggggtggacgggcttcacttcgcagctgcgaatccaatggaggcgacggtgaagcttggcgatgacgggaggtaaaacagacttctctgcgggctgagaggaagggagagaatgggctgaattcggcccaagactaggaaggaagattttattgcttttccaaataaattaaccaatgagatgatctttcaattgttaaaaatacttccaacgctcaaataattccatgaaaaatcttgaacatacttggacactctaagtatttaacaaaattgaaaccatctcatttcatgattaatttaatatgtgaataattactgaaatgttctttgcattattaaaattaataattgagctctgaaaaattcgagaaaattccagagagtataattaatcatggagaatttaataaaaattaaatcctgccatgctttatatttaggaaattttatttcccacatttaacttcacttgtaaattaatgaacatttaatataaattctatgaacaatgtattaaataatttataaatcctgaaatgaaattcaggctgtgacaggagacctgctctcctgatcgctggtgcacgccggcgagtgggatggagtagtctacgagcgacggcgcagtacagagtaggaggcaaaccctagattgatttcgcgtatgttacgtgaaggcggcggctcggtttatatagagataggttgcctgatcagggcgcccgcgtaaccgaaccggataagtcgcgcgtaacctatccggactccacgccgttttcacgcaccggatttttcggaatgtttccaaaacaaaacaaatccgaatttcccgtagcaaaacaaaactgcaaaagaaggctgcatctgcgcaagggtgaggagccaattttgcggaacattcgacacgtacgtcatgcacgcgcgccgcctgccaggccaggcaaggcgagtgagcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggccttagcccatctattaattccaacacaaaacacgagtaaatatatactccctctatcctataaaaacaaatatagcatggaatgtaacacatcctagaaatatgaatctgttagatcccatattaggtttgttttgaaatatgaatctgttagatcccatattaggtttgttttttatggggcgaaggaagtataaatcatcaaaagtaagaatccagaacagactcctagtcctaggaccaagcatacacctacccaggttcaactcctcccttctattttttttcgataatggaatcttcattaagactcagtcaaatacaccaacaccaagttgatacattccaactaagccaccctcggcctctacataaaatgcacacagcctacctagaccttcattacgataccgagatatcagtggctatcaatccatatactagatcgccacccatgctcctgagtaaaaactcccacctagtccaaacgtcgcgatactatcgcaatagtatcccgaagacccggtttgtggaggatagcctaggtgcgaagccaccgggtgactaaagtaataacctgcaaaggagaagacaccaacttattataaaaatttacctcgtttctgtttatctaaatggactaacaaagagctgctgcacccatcaaaagaagatttgatgggtgtaatttgtaatcctttttacatatgcaatctgtaagttttataattttaatatatttacacacggcaggaacctctcctatagtttctttttttcaaaacaaaaacagatttctcatttctttaggaacacatgtaagcaacgcccatgttagaaaaccggcctcgaaatcacatcggaaaccaaaccgcggacgaaaacaccataggagatccaaacatgatgacgacaccgaggcacgatatttgataacagagtttagccgaggcctagtacatctcaggggtactgattacgagcgctcctccccgatccagcatattacagcgtatcagagttacaatgactcacggccagtatacaactccaagtcctatactgtaaccgattacgtacatatattcgacacaaacaataacaaactccaccttgaagaatatgccaacctgaatttgttacttgctcgaacctctgtgtacccgaacttgagttgatcctttttcgccgctcacgctgaactgccccgacaagcctccaccaggctcaccgtaaacaagagactctcactatccctgtaatttctttctcttgactccacctgcaacagtgctccaccgtctctcatatcaccacagtcatcttaccaagcaaaattggattccttcctagctatcacgtcgtagacttccccaagaccatgttcacctccatctaccgtcttaaatttgacttgatctaatccatgaccagataaccgatgtcatcaccaaatagataaatcaaactcaccacacatgaagagaacattttcttcattgtcgccttatgaactaagctaataaatctaacatccacgctttcctgcattcgtagacttaattcctgataatttgagaaaatcaccgttgctttgaatcatccgaagaaattaccaccatagtgcttgctctttctcttcagtgacgtatatttcatatatcctcatcatgcaaaccccgcagatcctggatatatcctgtactgctaaacaacccgttgacgctctcaacgattttcacccgttgttgcccagcaaccatttacacctgcctgacaataatatccacttgcgctgcctttcctgccttaccaatactttgacttatcacgctaccattacttcgctgcatgtataaacttagcatggtcgcatcataccgtgacacttgggattgtggacgtttatgcagaccagcgtcaacatccaacaagtgtgctacagtagtcttgactcttgaccaagttcctatgcatgaagtccatgcagccgtattggtttccacgcacagccactagtacttcggctcatgcaacgccctggattgttcttgccctctgctgttgttcgctgtgaacagtaactcggcccatggacaataacagctccacacgaacaatatcaagcccaacgagacagtggcccaagttaccagcctactgccggtcaacccaatcctttccaccagggaatagtcgtactcatcccctt

SEQ ID NO: 61460 - DNA, 1694 bp, Oryza sativa
ttttggtcttgcaatcccttgccaaaaaatttcaacccacagaaaagatggtaggaactcttccctaagggagaacaagaacccacccagatctgggcgagtttttccgtggcgcggaatcgcaagaacgctcatcaaagaggaatcgcacacaagaaacactcacgtgaagcgggtgccgatgggcttgaggtcgacgacctggaggacgatctccggcaccggcacgccggtggccgcgtccggcgacgcgttctccaggacgaacgccaccgcccccggcgtcactgacggtgccgcgtcggaatccatccccgagccgagttgaaggcttcacgcgggaagattcagctgcggcggcggcggcgatggggaggaaatggtttggagttgaggagaatgggagtgggagaggattggatccgcgcgcctttataacgccgtggtttggcgaggcgaggcgagcgcgcgggcgggaagggggaggagatggcgtttcggtgggatttttgccgcggggtttcgcgttctcctcttcttccccgcgcgcgaacggccgcgtctggtttttctttttttggctcggtttttgagctgtggcgggagaaattttggagggttttcgcgccggtggcggaggcggagtgcgagccagagagatgggccgggccgctttatcatcacgttcgcctgaacgaggtagtgggccgagactaatacggcccaattagtgagatgggggagctgcctcctcggccaggttgggttttgaggcccataagcgtgctttccatgggggcccactattcagcgtgaaggaacgacactacggcggaatcccccctaccgccggtccgccgccgctcgccgtaacctgccttcggccggcgtcgtagttgcgtttcacggccgttatttcagtctcagatcaaattggattgataagccaagcatcccaaattctcaatgtcacaatgtacaaattggcttacggcacagcagcagtaagcaacctgagcttcggcgagatcctcacgaggccagggtggtggtggggcagttgtcgacgccgcaggcgaggatgtcgcggtagtcgcgggagacggtgaagctgtcgtgcacgctgccgtcgcggctccggacgtactcgaacagcagcgccgtgtggttgaaggccgtcagcttggcgaacccgtagtcccggtcctggacgtggctccaccgcgcccgtacgccggcgtagtccgccaggctcgccccgccgccgcccaccaccacgtgcgtcgtcgccgtgaacgcgccgctgtagtggctcgccgccttcgccacgcacacattctgaatgcacacatttcacacacagtaaaacacaagcagaaaatgagagccacagccataaattcacaagaaatacacatactttacactttagctgttctcacgttctatacttctaaaatagttgtccctgtgtgattcaaattttatctcaaaatagtaggattcaattttatttcaaaatagttatcacttcatattactccctccgtcccaaatataacaacttttagcactcagaatttgctccaaaatataataatttcttaactataattctcttcctaaccaatcacaactatccactatctacttttcccacctacctctttctgaaccaatcacaatatctttct

SEQ ID NO: 61461 - DNA, 10895 bp, Oryza sativa
tcatagaaaccggccccttttcccaccctcacatgataaaaaaagtagaaccaacacatatagtatcagtataggtgtcggttgtacttaaaaaaccgacacctataatatagatgccggttttttaatagaatcggcacctttgaaaaaaaccgagccggtctctttttaccacccatagcacatccttatccaccccaccaatactatcgacatccttatccatccaccacactgcgccagccatccctctctctccctctctgatttctcttgcccctcctctcacattgcgcccgacgatgacagagttgcggcggcggccaacggagaagctaggatggcgcggaggtcctcgccaacccgggggcccttcccccttctctcctcctccagggcggctcagcggtggagaaggccggccgatgcggacgaggaggcggctcggtggagaaggctagccggggcagcggctgacggctggaggaggctcgcccctctcgccctcctctgctcgtgctcgcggcggcgcaggtgaggtagaggctggcgcggagcgcctcgccccccttcccttctcgtcctgcacggcgtggggttgcggccgacgcggcgaggtagtggcgtggtcgctggatctcgccgaccccccctctcccgggggacctcccccctcctccagcgcggtgttgggtggcagccgccgtcgcggaggccgatgtggcggcgcggaggcgggcacggctaggtggtggtgtggaggccgggcgaggtggtggtggcggcggtggtgtaggtgccatcgtttttttaattagtataggtgccggttttagaaccggcaccaataagattgaggcaaaggtgccgaccaataggtgccggctggaaaactggcacctatagccaattcccaaccggcacctatagagatttctgtaccagtgactatctatactggaccaactagcaattctaacaagataaagcaaagcatgtaagtatgtcacatactcatccactagcaattattactattctagagtatctggaaacttatgtgcaagtatgacatatcatctagagtataatgttttagagctcaacatataatgatatcaaattatcttccttatatcatttctataatatttagggcctctttgactcgcaggattgaaaaaaacagagggatcagaaaaacacgggattctaataggaatataattcaagtataaaacagaggattgcaaaacgttgaaaaaacacaggaatgagtgttcgattggactgtaagaaaaacgaatttcataggatttggaaaaccgcaatcctttgaataaaatggtcacatagaaaaaattcctataggatttgaattatacgaaattccttcttaattaaaatcttttgattcaaaggacccttaacatatattcgtacgttcgaaaatcatgaaatggttaatgtgggagttacaacagctaactggaatatagagaaaaaatttctcgcatcaaaacattaagaggccccaaagctcgtaggcttcttcaataatttgctactccctccgtccaaaactatagttatttttagtatttaaaatttatcttaggatataacaacctctttaattatatactccctccgttttacgatgtaagactttctagcattgttcacatatatatagatattaatgaatctagaaatatagatatggacattgcttgaaagtcttacattgtgaaatggaggaagcattctttaaccaattacaacctctcactttttaattttatcactttcttactacctctgttttttaatagatgaagccgttgacttattcttatgaccattcgtcttatttaaaaaatttacgtaattataatttattttgttatgagttgttttatcacttatattactttaagtgtgatttatatcttatatatttgcataaaatttttgaataagacgaatggtcaaatatgtgagaaaaagtcaacggcgtcatctattaaaaaatagagggagtatttaatacctatatccaggggcggagctagtgtatattaggggggtgcccaggaacccggtcaaaaaatttttttagctacatcttatctattttcaccatgtatgcacccctctcaatacaaacttaggcacccgtattagtttaaactcgatctaagataggggaaattaaacaagtggcaccaccctttatttcgctatagctccgctatggctatatccaaatctatggctatattcaaatctagaacttgttatattttgtaacaaacgtgtattagtttttccactcaacactgcgacagttagtgcaaaactaagttcgtagtcggattgatcgatcactgcatgatgcagaacgtacgttagaagacaagttccgcttgtaccgttgcacagcaactcagcaagcactgtatgccgtacgtctccgcgattaactatagatagtaccaaatgactagcccttaccttagcttgtccttccgtgtggctaattaattcgttggggggtggtggccgtacgtcgtcgaagtcggagtcggcggccggcgtacgcgcgcgcgcgcgctcgggttggcgaccggtcttgggacggggattaaacttagtcggagtgggccgagtccgagtaggagacggatggaggccttcctcctatatatcgcatcacatcgatcccactcgtcttcagatcgctcccaccatactcgctattcgctagtcctcccgccgccgccgccgccgccgagaagaaggatcgaagatttgcgccgccgatcgaggaggaggttgtgggggagagcagcagcgcgagatggggagtcccaagacgtaccaaacgtacaggatgggtcaggaacagatggacaccatcctgtcctgggcgttgccggagaaggattacgagccggtcttcactgtgatctcctcccacaccgacgagcagaaggagaaggaccgcctcctggccatcggaaccgccgccatcaagaacaagttgctccaccacaagagggggctgcaggccttcgtcaaggacaacctcgatcgcttcggttacgtcgacatcaacgacagcatgttttatccctagatgccatgtctagttattaacggacgtgttcactgtcagactgacagtaatctatgaagtttaatttacacttcctctgtttcaaatttctttcttgatatctcttgtttatactattaaataactttaatttttaagtaattattattatcttgatgatgatcgtaaaagtagaagataattgtgttggactcgataatacgaggaatggttgtatcgggatttgataaaatcaaggtattctgtttttttgtttgttagtactatgagataagtgaaaaataaattatttaataacagtggtagttcacaacttcagctagcatgagtgcagcaaaaattgctctgtttgtggcatgcatgcatccaccatgttcacatagtttgttaaggccgatttcttggatgtttgttggctgagtttgtcgtcgacgcttgaaaccagaaagatcgttaatgcaagattactgaaattacattagctgttgtaaatttgaaattttagtttatttattttttaaaaaaaactttgaaaagtgtttctttattttattcacaatttttttattttgtgaatatttttgttttaaatatagagtctcctataatttattttaagatataatccaataaataccattggcaagcattcaaatataagaaatgctatcgacaagtgtgagtttcaacaaatatcatcgtacaaacgactttttccaaaaaaaataccatcgccgttagagtttcatccattctgcaccgttaagtgctatagtatgaatagtatatttaacggtgcggaatagacgaaactccaatggcgatggtataatgactttctcatctttatgtgagcgtacttaatctttatccatggctggtttggctgaggtcttaagctcttctttacacggcaacacctctatcctttcaatcccctggtgctaattccaatttccatttctcttgattttctttaattttccttgtcaatttttctacgagtgatagaagatgacatcaccttcattcctatgatttcgtcggtcaagcccacagtagatcattccttgccatttccaactacagcagcttttctgtcggccatacaaagatgggtatcttcgtctttaaaaaacaaaataaaaaaacctcatcagcattggtttattaaggtagtgtttggattcatgggactaattttagtccctatgatattgaaagttggaacactaatttaggccctgtttagaaaacttttcagcatgtcaaatcgaatgtttagatatatgtatagagtattaaatatagaaaagaaaactaattacacatattacgtataaattgtgagatgaatcttttaagtctaattacgccatggtttgacaatgtggtgctacagtaaatatttgctaatgacggattaatttacatgcgaaatctataagttgttttattattaaactatatttaatacttgaaatatgtatccgtatatccgatgtgacatgctaaattttttcaaccctaaacagtgccttagtagtttagaaagcatgcgcaacaaaaacgagactttctcatgatctcctgcagacgaacgcagccgtttgtggtcaaggtaggagcagtgctacgaccagctcgggctcgttcgtatggtgcaatggcattgttactagcagcttcccctcgttttcctcacgcacatttttcaaatgactaaaagatgtgttttttaaaaaataaatttatatatgaaagttgtttaaaagattaaaaatttagttactgcgaatagatttttctgttttctgtgcggaaccactatgtttcaaacctgaacatgcaaacacagttgagtggcaacgtcaacggagcaacggcagctgggaagcaatttaatgccgtgtggcaacagagcaggaacggagtgaggaagcgccgtttgagcaccgtcaagctgtcggtgcagctgtcggtgaggcagccgaacggctgctgctctgcttcacgtgctgtgcagctataaagcagccggctgctaacgaaggtgtcaccaaaacttaatggaagatatcaaattaaatcgggacttcgggagattagagcaaagctggtaatattaagcatgagaggatgctagagataaatcacacaaacacgacagtagtaggaacacagtgaactacacatggacgagtacagacagattttagaaacacaatacatatagagaacatatccatgacagacatggctatgttaattattttaaacggtgcaaactaaataccatttacctgttgtaaacttcatctgcaatggtatcacggagtgtattcattgccgccgctctgttaggtacatcgttccagccacgtagggtggagcatctgaaacgatggggtatccattgtacaatgggttctgtgtaaggaaatacatgtcggagctgtcaatcctgaagttatgtagaactaatgcacaatgtatgatcttggtatggtcgtcactcctaaggaaataaggtatttccctcaggattctcactggcttttgataactccaaatgtcctttccactatgttacgctacgaactgtgcatttagttaaaagtatcttcctttccatggggcaaggctgctcccttattacccgcaaattcatccaagtggtaccaaacatgtgggtaaggtggtaggaatctataccggctagcatatcccgagtccacaaggaaatatttccctgcaccaacaaattagcgaagtgattatttctggaaaatggacactaacatttgcaattgttgaacctaaaattcaaaacataccccatggtagccttgggaaaacaaacggatagccccgtactgcttctgttaggttgatcatgcacagaccctagccacccaacatctgcaaaaatgacacggtcgtccaatccaatagcgacgaacattcctagaagttatgtggtgacggttcctgtgttgaatggaatcatccactgccacaatgcaatgaatgtgtgctccatccactgcaccagccgcaccagcaaatggctggaattcttcatcattctggacacgataatgaactcttgcaaagttaggatctaccggcttatttatgtcagcagcataaaccgcattaagcactctatggatgtacttagagacagtagacccagatcttaccatcctattattagtggccctatttgaattgccccccgccatgatgtacaaaaatattccaagtgcttccattgggcatacctcaattgatccatgaagattgtatcgattagtaagtaacccaaacagagcatggatttgatctggcatcagacggaaaattgcttggcattgagatgggttttccattgtctccatcacccattccattccagattgttgcgatacccaacgtgctgccctcacacatagctttgccttcaaagccgcaaccaacatgtccagaaaggagtcctcctcctcactgtagtagccatccttagaaccatatgatctttcagaagtgctcatgttcctatatcaatacatgacaaagtaaatcatggttaagttagaagcctatgtgctgcaatgacaaaatgattctaagtaggtagaaatcgaaaggttagttcacattattaaagtactgcaaaaaaacagtgattaaaataggcaacatattagtgcaatgcaattgtaaattaagttagcaaaccacaaaaagttagctccttgtacaaaataagggcaatcaacaaaggcaaataaatatcagctcaacataatttattcaagcactgcagctcacatagttcaaattaatggtgctgaaattgttcaagaagccactcaacttagggcacctttgaattggaggattgtcataggaatttttgaggatttaatttcctaagaaatttttcctatgaaaccctttgattcataggaaagtataggaaattttccttaggattgcattcctatagctcaatttcataggaaaataagcaagaggttcaacctcttggaaactatccttttgctttgtttgtttcctatggtgctatcaaaaagggaccctcttcatatttcttgtgtttttcattcctgtaggattaggaaaacataccacttcaattcctacgtttttcctattcctgtgtttttcctatcctgtgtttcaaaggggcccttaaataaggcctacaacaagcacgatgctcgatatgaatcggagcaagttattaaacagacatcacagggaaattaaaagatgcatcacgaacagaacatggcaccaaagcgacataagcaagcagaagcagtgctaaaacattgctgcaccatcagcaccaccattagcaccgtcgctaccatcatcgtcatgaggactgaacctcttgtaccagccctcaacatggcctgagcaggttggtggtggcggtggagcaaacaacagggggtcaggagtgaggtctggtgcaccatgcagctggatgaagtacatgcgaccctctggtgtggtgcagtcctcaatgaagaactcacacaggtacccatcacgaaacatcctcaggattgtgtggtagatgggatcctgcatgctaatcccatcagccttgagcatctccatgcatgctctagcgctcttcgcttgcttctgctcctccctcctggccttactttcattggactgaaccctcaggtcagccagcctattaaatgcatctccggtggagtccctcctggtccccttgctgttgccacctgaagagtagctgggagtcatgattctcttgccccttctgcgcggacctaaggatggctccggagaaggtggtaggagtgccaggttggtgagatcatcaacatctaagatctgagcttcttggaggaccggtggtggtgccggcctgtgtccaacaacgccagacttgttgagcgtaactatcctaccactatacactgcgtgatgctcaggaatgaacttgagaggtacattcctaaacacacggacacctctcctcacctgcagcaaagccataacaatttggattcaatatgaaggtatgaaatacaaagagggcagctaataatgtgagaagtacatgcatttcagatagacagtgcacacagaaccaaaaaaacattaaatcacagttcagctgtgcagttcaatcaagtcaaaatatgcgttttctgtcataattggttgtgccctacacataacaggtttcaatttggtgcaaaaggagcataaacttcagttagatgtatgtattatgtttagttgtgcaaggtatgcagctagatgttttcaattcagctagatgttttctattcagatagatagtgcattgagacatggtactaatagtaagctgtaagatgatttcgttagaaataagacattagcatttgtaaatttcagcagaaccatatgaactcacatatgcctgtcaaatcaggtaagtccatcaatcatatatacaaatagtttcacagatgtatcaacttcctatagtacagtcatgttaagttcatctagcatgcatatagagatgtatgtagctcttgctaagattaacgatctaacttaatctaaatatcaggaaaaacatttgtactcagatatatctctagattcagttaagtcattcattcatctagcatgtatatttacaagtaggttctgtaacctaaatgttgtaagttaacctatatatgaggcaaactagatgtactcagaaaatgtccaaaatcagttcagtcaatccttcttctctacacctataaccatgtaaatcacatatgttgaaccttgcatattcatatatattcagattaatttaagtacagccatctaagtttagctgtcagatattcatagtagttttaattagctatcctgaattcaaacaaaggtgtttagctcacttctaatatagtaagttggcatcattttgacaacctacagtgcatctatacccaacaacatttctgtatgttaactgtatgtaattatcatggatgtgtcaatacaaggtgcacttagcataaaacatctgagtacgactttctagcaatttgagtgcacacatggacatgcagaaacttacaaggatgctcagaatttattatctgtgttggcagtacagctgaccaaacatttcgacaggcagttggcaaattacagcagtcatattgtaataaaatggaaactatgctgcatgtagatgattaagtaatgtacagctgcatagtttgacatatctacatatggtcagaactaacttaagcatctgtacagacagcagtgctgtaaatctcatatcttaatgcatgtagagtcatatatatgatcacttgaaatcagagcaactggcactactaatatgttatatgtcatgtgataaatctaaaggcctatgttgcacatagctaatatcccaaacaatgcatgaattttgtctggcctcatgcgaaacacattatggcactgagctgcattggccattgtctccatcattcactgcatccctgcctgttgtggggcccgtcttgcagctctaccttgctcatgggcttccaaatcagctaccaacatgttaatgatggagtcttcctcatgatctgcctctggctcaactctaacttcctcaaaaccgaaacggtttggtgcacgagcagtgcgacgggggcggctagccatctaaactcccagaaaagggcaaggtaagaatcagataagtacttaaagaagccaagaagcaaagtaaataacaactcaaatagcatacacacaggcataaactgaatttctcaaatcataaagacacctgataaaacgggtgtggacaagtcacagatctacgtcgagcttgactatacgcacaccacctaggatatccagactaccatacaacacccacatcaaacacacacacgcactacctcgccacgactccaaaagagttggcagcggaacaaaagggcctaacacccgaacaactgctaaagactgcctcctctactcctcgcctgcctagctggctccagtggtcggctcctcagtcgaagagacgtagattggcgcactcgaagagaccagcggaacctatcgagggccggcagcagcacgggcagctggcggaggggagctaggtagtgaaagtggaacacagtggaggaaccaacaacatgcttccgtgcagtgcggataaagcgtgggccacggcgagaggaagcaactgggtgtgtgtaacaccctgaaaatttgaccaataaaaacaaaactctaaaaatgcggaccttcgaaaactttttaaataaattgcatcatgccgactttatttgcctattccattgaattttgatttcgaagtttgttgatcgcgaataaagaataactaattaggaataaaccctaaaaattaattgggctaaataaataatcggaatacaatttaaaataaaggttgaggtgaggatagaaatgaataaaatattatcgcgatcatatttgtttcaattaaatctaaatagacggaatgagaattaactctaattaaaatcaagtaaattatataaaaataaaatatgggtacaattaatctttaatctggagtggatccattggtttggataatacacatattgagtaaacttcatttatgcaagatttataaattatagaatcaaatttatatgggaaataaactaaa

SEQ ID NO: 61462 - DNA, 2113 bp, Oryza sativa
  unsure (1)..(2113): unsure at all n locations
atgcgccnttgagatacacctcggtacccttaatgcacataattgcgaagtcaaaatgggatcttatttatgtatcaacacatggttttgttgcattgatcttacaagtcaaggtcaccaaactaacaaaaccagcaacatacagcatccaagagaagctagcaaaaattggcttaagcatcatcagcactctgaatgtcgtgcagacaagtgcccttgccctgcctgatcacactagcttctacaggattatatgtcaaaagaaaaatgaccatcacgtcgacatttgaaccaccccaaaagaaaaggaactggatattgtacatagctcacactgagaacattgagcgatgaactgttagcgtaatggcattgagctgatgcatcaggtcaggcaacattctctacctgcactcaacttgcattggagtacagaacaaactaatttttcacacagcccaaaacggtttctgcccagaaatggaagttgggttccctccaagcacgctattcgtctcatcgatgttgtcctcttcatcgtcatctccataatccataagcttcagcagagtatctgcaaatgaatgccaaagaagttcagtaaagatggattggttctgtcactatgtagaaaacaacgatattatagtgttccaccattaccagaaacagatgccccaccaggtttgaccactctaggctcctttgaaggtaattgtgctgaatacaaatttggtggtgagactgaactcacgtccaaggatctcggaggtgccattggcttgtttaaatctgaacgcctatcctcatttcttgacatctcatttgaaggaaacttaggcggtggcggaggcatgctcttgggaggtgggggtggcatgctcttcggaggtgccattggcttgtttaaatctgcacacctatcctcatttcttgacatctcatttgaaggaaacttaggtggtggcggaggcatgctcttgggaggtgggggtagcatgttcctgggtggtggtggtggtggcggcagcatgttcttggatgcagatggatgtgcagaaacatgcggttgatcttgaagaagcatcccatttgatccaggctgaactttaattggaggttcaatcgatgaattggtcatgttacctaaaccgtctaaacctgtcttaacaaatttggacctctgttgtgagttctggaaaaatgaaacaaaaagacttctccatcaaattcctttgcattagagtaaatagtacacaatgaaatacaaataaaggatgaaatcaacaaaatttgtgcataaacagcacaaatccataaattgaaagcattatgactggtaagcatcatacatggatatcagttaaccatgcagagttatagagattaacttacatctttctaaagttcatataactaaagagcataacggaaacttcataaaaagtgtctacaaagaaataaagcaaaaggtactgcattaatactattgtttcattaggctaagaagtttctgcttttctaggactacttgtgaatgtcactgagtgagaactctttaacgtgcaaaactttaatggttgaacctatttctccaactgaaaaggaaggaaaaaacttgaccaaattgtacctaaacctattaagaaactaccaaatttcaaattcaaggaatggtaaaaatgcagtcctttacgaagtcttcttgtgggcatcaacagcttgaacacaaagggttagtaacaagatagtacaagcagtcatccactttagaagcagaagactgtgccttgctaattcaatttacgggttgaaaaactcatgtagtatcaaaaaatacaagcaataatccaattcagaagcagaagactctcgtcagttaaactccattggtgaaaactccagcttgtaacaagccctgtgaaaaattcacattctattaccaccctgtgagcttcagacaaggtcagagaaaatacctggaatgaaataaaacgtcagtagcagataaatcagtcttggaaaaagaaaaaacgtgccaatctggtaaacattgaaggaccactatgaaaagaaaatttcacatcacattttgaatcgtagattttctaga

SEQ ID NO: 61463 - DNA, 11333 bp, Oryza sativa
attataggtgtcggttttttaagtacaaccgacacctatactgatactatatgtgttggttctactttttttatcatgtgagggtgggaaaaggggccggtttctatgatggttttttagtagtgagtcaacgatagcacggaatggtgatggttgaatgcaataaaatctccgaaggaatggaagtatggaactgagactccaatagaattctgccgaaaacttcgaatgaaattctaaattaaaatatgtaatttcagccatattctattttgccagtagcagtattatacgtcggtctacatgtacgaggaaaatggagaaatggtggaggtatagaaccgtaggagtagtttgtgtacgtaaggaagaggtagaaccatgaaatttcagcatttgtttaaggaatttctcaaaatttcagatatttgaaacctttgcatatgcaacatatataaatatcatctctatacacattacaaagagatcataattaattgggaagtgtataccgatcgcaaagaatcatttgggaatgaatcagctataactgccgggagaatcttgtatatgctgatctacgtattctttaagataaatgtgatatgatctacgtctgcataatgatgcaggatcgtatatgctaatgcttgttgcttcagaaaaaggtgtgaccaagacgaaaggtgcagtacgggaatcagaatgacaaacgaagtgtggtctcaataatagaactaatgagctatgtattagtcaggaatcagcatatatactctcaatcagtatactgccttgtcctatacatatatagattcgttcctacggaaatttcggttcctaacagttgacggtacgtcaaccatgcagagtgctagacgacctaatcgattgatggatattgaagatatatatttctacaagaacgattattggcagagtgcaatttttttaaaaaaaatggttgaggtactatagctataggagcagtatcggataataattgatcacatatcgctatagcttagcgtatatacatagagtacgtgacttacatatcaagtcaagtggtcttatcttatatagaaataaggcctgtttagatcccacctcaaaatttttcaccatgtcacatcgaatatttgaacatctacataggctaaaaaataactaattacactgattgtgactaatttgcgagacgtatcttttaagcctaattgtttcatgatttgataatgtagtgctacagtaaatatttgctaatgaaggattattaggcttaataatttcgtcttgcggtttactaatggattctgtaattatttttttattagtgtccgaataccccattcgacaccctatataataccttacgtgacaagccaaaactttacacccctaaatctaaacaccccataaataacaaatatatgagagagcatataagtaacaaaatatacaaggagtgcattgatgtgtgcgcacgtgggaaacatatcctatgcacgccagctggtaaatgttatcgaaaattttagaaaatattgtacacgtagttctagtaaagtctgtattcaaattcactatatttggtcgtagaaaaagaacaaaattctgactgaattatattattaaaactgtcataattttgtatttttcaggctaaaatataataagtttaaatatgaaactttgcacataggtatagtgtaccattggaagaacatgcataattttttatatgaatttttcataacatttgctagttggtatgtacagcatgtgcgctgaaagtttgtgtttataagtctataagatacatttgccgtgctatgagtgcgtcttgagtaagtagacaaatatgaaaccaggtataaattctaacagattctaacatatctcttgtagtctttctatgcaattcagctgatatagtgtctatgcttcttgtaaacgcctagtgaagcaacctccctcgcaacaaaagaaaataaagtaaacttgtgcttcgaaacacaagattattagttttatgccgtgagctttgaatttttttagttcaacttttcttttcttgctttagtttgttcgttccttacagcattgcaagaacactcttttgcctaattgcatgcatgcctgacgatgcttcccatgcacgcctagtacgtgttttacacagcacgttcttcataatcatagctcttaaggattcagtccaaagttaaacgccgagttgatatacgtcttttaaccgaaatttaggagcgaattttaaaattgatttggagatgttagtaagatttgatccacggaacacgtatgtatatatatatatatatatatatatatatatacacggcaaatacttctactgcatgcaaattaaccaattagttaagtgagcatttgctagctagtttcaagaggaagaatgttttactagtccttgcaaatatctctacctctcgtctccaaggagaatataaggaagcttttttttttctgtttgtgtttgaacaaatactgaaccgaaagtctgataattaatctgattaacgtgcatgcacatatatacgagctgtgagccgaaagaaaatggttgattatgaagtacttccttcgtggttaagaaaaaatgttagttaattccgccaaagaaaggcaagagtgaaaccattctttttgtctctttgacggtggaccaagattccagttactatatagacaattccaatgcagtgcatgctaaggcatatgcatccttggttatggcatgtttaaacatagaggttatatatatgactttttttagctgtgattagtcaaactgtttttgaagaaatgtatgtttcgtgagtaatgccactaatatgtgctgttataaatgctattcctttgttattaattccataaaatccatgaataaaaatgtcagttgttctaatttgacgacaatacaagatatgagacaacattatatgtataattagcggacccgccaattaatatcatccttctcaaaaaaaataaagtttgcaatccaaaaataatctgcaagcaaggtataagtaacctttcaatgttgttggcccctttcaccggtttcaatgcatgtgttgtgcctgcattgagatgcacttgtgtgttaaggaaaggaggaaactagtgctgtgctggctagtcattttataagttcataggtcgtcttcaagttggggtcaatgggaggaacaatcgagaaagcgacctccaaatacttgcagtattttatgacggattattcctactaatccagctcccctgatcctggcctaaacactgtctctataaatagaacaaggccgtgcaacaacttgatcacaagttaaccaggtcatcaccaacatacaaagctaacaccactagcttagctcgcttggtctcccaaaggaagaacatatatggccactcctctcaaccttctcattgctctcctcttcatcgtcgtctccgttcaaggtaaatcttgtaacacaaagagagattatgtgttagtacaattgaagtttcttgttagtataaattaatttaagtttcttaatttcttttgatgtttcaaaattccagtgtaaaaattatttcaacttagatatatgacagatggcataacaaataatcatccatctttattgggacacttatcttcacaagtgaatgattcctctctaacccctagagctagctagttttagtcgttgtaagcacatcttatatatgcgaataattgcaagacaaattaatagtagttatttttctccagttaattatgcatgcattttccttatactaaattgttaattaacatgaattaatataataatattgagcttgatcgatcgtcatgatgatcagggacaaatggggccgatcgctgcgccgcgtcgagcagcatcgatgtgcagaccatcaacaccggcgaggccgcggccggcggcggcgacacggtgttcgaggtgcaggtgaagaacctgtgcggctgcagcgtcagggacgtccggctcgacggcggcggcttcgcgacgacggtggaggtcgacccggccgtgttccgcgccgccgacgacggcggcgactactacctggtgaacggcggcgggccgatcgccagcatggccaccgtcagcttccgctacacctgggaccacttcttccagatcactccccggagcatggaggaagatcagtgctagctatagctagctacatacacttgggtacatatgcaaagttggagggaataatattcttgcgtgagctaatacacatgtgttgcagtgttagctagtactatatatactaatgttccatgaaaagctaggtcaagtgtggaagaattattcctgcatgggtttatatatgtgtagtacagtggtctaatgtgtactgagtgagggatcgaatattacaaaaaaagtttagctcaataatgtatacggtcttttgcatctcaataaatggtttgtaattgctagttactttccatctggatatttagaaagttaaattgtatcttgtgactaaaaaggttgattacaattataagttcctagaaatttaaaagagattttgcctgtcataaactcaagattagaaatgaaacgtaaggggctatggacagggacggatccagcgtgggcgttagggtactcaagtcctctctaccccgttgtaccaccatcgagagaaggggagataggaggggaagaagagaaagaagaaaagctggaggaggaaggagataagccgcccccatctatacatttcttgtatctgcccatgcctatggggtatagctagctaggtagacacatgaacaaatctaagacaaatctgtaaagtcttgtgtagtttggaggggttaaaagggattgggggagcctctctcatagggattaaccgaacatggtctaaaacggtacacagaatcatttgattggacttgtagggacatgctattgagttcccttccttgacgtgtgtatccgggctcctgtgaatgcacggtctagcggtcccgcattgtagccagccatcagggtattgcttgtgggcgggtaatcgctttcccgatctcctcctagcgatcacccgtccctcccccctatacgctcttcctctcccccttcctcctccccttcttctcttcctactacaatacaccataatttttttttaaaaaaaaacaaagttggaaaatttatgtatagaaatactatatataaaaaatttaaattcaaattcaaatttgaaactggtatgtaaacttttaacttataaactttgggtctataaactaatatttgaattcaaattcaaatttgaatcgggtatgtaaacttttaacttataaactttgggtcaataaactttaggtatataaactttagatgtataaaaatactatatataaaaaatatttgaattcaaattcaaatttgaatcggatgtaattcaaattcaaattgaatcgggtatgtaaacttttgacttataaactttgggtctataaactttaggtgtataaactttagatgtatagaaatactatatataaaaaatatttgaattcaacttcaaatttgaatcggatatataaacttttgacttataaactttgggtctataaactttaggtgtataaactttagatgtatagtaatactatatataaaaaatatttgaattcaaatttaaatttaaattgtatatataaacttttgatttataaactttgggtctctaaactttagatgtgtaaacttgaggtgtacaaactttaggtgcataaatttactaaaataggaaagtaatgcggtgtcaaaaaagaaaaccatgtggaggagaggggggcgtgctaggggcgatcgatcgcccgttagcaatctcgcagccgtcatgcctatgtcctgattctatttgtattaattggtttgtataaattgattatagagataagacaagtgctaggctatatattgtaacattgatctctcaatcaatatcaatgcgatgaatatctcgctaacaatacccatagtgtcgaacctagtagatataatgactgctcccctattaatggttgtttctgcctttattgacttgacctcgctgatgtctttgccctctagatatatgtagggaataaaagcagagcagatttagataagtagtggttataccaaatcctataccatattttaaagcggatttagattaggtgtagatgatgtgaatatgcggatgcagagcgaataattccggatgttggaaatggtgccaagtcgattagaacttagctcggaaatagattaaaattgtcggatgttgcgtatatatgcaatcaaatacaacatcaaattgcttatcgtcatcaccacattggatctcacatcatcactaggttggaacctacactatagatgggccgggccgggcaagcatgatgggccttcgtgccttcgggtcgacccggcacggtccgagtagtattgggccatgcctgggccgtgtatgccgcccgtgggctggcacgacacggcccggtgcgtcagtcgggccgtgccggcccgacaagcctcgccccaggcacaggcacggccgggcttgggccgtgccgtgccgggtggcccatatgccatctataacctacactactacaaaatcaacttttgcataccgtcaaaaccgatttttgaaggtagctgggtcacccgcatgcactcaggtatttgcaaaaatcggatttttgcatgcggggagagcaatcgcatgcgaaaatccgatttttgcatgcttaagccgtccggttgcaaacatgaaaaatcacaaaaaataaataaataaaaactccgaaaatcgatttcctttagccccaaaaccctaaccctagaatccagaagtcgccgtcgtcaccgtcctcaccatcatcgtcgctcgaagccgtcagaagatctgggtgagtgggggggtggagagacgataggatccgcatgggaggggtaaggggcactggatccacacctttcgtcactgctaccgctaccggagcctaagctcgagctcgcaatccttgcctactgaaagtgcatctaggccccaattgttttgatgattaatgacaatacgattagagaggactaacacgtttgtttacgtgaatgtgaaggattgttagtccgtgacaatatgtagcgcaatacatatctcaatgaatgtgataattcatgagttgcggcaatgatcaaaggttatattgtacattttcaattcttcatgtcattaagagggattatgcattgacatatgaggagtgatgaatgtgctcaaaatcaatttttaaaagtgtttctcctcagtttctgtgttctggaaattttcgaagttgtctgaaacagatttttggaatttccaaaaatagacataaacaattttagcttctagaaattttcggaattgtccgaaaagtgattttttggaatttccgaaaatgaccgagcagcaaaataagtttctgtaaattttcgaacttgtccgaaactggttttcggaattttcgaaaatggcagtgaggagaaaatgtttctgtaaattttcggagttgtaggaaatcaatttccggaatttccgaaaatgtctgcgaaccaaaaatgcttctggaaatgttcggacttgtccgaagggtattttcggaatttctgaaaaatgtccagaaggttgttttggttctggatatttttggacttgtccgaaaagttttcagagtttccaaaaaatcctcagttgactttactatttctctaatctagaaattttcggatatgtccgaaattaattttcgtaatttccgaaaaatgcaattattgtgcataacgggcagatctggagctatggctataaatagcccactcgctccacttgtgagggttgctagactgattggatatttcgtgccaggcttgttcatcttaagattcacttttgagccttgctttcttgtgtcccctctctacttgtgtttgactcggatttggtttttgtgtgagagttgtggattcgagtttgtgtgagtgcttgttgttggcttcgtgaagatttgtgagcacttgcatcatctccggaagttctttgcatcatttgttactcttggaggttgaggactcctagacagctagatgtcactctcgagccaccgatctacgtgtggttggctgggagaagtttgtgaaggtcggatctcacatccgaaagggaagatataccactaatggaaggagtgttttgtggaacctcttgaggaaatggttagcgaagacccggctctttgtgagctcctcaacggagagtagaatcccctcatggatttgaactctgagaacaactcatcttgttacaactttgttgatatctcactcctctagctttgcttgtttgtgctgctataggtctagttgctgtttgtgctagtatattcttgttgtaggcagctagatctagaatttatttgaattgcgcatactctactattttcggaaataacgaaaatcattttacccgagcctgctgcccttacccatcaccaacagagcccaagccttgcccaactgataaattggactattggatggaccaactcatgttatatggaatagatagagtggttacatgagctaacaattttcaattatttggcaaagaatctattggataatcctcgtcaataggattttatggataccgcatctacacccgaatccacaccatactatctgagtccgcatttttatcctccatattttcataaacccataccatatcctgatttcagacaaatttggagtggatcagattttatctgatctgtttggacctttagatatatgctacagtcggttcaggataaaatccaattgtcccagaagcaccaaccaaggataggaaaatatattcaaggagacaaagttgtgaaactgattgagccataaaaagaaggcaacacaacctactcaagccatccatcctcgttgcgagagtgtgaattgtttttttagtttctcctaaaaaccttccatttcacccatgtgacagatgtttatccctactttatctaaatcggcttcactagtcacttttaatctttcaaacccatcttgatttagatatgtctacattgaggtggttcgcgactccaaatcaccacaaagagttaggtgccggattgtgattagtggcatgacaaaaaaaaaagttgccaacagtcctcccgtctcacctctcctggccaccgccaaatcccctcctgccatgccttccccaatcaatgccggatccactcccgccaggcctcctctaaccgccgccggatctcctcctgccaatccataggcgacccccttctctttatccggaatctaacatgataggagcaggggttaggcacttctcgagataactcgaggtggtcggtgcaggaggggccgctcctgctatggcaggggggaagcaacgacaccagcggcaggcactaggaggggagggcccgtgcggcagcgaggcatacattggagaagatattgggctgatttggtttgaagccaaaacttcccataccaaaatattggtattttgaacagtaattttggcaatgtttgatttgctaccaatacttgtcaataccacacaaatgttgccaaaatattggcattaccaatagtttggcatggttggaaaccaaacaagcccgttattcagagaggtttgctgctttgacgggctttgatgggaatattgacggtgatggtatatttttaatttacgtaagtaccagtggtgcccacactattttctgctttattagtggcattttttttccagtacagcgattttgtaatggcatgatcaaatttaccatataaacaatgagacagagtagcatgtttaattatgcataccgatctagtgcttcccaacgaccccatagatctgtcatcatgttaccttgcctgtcaaattttattatgagaaacaaactaattaactactaccactgtttttttaatatatagcgccattaactttttgacaaacgtttgatcattcattttatttaaattttttgtgcaactatacaaattttgagtcatgtttaaataacatttgacaataaatcaataaaataaataataattacacaaaactgagggagtactggtttctagcgattgcaaacagacggcatgggcgaattagaatacaaattacttaataaaatacaaagacattgcaaacaaaatggattttgacaggcccagcgcagtggtagactgatggtgcactggtattcaacctgcaacagcagaatgtataagctcgtttggacttttgagttgaggcaaagtgcataagttaccattcaaagtttagcacatatacatattgtttaaaaaataaatgcatgacctatttgaggagaatgaatgcaagtttctagattgtttatgagaacagagaaggaacacatgtcaggagtattaaacaacagctataaaaggcatacttcagacagcttggcaacattagtgagtgttgattctggaatggattgtttttgcaatttcatctagaaaactcatacatagagttcacataaagatccttctcacactgctgttgagtaaaaaaatcagctgcgctttcggcaagagtacagcttttcatgggcagcttacaactacaagtaaagaatgacagtcccagtcttgctaatcctgtatatacaaaccattgtttctcaaaataaacagaaaaaaaaatgcatacaagaaaggaaggcaacctacggtaaacactgcagtatatgagtataaaattgaggcctctgtgacagccaactcaacggcagtgccccttatttctgaaaaagcatattatgccagaaaatggttgctgaattgaaatacagtttgatttccgttcttcgcaacaacgaattatccaccctccaacaaggagtggggatggtggttccatctgccttgaccacccttcaacaatcatccctccatgatcatggaatctgcaagagaggggcagcttttgacatgctttccatcagatgtaaatgttgttgatgtcactaagttgtcctagccatgctattgaatgaacaagctagaggcatcagaaattcgcatcctattgacagaaagcacccatataaaagacaaaggcttattggaggtgacctacaagctctattaattttttcgtacaaccgcgtacaaccatctttg

SEQ ID NO: 61464 - DNA, 737 bp, Oryza sativa
  unsure (1)..(737): unsure at all n locations
gatttagnaccctgagtaacgccttgcagncgactctagaggatccnctggtgttctgctattctttcacagtgatatcatccatcattattgctgttgtaatttcaacaaaaaactacatggtccatgccatttatgttgcagcatgtttcagtgattgcttttagtatagtacaatacctgtagtacaaaagatcctttttatagcaagataatggtatgctaatattttcccccaactttagctaaaagatactgctgagcgtatcaaagcagttgatcgtgcggcttcaatgattgaggaaattttaaaacaaggcccaaacccagaaggcactatccagagcaacggacaggtcttcccttcatatctcagtctgtttaatatatgatatctaatggattaataggcaccaaaccaaatattataagtacacatgtcataatccatctctggtattcattaaatgtgttaatacatggtctggttagttcattcataattatgttgatgcaatcttgagaaggaaaataataatccacatatatgggtggtgcttgtattattgtttcctgattaatatggaaccagttacagtgtagttttttttttaaggggagcagattaataattactacttaacatatggcaattcttgttgagaaagctaacatctttcttttgatgttacaggccgttcatccttttagtgcctcaatatttttgggttttcatg

SEQ ID NO: 61465 - DNA, 7702 bp, Oryza sativa
  unsure (1)..(7702): unsure at all n locations
agaggttattgtaattgtantactgcatgcctgcaggccgactctagaggatccccattgatttgaactagtttttcagaaattttatttagtttataattaccccattagtcaaaagaccaactgtaaatctagtgtacatattagtttttccgatactctgatttggtaaaaagacaaaaaaatgtataacacacactaatgaatgaactgtgtaatttttgcaaatattcaatgaattaggtgtacatcaccatctttgatctactaccagtaagggtcgtctttttagtactgctgctgcttgctaaggaatgcaagccatgacccatgagcattggatacccatcagcaggagttcaactccaatggcgcaagagaaaaaataacataaagactagacccatgagtattgaatacccattttatgaagcatgaatatagcaagagtaccttctcttctccgtgttggctatgctagatgaggtaaccatataacagaagaatttaataactcgttagctgaaaattaagaaataataacatgtgctttttagagaatcacatatgcttgatacttttacagcatgcaatatatatgtttcatttttccctccgtccaaacagaaaaatcctaagtgatttgcacatcagtagtggcgcaaggcaaaagtgtcatgctaattctggccaggcaatggaaaatgcatctcgaggttgaggacccttaacaaagcctacgatgagatgttgcattgttctttttttttcatttttctttttgcttggatgggtgaagagatatcgtagtcatacttgttgcaatatgactggctagagcttgtggaagaaagacctgaccattgagggcggagctagaacgaaatggggaggggtgtcactgcttgctttactctgctttaggccgagtttagactgatatgagtaactgagtttggattgaagggggtgcatatatggtgaaaatatatgaactataactaaaaaccgggttcctgggcaccccccctcttcaatgtagctcccctctcttcacccacaagtccagctagcctagcaaagttcacatttttcttctatcttgcatcatcacacgaagtgaactgcgtgatcgtcggagacatcgaatcaaaggtaaggttctgtgatgatcagcaccatgtaccaccacttttcttttttgtttttgcttggagttatctttctcatgatctgactcaaatgcactttgtgttcttgaatttctagctctcgcccattctgcttgctgccctgatctccttcaaattctagcccaaagaatggaggaccagatggctaaccttcgcttgactgacttcgagttcttcaggatcatcctgcccggatcctccaaaacgaaactggtaaaccattttttttgttgattcttgggtttctagcttcagcctagtgtgtgtttgatcgatccgtggtggtgcagaagctgccttacaagttcgcgagggagcttggggaccgagagctccgggaggcgaggctgcgggtcgccggcgaggggcggcgcccgtgggacgtgaaggtgttcgacgacgacgtcagcggcgacgtgtacctgggccgcggctggcaggagttcgcccgcgcccacgacctgcgtgacggccacttcctcgtcttccgctacgacggcgccgccgcgttcaccgtcaccgtcttcgacgagaccatgtgccggcgggactacccgcggcaccacgacgccgncggcacgtaattgctcgccgccggggncggccgccgccgccctcgctctggcatgactgatacctgtgtgttccgcctgcagagagcggaagcagcagcagcagcgacagcagtgatgccgcggcggcggtggccacggcggcggcggaaggggtcggcgacgtggcgctgtcgcagttcgccgtgacgctgcggcagtgcaacctcgaagacaagcaggcgcagtacttggtgagctcgtgcccacttcttttgctgccatttcttgttgccgattgccatgtgctagctaagtagctaaccaatccgaccaccgcccgtcggcggcggcggcgcagaacgtgccgatggagttccaggaggcgcacgagtacgcgaggcgggagaaggtggtgctgcgaatgcgcggggaggcatggacggtgaggctgaagcacagcaggcgggagcgcggccagcgcacggcgttccggtacgggtggcaccggttctgcgtcgacaacggcctcgccgtcggcgacacctgcttcttccgcgtcctccgcgagggcgacctccgccgcggcggtgccgccgacgaccacgtgctcaaggtcgccgtgcgcaaggccgacggcaccaccctcgagtgatcgatcttactaattaactactgagattaataaattaattagcgcgctctcgtagtctcgtctcgtcgtgtgtgtgtgtgtttaggtgttggttagtcgttctaaatggcccgtatttgtcttacgttaaatcgtctggtacttgatcggatggtgtttgtgggtgtgccactggcagatcgacaggtggccgagctgtgtaccgaactgctttattactctctttcacgaacaaggccctgtgtttcgcattcacaacaatgggaaacaacccaatctcgtcataagactggatggattcgtatcgcaagtgctccctcagtgttaatgtaaaccaacttaatataaaacgtgatattttatatttaaatttattgtattataaaatatctcattctatctctgatttatttattttgagacggataaagtataagccaatgttcaaagctaaaactgataaatcttgtttccgaagtttgaaatatacggacacacatttgaagtattaaacgttgtctaataaaaaacaaactgcagattccgccaggaactgtgagacaaaattattaagcctgattaatccattattggtaaatgtttactgtagccccatattgtcaaatcatggtgcaattaggtttaaaagattcgtcttgcaatttacacgtaaactatgtaattagttttttttcacatttaatactccatacatgtgtcaaaacattcgatgtgatgggtgaaaagtttttgttttagataccaaacaaggcctaagcatctagtccattttctaatatgtgtaactgtatcttctaaaaatctgaatgaaaaactgaaccatccaaacagatccaaagtgtgagagtgacacagcttaaggaacgacactgaaccgttccactccatggcagaaatctgcagactaaaaggattttaaagcccatatagcccggcccaataaaaagcccatacatctgcctggaaacgagcctgctagaccaaggcccatatagttgggcccgcctgtcattttatgtacttttcgttgccgtgttgggatgtgcaccctgatacccggaatcagttgcataaatgaagcacacgatacgacacgtccaggtcaggagaggctccaacggtcacattatcctcgctgactccgccgcgcgccgggtgctcgcctttctcccccttgcgccaccaccggcgccggcgagtcctcgtcaccggagagcgagggggtctccgccgtggtcgcctgcgcgctacgcggcgacgctgccggcttccttccgccggagtcaaccttgggggtaagggtaaggtttcccccgagagagagagagagagagagagagagagagagagagagagagagagagagagagagatttaggggttttcttctgtagtttttgctgtgatttcgtcttgcggttcttctttacatccgtggatgacacgggcagtatctacgaaagcatatgcgagttatctatcagatctggctcccccgatccccttgtgtgctagggttgatgcgcgcgtgcgatggctttggttggtgcggatttaggtatccttagtttgataccaacaacttgataggttagagccccaatgacccatgttttttttattcaaatgcttcagcaactcatgtctaattacatagcagagaaaatgcaatagaagggtatatgttatcaagaacgcacttttttggatgttttggtaggagatagcacatctgtaccttcaaaagttgttattgccctttcccacagattggcattggacgatctggcgcattgcacatgatggtcaatcgaccagaattggacttttggtactcttttttttagataatggatagaaatccggcctctataaggtcttttggtactggaatgttgttgttgccctagttgtttttcacagaaatttactataactgtatcattgtgcttgtcatagtttgctgttcgtactttataaaatttcggaactgcgggtttcagaccaggtagtttgctgttcaagaagtcatggccttaggcttcttttactagttccttttcttatttacattacaaatgattgcttgtgttagggcaaattcttggcaatctcgtcttgcttacacctcgtatgctgttggataagctcatgtggaagaatgacagcatgtgtgcaagatgctaacgtgttgtcttttccaattaactgtggtttttcataaaatttatctcattcaattcactgttcttttccatagtaaatacatgttcttctggatggtgggttagcaatttagccttcattcattatttctattaaacacatttttctagtgtataatttcttttcacgaatgctaggcaataggcatcaccacctcacaaaggtgacatttcctgatgattcccttttcttctgtttccacaccagattgctgcaaacaactccagtttctgaataaagacagtgccgatattaatggataagaaacagacctcgttaggcactcctgtctacaggacaaatcccttcgattctgactctgattctgaagtgccctcaagaccgtcaagggcacaatctgtcccagtgcgacgcacagatcaatctatacaagagctggaggactatgctgttgataaagtagaagaaacatcacgcaaagtaaatgattgtgtcagagccgctgaagcaatcagagaagatgctacaaaaacactggttactttgcatcgtcaaggtgaacagatcacccgaactcatcgagtagccgcggatattgaacacgatcttagtatggtaagttatgttgtggaacccaagtatccttgatcttcttctcatgagtattgctcataaatatgggtagaagctccatagaactttttggatgtgttagtactaaatttcagtcatcatttcaatatttcatccaaacattagactaaatttctatgcacctcaacgataagttatgtgatgttttgcacatatctatccttatctcactatcttaactcccctctagtttatgtttctctatgtcgtgtcaattgctgggctaaaccatggaggatttactaagtactattattattccttttcttgcttgtctagataattgtgttttgcttggcttgtttttaagatataaattacatgatgtattttatttctgaagttatagagattctttgccttgttcttaatctcatcagaaaaaaaaaatctgaaatccaaatttatggtctcttcagagtgagaagcttttgggaagtctaggggggctgttttccaagacatggaagccaaagagaaaccaacagataaaaggaccgatttcacaaagtatgatggtttagattctgactaatttctgggactctcttttttttttgcttaactgatccatttgagttatggcagataattctttcacaagttcagcgaaccacatggaacagaggcagaggctaggtatttcctcaacacgtcagccatctccaaatcaagtacatcgttcacctgcaactgcaatcgagaaagttcaggtctgcattcccatctaaccatgaattgtagaatgagtaatttgttctggaagtttacaccactttcttcttttaggttgagatagcaaagcaggatgatgcgctctcagacttgagtaacatgttgggagagctgaagggtatggcattggatatgggcacagaaattgaaaggtaatacttctttcaaatatttgttaaaaatgttatagaagagattgcccatttcagctgttcacttcactgttcataaaatttgatggagttatcattttgctgcaggcaaaataaatcactggatgctttcggtgatgatgttgatgaactgaacttcagagttaaaggggcaaaccaacggggacgccggttattgggcaaatgatgccatcaggttgtcgaaccacagcaactctgtttctagcagttttctccatcccatgggattcaggacttgtgagtgcgattagcagatgcgcctacttcatctggatattctgtcgtgtctgaattctgagcaaatattcagattcccgtgttgtgttgttgtatgagaaatcgtcatatacacttgttgtatgataagttgatagcttcaattacttggtgtaggacataaccaccattccccttttctcttagaatcttgatgtaatctgtactcctaaatatgccagaacgagatgagaagagaattgaatcaagcgatagaattactccagcaaatttgatgtgtgctccttgttttgtccttgaagctcatcttaggacttggcgtacgcttttgctacgtcaaaacccatgttttgcccttgtcgatttgccgcgctctcacgcttattacgggcttggtctgtgtgctcgcgcgcgggcgcggcgggcggcgcgatggcctcgggtacgacgaagccatgcggcgccgaccgcgacgttggcgtcatctcgccgccggggccggtcgacggaagaggaggcggcgggcggtggcggcgcatcgcgctgtacgactcgttcgagctcaacgcgatggtggtgcggctgaaccggctgctggcgagcgggagcggcgatggcggcggcgcatgtgggggtggtggcgccgcggcggcggcgcgggcgcgcaaggccgggagctggtcgccgctgtgcccaaggcggtactcagcatggtcaagcgcgctctccgtgggcgcggccggcaaggagacggctggtgatgcggcctgtgacagtttgtgttgcttggttggacgcgcctatgtaattttattagtattattattattattattattgctaaagttgcacgagctgcaaaactgacaagcatttgcttttgagatggatagcaactttagttgcataattacaaaacacaatcaaatcttgctaggtaggagtaatttcatcaaattggacccaaaattataacaatctgcactgagaacaccttcagttgtcgcatgtttattgcaccgttaggacactctccagactttgtttggttaatccccgaggagaaaaggatttgaagagattgaggaggattatgtgtaaaataaatcatctcaagagaattggaatcttgtgaaagggattaatcgccacgcaagcgtctctcccacctgacagctgctacactgcaacaccacatcgaccacatttgccctagtcgatgaaactgggccccacccacgatcctggcccacatcccagtgggtcgggtaagaa

SEQ ID NO: 61466 - DNA, 7004 bp, Oryza sativa
gggattcgccggggtttaggggttatggacgccggcggggtggtcgccgccgtggatggaggaggattgggtggacgtgggcaactccgcggtttggatggattggagatttgaaaatgacgggtggtggtagtgggccggggaggggacgggctgaagtgatggtgggctcttgcgtagtgggcatcactgggcggggttgggaacgtgactacgggctactgggcctaatacagcctaagacgagggccccgtttgatttgagggataagtccattttaccatcctaaactcttcgctttgtctaaaatacaccctcaaacttcaaaaccgggtatttaacacccttaaactttcagtaccgttcatttttcatccctaatggtttgtagggcagtattggtacagtaggatgccacggggttggtggcgaactcgacgcggtctagatctaggggctagaggcatcgatggcgtgggagaggttgaaagaacgggagctgggctgcagtggaagacgagcggacgggagtggaggtccgcatgtccgtcgaggcggagttcgagcttacctgacctgccccaagttgagcatgcgatggaactcggggagacaatggcgacggtcgaattttttccttgctgctaccgtggatcaatctttcctccattggacaaagttggttttttctttctgcgagctagtagaatggatcgattggttcagaatcgatttttccctttgtgcaggcattgatggactggtaagcgactcacttccgttgtttaggtgagcaatcgagtcgaagaagcagatcatctgtctcatgcagtcctacccgaatgcggcaagggaagaggacacgcagctgtagctcagagctcgagctccaggcaaggacagccacgagacagagtttggcacatgccgacagaggtggagctccacatgcgcggcggaggccgatgaggaacactcgggtctcagggaggcacggatctcaagcttgagctcacctgtgccgagataccaaaggaagggctcgggaatgtgccgctcaaccttgacctcgcctgcgccaagctgccggagagtgaggcgtagttcgttctgctccagtagagagaaggaagaaaggaaaaatgacaggtggtcctaggttgactggattgcctcctaagaaaaaaccagagcggtttggatgaggggtataaattgcatggttttaagagatgaggggcgtctaatacccgattttaaagttaagggtgtattttagataaatataatagttgaggggtgtaaaatggacttatcccgatttgaacggactattataccatggattgtctacaaattaattatttttataaatagaattttcagaaatagcttagaacaaatgctctaaatagtgcagtagaataatgatttcgaggaaatgttattttctgtgagtttttgaagttaccagcttttagtgttttttaagataaggggaagagttttgttaaaaataaaattaaatccgacccaactagggatgcacaaaagtctagaaaaataaaatagaaaaaaacactaagacaaacctaaacatatcatgttgtcttgtagcagctcactcaaatagaaccaagacaagaggttaatcctagttatttactccgaaacaacgccctcgagaaatacatgacattttgtctgccgctgctattggaacacaaggctagattgttattcgaagcctgacatcacaccttcaacaaaggaataacacacaagcagcgatgttgtggaatcattaggttttcactctggagtgattgctagtactctgtgccatcatctggatggacttagcacaatccactcacaatctgatcataaccacaattccacaaaaccgcctttagcattcgctgaccaagcaaccaatatatcagattgctaactatacagaccaagcagtaccaatgtgtagccaccaaggacaaagtactagcctactggatctgccaccaccaagcgaatgaaagaagccatcatcgaaccggactaccgaaaacatgaataaaattatcgctgaacagatcagtatggaacttattggcacaaccggataagagggtgccattgcgcccttcatcagctagaccaatatcccttcttggatcacgttcggattgatgtgatgtcctccgcattgcatgtttatcgacccaaacaaagcggattgccggttggaagagaggatcagcggtgaaggggtgtccttgctaactaccgattcaactcctccgacatccatggcgagcacggtcacaacagcgatcgaccgatcttcctgctaattcgcacatggtgttgatctctccgatctacttcatcgtggtgttgggcggtaaaaaaaactaccaccatcgtcaccaacggcggcggcggaggcagaacaggcgttgaggcagctggcgacgactagggctgctgaggctcctttggagtcacccacgggaggcaacctgagaggtccgcgtgtgccagattttactgtgacaggggtattaaggatatgttaaactagggaattttaatgtgccagatttagaccagtgcgtgtttttcgcgtcaacacatgggaattttaagagctctaatccaatgtttaaaatagcgggtctaataatttaagtaaaaattcaaggttggatggttttctttttttactctaaatttctaggatttctctaattttattagagcgtcacgcgataatgtagtagtgtttacaagacatttaatagaattttagtatataatagatttctagggtttctctaatttatttgagagaaagtttaatgtaattttagtatataacagatagatttagaagatggtttaaaagaacattgattggatatttcttatagttcttaatttaactaaatatatttatatttgggaagtaatatattttatctttatattgtagaaattcatatttgaatgtatgttttttctgtctgttttatgtacatgtatatgttttttcttccagcgaagattaggaaaattttgttttcaatcatgtacaacgtttgtacgtacggaaagaaagcagtggcatttgtaacgtgcaaactcattcgtacatgaggaagttattattttttaatctaatgatgtaaaataatggatccatcaatttaagtgaaaattaacgatgagattagatagtgcatgtggtgacttaggagcgttcgtaggagtgccatgtagcggcttaagatcgtttgtaagaagtttaatggatttttagtatataaaagattataggggaggttcattactttcgaatggtcaacaacgcaagcaactaactaacaaactaacaatagagtcataacatgcaatgcaaataatgtatggatcaacctgattaattgggtcgtcgttccattcccagccgatcgatcgcttcaaccattcgatatatatagctgccctaagcaggatcggttatttatcgatcgattgattgatgtgtggttatggccagcggtgtggtgatggtgatggtagtggtgacggcgacagcgatggcgatggcggtgcaggggagccgtcactcggatttcttcgtggagggcgaggtgtactgcgacacgtgccgtgccgggttcgtgacgaacgtgacgacggcgatccacgccgcgcgggtgcggctggagtgccggcactacatgagcgctagcgggtcggtggagagatcggcggaggggacaacggacgcgacggggcactaccgcatggagctggtggaggtggacaaccgcggtgccgagttggtgtgcgcggtggcgctgctcagcagcccggtgaccgaatgccacaagatggaggtgggtcgcgaccgcgcgccggtcaccctcgttcaagacgtcggcctcgccaccatggtccgccgcgccaatcctctcggcttcctccagactatgttagctagatacgctgatacggatacgcgatacgtggatacgaagatgtggcatttgtgaaaaactaaggatacggggatacgtctatatatatattaacaatataaaaatttaatatataaatttatgaactcttgcatggaaataagctcgtataatgtcatggaaatattttctaataattgtaattgactaaggttggtgaagcgatttaaccccgagaatgatgatgcagactgaagactgccaacttgccaataacttgccaacaggtttattccaagagtgtaatgaacatacacgtcgagagtgttagatgcattagcacttgatattccaatccgaaatttcatccgatctaaaagtagcactttgtaccaagaaaatagaaagagggacaagaagttaaaaaagaaaaagaaaatcattgctaacactagcatagctgcatgggagaggccaacaactgaatcgaccgatggaacttgcttgcctcactgctgaagtaagtggttgcctggttggagatggcgccggcggcggacggcggtgctatgcctggcggcggcagcactgcattcagcatccggtgttacgcccgcatatggcgacggcgcacaactctgcgattggcgtccgtcagcggcagcggcgctaggagtcgcgagccgcgtggggtgtcgggccatatgcgagaaccacggaagcgacgaacggcgtggagttgcaggataaagcgatgtttagttctctcgatcgtatccagaaggtatctcaacgtatcgggggagtatccagattttttttttgatttttctgaaaatcaccaatatcgccgatacacatgggatacgtatccgatacgtatccgtatccttccacgtatcagatacggatacgtagcttttgggaagtatccaggtaatgtagcctccagacccgcccactccccatctgcggtgaccttctcaagagctacgcgctcggcaccgcaccaagctactagctacctcatacagtgctccctttattattatttcctcttcttgcttttatatttatattatatccgtgcgttgtaatgggtgaaaagattctaatgataatatatgtttttcatgtataatcatgttaatgacaatgtttgtattttaatgagtggtttgtttttttataaacggtgttttttttcttgcgtgattttctcaaaccatttttttagaaatggcgtatttctttcaaatatttttttcatagcatgtttttttttgcattttttactgacgacaaaaaccatattttttctccctttttttcttttatttttttgtgttttttgcctgttttttcaaacaattattttctcgcgctttttttttgcttgttttttcaaatgtccttttttgcttttttttttcaatacaggagaatatatgacgaaataaaagccgtatagtagatggcaaaaaatcgatggatcctatccgagtcaagcatccatcaatttagtattttctctgacagttttttcaaagcgatttgttttttaatagacggtgttttttttgcacggttttttcaaaccattttttagaaatggcacgttttttctgaccgtttttttctcgcgcatttttttatttgttttatggaagatggaaaacattttttagcgtttttttgcgctttttctgacttttttctcacacgttttattgaacggtttttattttctcgtgcattttctatttttaaatagttagattagattagagatagagaagagatatatagtaattagaaatcgcaccactatgtttcgcactttccatttttttctcgcgtgcattttttattttatacgaaccaacttcttattttttaggaaccatttttgtcgtcacatttttcgcctttaaaggaatcacattttttttctctttttttctgttttaaaggaattggatctagtgttttttgcaccactttttttttgccgacaaaaaaaaccaggcgaaaaaaatttgtccgatccaaaacaaaacgggcgaaaaaccgggcgaaaaaagaaaagaaaaatcaaatctgtctgatcaaaaaacgggcgaaaaaaagaaaaggaaaacaaatccgattccacggtaaaaaagggcgaaaagaaataaaaaaggaatctgtctgattcctaaaaaaacgggcgcaaaaaaaaaccaggtgaaaaaaaagtccggccaaaaaaacgaatccgcgtggacgcagtaaaaaaagagcaaaaatattaaaaaaacaaatctgtcggagtaaaaaaaaagaattatatgcgacgtggtaaaaaaaaaatcgaatcctaatatatttgacgcggtactatatatctctatcttctctatctctgctacttaaaaaattaaaaacatttcctatgtccataataacaaaaaaagggcgaaaaaaacattaaaacaaaaaaaaagttcgattcaatttacttccgttgtccgtgaaaatcttatcttatcttaatctcaatactacttatatatatatatatatactacttaaaaaataaaagaaatttccgtcgtccgttgggaaaaaaactgataaaaacaaaagatcggaaaaaaaaagtccgactcctccaatggaaaaaaaaggagagaaaaaacaaaaaacgaagagaaaaaaacttccatcgcaaaaaaaagatgtccgactctaaaaaaaatccgactcctcggcggagaaaaataaaggcgagaaaaaacaaaataagagaaaaaaacttctactataaaaaagaaaaaaaaggtcctccgtccccgcctgtgcgatgaaacgccagcaaaaaaaaaagaaattgaggaaagggataaactagattgaagttcccaaaattaaaagaggataaacgatattgaaactcccataactcgaaaagagggaataaaatatattgaaatttctcgacaaaattctctaaattcgaagaaccctaattt

SEQ ID NO: 61467 - DNA, 26376 bp, Oryza sativa
  unsure (1)..(26376): unsure at all n locations
ttcctgcagccctgccgcttgacccgcgcggcgcgcgcccctgcccaccgcccgtcccgcgccatcccgcgccgccgcccgccgtgtgagagagatagagatagagagtgagagtgagagtgagagagagaggagagagaggagagactatgacaggtgggtcccacattttttaaataaataaaatgttaactggactgccacgtgtacgctacgtagaccaaaaccaccgcggattggatcgaggggggtaattcgtccggtttgcatagttaggggtgaagaatgtccggttttgtggttcaggggggtaatttggacgaccgcgatagttcggatgggtaattcgtactttttccatttttttaacaccataccagagtttcctgtagtatatattacaaattgatcaataatttctggttataacatttacaaggtgtttttttaaatggctacttcgttataacatggtgttctgttcatgtgaacttgtgaagtggctgagaaagtctttttagctaaaatgcagtgtgctatgttgtgaagagtgaaatgaagaaatggcaaaagggtgagacatgggcttatagttccagtgatatgaaatcgttcatccctgtcttgattcctagaagatgatatttttttccaagtagctttgatgaaatgtagcaatgagtcaatgaccaaatttgtaataatctttgtatggatctgaacaccatcgatatgatttttttaatgaacctcttgtattataaatggttgtttgcggctttttgtggtttactgctattttgatggatgtctttgtctcctatgtcacttgtacttgtgaatttgtggttatccgtagcattagtatggacatgctattattacgttgacatatgtttcatatcaaactgttatttgggtttatattcacgccctcgtgctatgtgctcaaaggatagcggccaacgtgtgccttatctatcccgttaccactcgccgctcatcttcctgcacataaaatttctaatccactttttaagttcaaattatttactccaattatgaaaatttgtacttgaaaattttaaattttcatttcaatttttaaaactttcaaccttttgatttttgtttggcaaatatttaaattagaggcctgaaaatgcatcttttaaataaatattggcgatagtccattctattaaacccgcccagtatattattcttgccaagaatatgtctgacatatgacatatattgaattaagactcaattgcacagatcatacaagaaatagtttttgctaacattatattttaaaattctttaaagagaaataaacttgcaccgtagcgtttagcacgggcatattactagtggtacaataatggaaaaggctctctaccttcttgaggtcatgttaaatggatttaacccaaatatgttttaactttgcagtgactcaattgtgaaaagaaaaattggcacgtcacacagatttatgactgctaaattcttatgaataagtgtaggcgtgtagcaactttttctagattgactgctaaatcaatttaccatcttttattggattgtcaatttttctagattttttttagatcaattcaatttttgtttggattataccatccacacagtgtatctcatatgtttgggaattggttatgcgtgttaataaaaaaaattaaggaactattttttaggggcttccactatatattgggctctttggcttagtagaaatgatatgatttttttgataaaaacactctcaaaaacttatttgtaggtacttttcaagacaacatattggctccagggttgggctcaactacaaagacatgatgatgatataaagctaataaatgatgcatgtcgtaaacttgaatcgacgattatgcacctttttaccaacttcggagggagattctcaaatactataattcagtaattgtggattcttttatcttgtgttggtgtttattagtttgtgtttattttatgttatgtcagtgcgtgctatgtgtgtttatctgtggattttgtaataattgattatagcttattgagcaaaggtcggattgtttattctattattttaaaaaaaagtatagcaaattggctagaaaataagatgcatgtgatggacaaaccagctagtaaaacgtgctttgtctcagtcgtaggcttgtagccttacgtaacaaactctaatgattggattttggatcctcttacttgcatggtaaagtcaaatgagcacagtatctatgactctggggattttgtagctgtccaattgtgcaacgaatggacaaaatatgtgctatattatccgatagaaaatttgagccgctacaggatatgtatacttctctgcaccataactacagtgaatcactttagataattgtagcaacatactcgtgctaccattcctctgccttaatttgtacctgcaaggctagtactccctccgtcccacaatataagggattttaagtttttacatgtaacgtttaatcactcgttttattcaattttttttgcaaatataaaaaacaaaaagttgtgcttaaaatactgtggataataaagtaagtcacaaataaaataaataatattttttaaaaaaattaaataaaacgagtgatcaaacgttgtaagcaaaaactcaaaatcccttatattatgggatgtgatggagggagtacaagttacgggatccttttcttgagctatattgtttaaattatgaaattctagattttgactttaacgaccaaaaccaaactgacgatagccttccagaaggcgacatttagtgttggggttgtcaacgatgggagcaccgatatcagtgatgcttatgggcgtcacacatctttttggagacgatgttagctgatgccttcttccccaacttcgtatctcggggttgactctctaagtgaaaatctagttataaatgttcagaacaatgatggcaatatctacaatgtcgtgatcttcttggaaacatacattggagatagtgtgctggtgaggcattattggcatcggattggctttgatggctatgacgttgggtaaatgactgatttacttagttaccttcaatgttattttctgctttggtttaacgttagtcactcatggtgatgtatgccaaattcgattatagaaataattgacgttgggaaaaactaaggactacatataacttgtacactgttgggcaaaacaatggttatgcagatagaagtattctttaatctttaaagtgatattcattttttaatcaaactgtgaatttttttttcatttgtagtcatttgccctgtaatttttatgacaattgattgtagtttctttaaagaaaaaccgaaataaattatattgtgttaaaaatgaaagaaacagatggcagcgttaaactccaccggggcttgcaaaaacagacggatcttgtgcaggagcatgaatccggtgcaaatctaatggtgaaagttcaaatgattcacaagaaaaaaaaatgggttgagtattgcactttcaggaaaagaaagatggcacacagcgtctctcctcaagcaagaaatggacttatttagtgatttgcaattgcacacgagatgcagtgaaaagagatgtgtaattttaacatcgagcccgtgtttaatctctgtctggaggacgtctttccctccgaatctccctttttttatttacaattgcacaccctaaagttatcgatcggagcacacgcgtgacgacgtgagcagcctctgctttctctaccggttgtatacatacatgctcaacgagctatatgtatataattggatggttagtacttcatatatactaacgtggaggatctcatcctggccggcgtcgtggcttcttggccggtgaagggctctccgcctcatcgtcgtcgtcggcctcctcgccgcaccgtcgttgctcgccggcgatctccttgatgggcgccacgtttaggtcgaaagcggcgcccacgctcgccgccgtcgctgcactggagaccgtcgccgacaccgatgggccatgcaagtagtggaacctcttgtgcccgcccagcgcctgcccggtggcgaatcctcgccggcacagcgagcagacgtgccgccgccgccgcccgtccgcctccgaggcggcgtcggcgtcggcggcgacgcggcctgatgatgccggaccagcagcaacgacgacgtctctgtgcgcgggcggcgccgccgccgccgccgatggcttgcggtggctcgccttgtgtccgccgagcgcctggtacgacgctaacgccttgccgcagagcgagcaccggaagtggagctccggcggcggcggcgccancgccagcgccagcgcggtgctctccccgcgcgccgcggcggcgagcgccatgaggcacagggagatgaggtctccgacgtcggcggcgccgctcccttgctacatcacgtcacgctatccaacacacacagctcgtgtcgtgaaaattgaaggcgatacgtttgcatgcgattgcgtctgtccgtggtgtgtgctcttatttatgcgtgtaaaaaaacacgaattggaaaactctatttatactctcgttttgcatgtaaattaaaacgttatcaacttttttaaaaaaaatagtatgatagatcaatatgttatactccctccgtcccataatagaagagattttgactttttttttcactatttaaccattcgtcttattaaaaaaaatttagaattattatttattttatttgtgacttactttattatccaaagtattttaatcacaacttttcttgtttatatttgcacaaatttttttaataagacgagtaatcaaacagtgcaagcaaaagtcaaaatcataagatggagggagtatgtcacttcatgcctattcaaattcaacttatacatgtaaaaattctttttatagtcaaatttattatttttttcgaattatataagtcaaagttcaatttgtatgtttgtgaaaagatatatcatatattaatctatcttgatattttttttaaaaaattataactttttaaacgctacgtacaaaacgaggacaaaaatctacttgcgaatcatagtcgtcgcaaatggcacgaagaaatcgcgcgcgtcaaatcaaagcagcgcacaatggctgacgacgcgaacaaactcccgaggtaagaagcttggaatttgatctgaaccataaaaaaaaaaagatacatggcgatcgatatgtcgtaatttccagttttccaccaacccacacgtgcacttttctgtatataattctcgacgtcattttcatctcattatgagtttacaaattacaaccggtccaagttcgatctcaacttgcgaattttacatatgcaacttgtggatttatgcataccctgaatagtgaatactctgaaaccggtgccttttctacggaagagggatgggccactgtctcctgaagcaatgcatatgattctcgacgtcattttcatctcatgatgagtttacacccggtccaaattcgatctcaacttgcgaattttatatgtgcaacttgcggatttatgcataccctgaatactctgaaaccggtgtcttttctacggaagaaggatggaccactgtctcctgaagcaacaaacacagctgcgtgctctttgactagttcaaaatttgtccaaaggaaaactcgattctgaaaccagcagggataaagttctagaacgatcattttatcagtccccttgtgcggcatgacctgcttttgttttaccttcaccaggtagaataaacatgcatatgacgagtgcaatgaagagcacacggagcgccaatcttgaaagatgaaaatcatagcctcataggcgagtaattgtatatgtactactctataagctctttaaaaaatattttgtaacgaataaattcatttcatcattattaaaaaatataggaatgagtgtattttgcacacatctacacactatcgcaaaggtcaaaataacaccatcaacaccgagaaattggacattctaccacttctaagattgggttttgccacaatgccattccgcggaatggcgtcgttaaaatgccactttcaacctatgccaaaccgttgctttgccatattcgccatttcacaagatttttaccattttttgcacttcaactgaccaaaatgcccctctctcctacagtttctttctcttctccggtgaacatgtgggatggggaggagaccaccacggcagggtggcgctaacctcaagctcggtgccaccaccgccggagctctcctcctcgtcgtcctcctcttgctctgcaaattcaagaacacaatctttgagctcaaaccacacacaatctccacaatttcggagagctagcgagggcgagggcgagcgcgagggctgcggctcacctcccgccgccttggtcgctggcgagggtttcggctcacctcctgccgccttggtcgccggctcgtcggtctccatcccncgccgcagttacccgtgccgaccgatgcccgagacgacgatgcaggtcccgtcctaccacgagctcctcctggagctagccttcttgggccatggtggcgtgcagcctccggcgcgcggcggagacgctggcggaggagatggtgacgagcggcgcacggtggtcagcgggaggaagcagcgcgttggccggcgggcgcgacgacggaggagattgtggcgcgtgacgcggtggccggcttaaggtttccttctctttctccgatgtgcgggcggcgggcttcggccatgggggcgggacgtcgccggcggtgagcttgggcagtgcgggcgtcggcagcacgaacgactcacttgtgacagccggaggggtattttagtcagctcgggtggaaaattaggtggaaatagagagaattggcccaaatggcaaaacaaatgtttggcatctcttgtgagtggcattttaacgacgccattccgcggaatggcattgtggcgaaacccactattggcagtggcctaatgtccaatttctcatcaacaccagtacaccacaccatgacacaaaactgtctcaaattccaaaaagattaatgcatagaatttggagagaaaccggatttggtgataatgggacctcctggatgacatcttcaaggagaaacgcaacacacggagcgatgctgatgtctgtccagatctcaaggggatactatacaaggttttcacccgatggtctcatcaaagagggaaagagacacttccaagagggaaaacgagcccaaaggcatcgccattgtctgccacaagactgggctagacttttgccttccacccaccccggttgttctacagctactgctccaaagccccgataccaagtagcgactatcaacgtgtagacaccgctgtaccaacgtccccctcccccgttagccagcccctacatgccttcatgtgccaatgctgcaactataactgtatcacgctatcatcgttgcaagcctccaccttagggcgtcatcattgccggtcaccatccccgagcatctagacctcagggggcctggaacttccgacattctttgacagcacaccagaaaaacggtcataactctttgctccggagtccgttttcaacaaagttgggctctgcggaaggcttattgagagggttattgtcgacgggggatacccgtaggccggatatagagggtactggggtacgctggtacgaagatttacgtaatacaacatcaagcagacagaaaacaaagattatactggttcaggccccttgataggtaatagccctaatccagttgatatgggattatatgatggaaaccacagattacagagggaaaaacagaactcgatgataccgacgagatcgtaatcaaacaggttcgattagatctctcgtcgacttggctcctgtaggcttcaactccgtaggctgtggtggatgtgctgactatgagatttgatgccttaggtcctcccggggggtcccttttatatcgcaggtcaactggtctccaagtaggactcggagacatcagacccggcatgatacaatgacgacccagttttgtccgagtaggactccttccatctgtgaactccatgatgaatttccttaacgtataccgaaaacgtccgtatacacgcaagtatatcatatcgatatgtgacgtatatcgtagggtagagggtataccttacccgtaaccctgacagtagcccccgacttctgcataactgaactcgtgtaaccgatcgtgacttctgatgttgaggttgttgtcgttctcggtgtgaggaccgagagacaaggagtaattgacaacgccaagtgaaactcaacagtcatgagtgaatttaaattaaagtccgaaaaactgccgcgcgtaacggacccagaaatttccggcggccatctctctcctttccttggaatccgcaccatcggaagtgcgactatttaagggagttttggggatccattttgaagtccgcctgttgtgaaaaaactctccagcctccaagcgtacctcgtcttctccgctcccgcaaaaaccctagctagctcatctcggtcctttctccggcgatccccggcggcaatagacctcgacaagtctacctccaccagcgcgtcgctgaagaaactacaggaggatggcacccttcccggtcgcgggaccatggagagagaagcaggaggtattgaaccccagcctgtcctgggtcgcatggttgcgatcgaggactatattctctgtggttttcttctcttggtcttgaacttctacggcctttctttgctccatttgaaccccaattccatcgccttcctcagtattttttcgcatctttgtgaggcctacattggggtagagccgtttcttgacctctttcgtttctactacgagttgcgttggatggaatccaacaaggtatctggatgcgtcggtttccgactccgggatggcctgaagtcgcgctatatccttttccagtgcccttcttctcgtagcaaatggcgggcgaggtggttctatcttcagatagaaaattcggattcagtcttcgttgttcctgaggaacaaccagacaagatttcgtctcggaccgcaaaacccgccttaaccccttctcttcagtccttcatcaatgccatcgatgacctccgagtacgaggtttgtcagggtatgaagtcgctgtcgacttcattggtaggcggatcaagccgctccaggctcgagcccacccagcctttgactattctgggccggaggacgcaacccgggtttctcctcggggtatttttcttgtatttaaattgacttccttatgtgcgtgttcctcctgacttatcgaattctggttctcgatctacatgtttgaacagcgaaaccgtggagcgccgcgtcggccaattgatgatcagcggcccgacaacggcgagcaaagtccccgtccccctttgcgagaagggggcagccgaacacgaagctgccatcaatgtaagtgtactcggcggccctttcgcatttttcttcggggatcgcattgtgacttcatgaagtgtaggctctccctctgactgatatcatcgggccgctcgtggatcatcaagcagcggcgtcgctgaaggaggacgtcaccaaggaggcgcccgatgttgctgtcgccgctgccacaacgagtggcggcaacgttccgaaaagggggaggaaattctcctccgtgatcagaaattgtcggaagacacccaccccctcggtaagctctcttggtccttcatcgcgtagtcggaaaacttccacctcacatcatgcccgttatactccagggctcggatgcgtctcccccgcctccacgacggcagcggcttgtgacgcttggcgagaagtaagtggatgaatttgaggttttgtcgcttcgtcaaactcttgtagcctttcacagggtagcacgggcgaaggcggcgcaagacggatctggagggacttccagcgcgtctcctgccgtggcctcgacggatgttgtggtcgtgcccaggagccgcgaggcaatgcctagcggcccagccagcgatctcgtggctggtcggggtctgccggctgtcgtcctcacctgggaggagctctaggtcgagatggggcgcctccttgaggctggtgctcgcagcattagccgcgagatcgcggaggcgagggcggcgtcagcgtcgtcgacgaatgagtgcgccgaccggctgacacgcgatttggcagaggttcgcgaggacctccagaagatgagggagctggtggccggcaatgagcgacaacgacaagggctcgagcatcgtatgtcggagcttgagaacaacttgtcggaaaactgtggctcgctgcgggtcacctacactggtctgcaccagctcgccggggagtgtggcgttaagactaccatcccggcgaatcccaacgagttctcgctgacgtcttcgcttgcagaactggcgacagcgatggaggcgatcccctccaagcacgcggccaggatcggagaggagacgtccaacgggacttataccggggcgtgccatgtcctcgcgtgtgtgaggctggcgcaccctgaactcgatctccagaagatcttggatcaaggggcggctagcgacgcgcgcaaggatgtgatggaagaagtgggcgatctgggggagtccgtccccccgctttttgaagaatagaatttcggctcccttgtactccttagtcatgctttgtaaaactctaattggttccaaccgcctttgtgcgtgcagtcatcaccttagttttctttagcattttgatctcgagtactttgttgtcatttgtagagacgttgatgtcgagaatgtccagcagcgcgggcaacctgagttgccagtgttatttttgttggcgacgacttccttaggttggttatttttgttttcatctcatttactctttcgtctggatcgacttgctttgctgtgttctcgggagaaaagagcagtttgccttagtcgtttccatgctaagcagacctcgagagtgcgcttgctgaccaagatcgccgcatccagtattggaggacgaaatttgaggtcgcggaactcgagaggactatgctggaggtgaagaaggaccaggccgtgcaaacactccgaggtcgcaaggtgtggttcagctcatatctgaagagttgctgcacgtccatgactagggtctgtagagagctccgagtaccccgtggagatcccgaggaatcagcggccggatacatctcgtggctgaatggggcctacgcccagctcaaaggcatcggccagcgtatcgatgaggccctgaagcaggagtgccgtcgatcgagccgatatgccggggggcatgtactggcttgcatacgagatcttcgtccgcagctgcacctcgagttcctccacgaagggttttctcgttctcggagaactcctacggagatagatggcctggcgaagtcgatggcgccgctggcggagaaggtcttccaatccatgaactggcgttggccttcctggtagtctccgtgtcctgtgacaaatgtcttagggaaaagtgtaatataattttggatttttatggaattgtaagaagtacttgtgaaatagaaaagaaatatatctaactaagctttcttactctagacgtagtgtgtaagagtgtcttctcacttcgcgacttcgatcagttgtttgagctatacactctccctagcccccagccttgccatcggaaaattcttctcgaaagataaagctcttggacctttgacctgcctcggttgaacaagcactgatcctagcccccagccgtgaagttggaaaattaatttccgattacatggcttggttaatacacacggcgagaactcttacacgaccagatcttacatggtctttcgtctctacaggatccgacaaggccttatcggctctgggcgtccccagccgaagttcccttaggttcctcggaggccttgtcaagacggcgtaaagggatatgaggataggtttcaacgctaggtgtcatctgggtaagggatcatcgggaaggaacactttgattgtaatttgtacctgaaaataggctttattgaagctgtaagatatcttacaagtatggatactattgtcttatacatagaatttacataattgatcaatgttccaggaatttgccaactcgcgaccatcgccgtctgcaatcttgaatgcgcctggcctcaagacttgtgtgatcgtgtacggtccttcccatttgggtgagagcttgtttcgccctgcttggctttgaacctgtcggaggacatagtcgccgatcgacaacgtgcgtgctcggatgcgcttcttgtggtaacagcgaagggcctgttggtagcttggctgctcgaacggcaactcgttcgtgatgttcctcgagtagattcacatcgtcgtttcgctgctcctcctgatcctcatcggagtacttctgtactcgtgtactttgatgtcgtagctcggtggggagcatggcctctgagccgtacacgaggaagaatggtgtctccttgttagacgttgtcggtgtggtacgcacggcccatagtactgatgggagttcttcgacccacttcttgtcgtgtgacatgagcctgtcgtagacgcgggtcttgattccttgtagtactatgctgtttgccctctcgacctgtccattgctctgagggtgagaaaccgaggcgaagcagatcttgactcccagcctaatgcagtgatcctggaaatcggcactgataaactgggagccgttgtccgttatgatacggtgaggcaatccgaatctgcaaaatatgcctttgatgaatttgattgcgtcgtcggccttgatttcccccgtgggtgtcgcttcaatccacttagtgaatttgtcgatcgccacgaataggaacctgtagccgccctatcctcgtgggaatggcccgagtatatctagcccccagcacgagaacggccaagtaagagggatagtttggagtgcttgcactggtagctttgtgtgtttacctgtggaattgacaggcttcacaccgctgaaccatgtcgcatgcatctttgagggcggttggccagaaaaacccttgtcgaaaagcttttccgactaatgtccgaccggcggcatgtgacccacagatctcttcatgtatgtcgaggaggagatgtctgccgtcgtcggacgagacgcattttaggagtaccccgtttagcgccttcttgtatagatcgtagccgatcatacagtagatttttgctttatgggttattttctcggcttctgcgtcgtcctcgggcaactcttcgctgcctatgaatttaatgagtggggtgcgccagtcgtctgtggtctcgatatcggcaatgacgcgctctgcctctgtagcccccgagctgttgctgagggcgaccgggctatcttcgccgcttgcctctttcactgatgtccttgtcaggacgtccagaaaggtgccaagttcgagtggctctcgtctggacgcacaccgtgctagatcatctggctcgatgttgtccttgcaatatacgtgtcgaacctcgatcccattgaaccttttttccagcttcctgacttctgcgagatacttggataactcgggcctagagcacttgtaatctttatgcacctggttcgcgactagttcggaatcccctttcacgaccagtcgcctaactccgagtgcagctgcagctcttatcccggcgagtattccttcgtactcggctgtgttattggtcgccctgaagttgaggtgaattgcatgcttgaattgatctcccgaagatgatgtcaagatgaatcctgtccctgctccttggctgttgagtgcgccgtcgaacgccattgtccacgtttcgttgtcgatttggttgtctgacctgttattaggcatggtccaatcggctacgaagtcggcgagtacctgggacttgatggatgttcgtggcacaaagtggacatcaaattggcttagctcgactacccattttgcaatgcggccgacaacgtctttgtttctcacgacttcaccgagagggaaggaggatacaactgtgaccctatgggcttggaagtagtggcgtagctttcttgatgtcatgattaccgcgtagagcagtttttgaatctgtggatatcttgtctttgcgtcgtggagagcttcgctgacgtagtagactggttgttgcaccttctctctctcaacaacaatgataatgctaacggaatatggcgtggcggcgatatagagaaataattcttcattaggttggggggcaacaagtacagggggatttgataggtagcgcttgagtgcaatgaatgcctcttcggcttcctgtgtccatacaaatttgtcttgcttcttcagcggagcgaagaaaggttgtcctcgctctcccatcctagcgacgaacctgcttagtgccgccatgcattcggttagcttttgtacttccttgagtcttgtaggtgacttcatgttctcgattgccttgatcttctcgggatttgcttctattcctctgccagagatgaggaaaccgagcagcttgcccgatggtactccgaacgtgcacttctctggattgagcatgaggcgatatcgtcagaggttgtcgaacgtttctcgcagatcgtcaatcaatgagtcgcttgtcttggtcttgacaacaatttcatcgacgtaggcctcgacattgtttccaagttggtcgctaagtgcgccctgaaccgtgcgctggaaagtgtttcctgcggttattagtccaaacggcatcttcacgtagcagaataccctaaacggtatgatgaatgctgtcttctcctcgtcctctttcaccatgctgatttggtggtagccagagtaagcgtcgaggaagctcaacaactcacaaccggttgttgagtccaccagttggtctattcgaggaagaggaaagtgatccttgggacacgccttgttgaggtcggtgaaatcgacacacattctccatttcccgttggccttccgcaccatgactgggttggctagccactctggatggaatacctctttgatgaaaccagctttgagaagcttgtcgagctcttctcgtatggcttgttttcgatctggtgcaaatctccgcagtttttgctttactggtttggcgtcgggtcgcaccatgagtttgtgctcaatcacctccctgggtacccccggcatgtcggacggctgccaagcgaacacgtcagcattgtcgcggaggaaggtgatgagcgcgagttcctatttctcgcctagtgatgccccaatcttgacagtcttgtcggggttggcactggagagtggaacgatgttgattgcatcgtccggtttcggcgtcttgtttgtcttgctcactttattgggtggctcagctgtggcaagtggactgggcgtgtgctcgaccatgtcgaggctccgcttgtcgcattgcactgctagcttagcattcccttgaatagtgattgttcctttcggtcccgacatcttgagcacttgatacgcgtagtgagatgcggtcatgaacttcgcgagtgcagttctcccaatgatggcattgtatgttgtattgaattcagcgacatcaaaggtgatctgcttcattcggaagttatttgcttggccgaaagttacaggcaacgtaattttacccaatggtttggacgatgactgaggagtgattccatggaagggttgatcggtgggtgtcaactcgcttcgtgggatccccatcgcgtccaaggtgctgccgaagaggaggttaattgagctgccgccgtcgatcagaactcgcgcgaccttgatattctgaatagtgggttcgaccacgatcggatatcgccctgggatgacagcagtcttggggtggtcctcttctgagaattctatcttctgttcagaccacttcatcttgggtgcagctccctgccacgtcgaacagacttcanttccactttcttgtattctcgctttgaggagtatgtcgtggaacctccgaagatgtgcaagacatggagatcagagtctgggtatgctgagtccgattcctgagtagccgcctcagcgtccttctcgaccacacgtactcgcttgcctttttccaatgccatgtgttttgcgagcgactttttgaagacgaggcaatcttctagagagtgtttgtccgacttgtgtatagggcaccatgttttcttcatgtcgctgccttgtgggtctgggcgcttgggagggtctgcgtattcagttgtgagaacttccgcttgagctttccttttcccactcttgcgatttttcttcttgcttgactcaggtgcgtccttggctagtttcttctctcctccggtcttcagtttgtcgttcttgcgtctcagtgcgtcgtccgcgtgagcgcattgattgacaattttgaataatcttcgagtagtcgtgacacacctcgttgccaactcctaggtagtatagcgatctctgacaccggacttgaaggcgcggattacagaagcgtcggtgatttcggggattgtatttctgcactcactaaagcgccgaacataatccctcaaggattcacccgggttctgtgtcaacgcatgtaggtcgtcttcgatcgcgtgacgcttgtaagctccttggaagttggcgacgaactgctgccacaggtctgcccacgaagaaatcgagtagggcgggagatgcatcagccatgaacgtgcagagcctttcaatgcagttggcaaataattcgccaatgcgttgttgtctgctccagcagcgtagagtactgtggagtaaacctgaaggaattcttctgggtcggtactcccatcgtacttctctattgctcctggtcggaatctctcaggccatcggacatcacgcagcgaacgactgaaagctctacacccagcactgggggcagtgggttgtcggcgatcgtacgtccttcgtggatgtctatctgatgatgaggatgaggaagatgacgacgatgacgatgggtcacttggtttcggtgtacgattacgagggcgtcggccaggttctcgagaatcctgtcgtcgtctcctgttgctgtcccggcgccgatctccatcgtcgtcgtcattatggcggcatcctcgactagtatcgcccagcacccgtcgttcgcgatcatcgtgatcgtggcggttatcatggtctcggtcttcgctcgaacggcctcctcgttcttcgttatcgtgacgtcgtgaagagacgcgatgtcgggaatggttctcgttgtctcgtgcgcgtcgcgcctctcggtggccattcaggtgatcgcggagatcgccggtgccacgaggtgaaggggtggctcgatgaggcgattcccgctgttcagggttttcgccatcagcaccgccagttggtggccattccgggtgcgctgcagcagcggcctcttcgaacgcgttgctgaggttagtcactgattcccgtagccgttctgtccaccgtgcgagatcgtcattctgaacgggatcgtagggggtttccctcagtattgcgttgacggccctgatgtgctgggccggtgtagtcacttgattttccgcttccgcgttagcgcgcgctgacgtgccggtcccatcgatagccaatacctcgcgtggcgtacttgtcgagatgagccatagtcttcgagcaggtgcaggactgacggttcgtggggatcgatgtcgattacccccaacgaatcgatctgatatcagcgttgctccttgttccttgtcctcatccctgagggggatacgtgactgctggaccttaggaggtgacgtcttcatggcactgagaaagaccttgcagctcgagaggtcgtgattctttgtcttgtgaataggacaatagacatcacgagttggagaagtacgctgaattccacgctctttgcaggcatgaatttcagcgtggacgttgagaaaaacccagcaggcttgcaaggtgtgttttctggttttgtggataggacaccaggaccttgtcacctcggaagtcatcctcgccggctcgtgattcttgtcggaaagacaaggtttggccgcactaggatccttctcgggctcggatgtcgtcgacgttccgttctccgcttcggcgggaggatccttcgacatggagtcgtcttgggttctagccactgcgttcttgcttccggtcattgatggaccagacgagatcggcaccgtggtgtaaaccgggaagacgatttcgccgacttgagtccacaccagcattgttgaagcaggaactcctttgttgaggttggtgttgacgctgttgtcgacgaagctggatgacatagtagtagaaccttgagcaccaagtccccctacctggcgtgccactatcgacgggggatacccgtagaccggatatagagggtactggggtacgctggtacgaggatctacgtaatacgacatcaagcagacaaaaaacaaagattatactggttcaggccccttgataggtaatagccctaatccagttgatatgggattatatgatggaaaccacagattacagagagaaaagcagaactcgatgataccgatgagatcgtaatcgaacaggttcgattagatctcctggcgacttggctcctgtaggcttcaactccgtaggatgtggtggatgtgctgactatgagattcgatgccttaggtcctcccgaggggtcccttttatatcgcaggtcaactagtctccaagtaggactcggagacatcggacccggcacgatacaatgacgacccagttctgtccgagtaggactccttccatctgtgaactccatgatgaatttccttaacgtatgctgaaaacgtccttatacgcgcaagtataccatatcgatatgtgacgtatatcgaagggtagagggtataccttacccgtaaccctgacagttatccaacccaaccaagctctgaaccactcataggttagtttaaggctctggtttctctcaaggtaacacttgcatgggtcactttgagtaccgagagataaacaaacacatcaacaatgcatcactcttaatagtacggaattcgtatactcaaatgcaaataggaaatctataccactaggaatgttttcttgtcatcttcttgctttaccttgacagttgccaacaccaacgccatctcactactaggactattctcacctataactcattaagcacattaatccaaaattgactatatatttgtcttgatcaatgaccactttggcttttggcttgatgttcatcaacgaattacatcctattgatcttcggcattccatcttgcgctcttcaaataattgatgtggattactcatggcttcaaatggcctcgcacgatccatcgtgacaaagtctttgctcgcccttcaccaccagattgagtccatcggcgccaagcctcttgctttcccttcacctcctcatgatccattgtagccgagtcttgattgcccttcacgatcttgccatatatagccactcataccccgtgtccccgtatcgtcaatatctttacttgctcctcatcaagctgtaatgtccatcttctaccttcaatctttcagcttgatgtcggaactcaacctaatatcttccaacatgtgttgtcataaatcaccaaaataatcaccacactcttagggtaatagatcttccaatctcctcttacaaaggcaattctagggaatagatctttcaggctgcaccccctcctctatagccgcatcttgccgcctcgcctccatatggaccaagccgagtcacgacgcatccaagctctcgttgttatgttgtagtttgctctcctcaacctctgtggaatccactatcggggtgtcagatctagccacattgatatcggatatggcaacctactattgttgtcattgtcggccaccttgcgccacctccgccccagccatcgacccagtacacctcagctctcaaaaagcaccagatctagtcgtcgagttcaatagtgaagccaccacgccgcttgtcatcgtcactgccacctaatctccatggcggagctaggaggcaaacgggatatgttgccaccgtatcgttccgtgcgtggtttctggtggcatcgagacggaggagggagggtggtggtgatgacgactagggttgaagcccccccccccccttccccggtgcggttgtctacacggggggcgatgtgagaggccaagtcagtataaaataaagtctttgtaggatagaggttgtactgatatgtgttcttgcttgcgggtgtttggattatcacagagaaaactcaccatgtgcagtagaacttattggtaagtattgaagcggctccgatttaaagctaatggaggtatatgcggtaagcgggacacatgcaccgtatgtctatgtcatgaggactcacgtagaccaacaatttcaagcaccaactttggatgattggatccatatatatgactatatgagtcatgacatatttctaaaatgctttgtccaaaccagtcaaaccttgaaagtttttaccagaagaaattagcgacgtcgagactaagcacattcgccattgatgaaacgtttcgtccttgagttctcgttaattttttacccaatgtttaaccattcgtcttattcaaaaaatttatgtaattattatttattttattgtgacttgattcatcatcaaatgttctttaagcatgacataaatattttcatatttacacaaaatttttaaataaaacgaatgatcaaacgttggtcgaaaagtcaacggtgtcatacattaaaatacggagggagcactacttactagattgagttttgacgtcatatgtccatattgctcattcgggcttccgtcattctcagccgccaaccatctcccccaaaccagaataattgctacctctgatatgggttgacatgttcccagcccagtttcacaaacccaacatgaaatcgaaaaagtctaatttagttccctttgtaaatgtcagatctaattcatatctttcaaccacaaacctggttatatcgatttttccaactattaaaaccgtgcaaaatgactctctcaactattttgaacgtgacgtccacatagtatcccaatcatcggagaaataaaaaatagacatgagccccacatgtaagtggtgagtgaaagaaatatgaaaattatggggtccacattgccacatgttagcactcaacacccactcattctttcttcgctgtttcgcacggacaggtgcaagaactacagtaggcaagccggcgcaggtccgctcaacactgcttcccactgaggaagcggttttgtagttgagggataaaaaaataaaaatcatatccaacctatatttttgagggtgttaaattagactttattcggtatgcaattgtttgcttcaaatgggcctcactttgaaccttgtttgattttaatggcccatgattggcactgcttatgggctcagaatctgcccaatcaaaaattcataaggcttattcctgatgcattccctgagcaatacagcaaaaactagcaacaaaacaaactggatccttcgttggcagtaggaccgtaggacggtaggagtagtagaagtagttggcagttggtacagtacagccgcctgcaactgcaatgcaatgaactgagcttgtgaaacagtgaaactgcacactttttgcactgcatctcaccagtcaccagaccaggtaactgctattgcagcagctgcaacaagagcagtcaaaggacgacatgaatacagctaaagagccgagctctcgattatgaggtcacgggcgcaaaggagcttgagctgaaactgcagctgctggatgcccaattaatgaagtgatttgcaactcctaaccatcaactaatccgcaacgatcgtgatttgctaggattaatccctttcctgcaggtctcttcgcggcataattaggtgacgttaacgctgaccggcttccccctttttcctgggacagttgcagaggtgccgttcagacgacggtaaaaatatactaaaacgacagattttccctgatttcgtcaccgcgaatcgcgtcaccgtgatgtcgatgcgtttgattcggcgcagttatgcaacagatttgaggttttgtacgtaatcatggctcatttactcgagtaaattacgccgatacagggcgcaattggtaagctctggtcgtgaaatttttactgagttctgacgcaatgggcttggactgggacggtgaaacgtattcgttgttgtgccaggacaaagagatgcgagatgcgtcatgggttattctgaattgttgctgttgttgattcggaggaaacgaagatggaattgcgtgttgaggccagatggaagggtcagagcaagcaggacaacattttcatttttgggctgattggtttaggtatggaggaaaggacttgttctgttgttggattgcaggagcattttaatatgaccagtggacgaatcttctgaattttaaatggggatgggtgtaatcaggcaggatcatggtagttatggtagtgaagagtgaaatgccatctctacaataaatgttgtttctagcgaaatgtacgttctcttggaaaaatttctgaccaaaatatatgaccttgtttttcctctataaatcaaacaatttcacatgaaaattctatgcattttttcacataaattaagctctctatctctctgttatgagataggagtaatgttttttttaagaatctgtttgctcatataaactctactggcttgattctaaacttgggtgggtggtttccgttaccacatcctgttgataagcccgttaccgtgataactgacctttagggagaccttgtttcaactatcactctggttatggaattgtgtttttttaagaatcggtttgctatgtaagttaatgaatttcatgcaaactctactagcatgattctaaacttggataggcggttaccgttatcgcacctcattgataagcctggttaccgcggtaactgatgttaagggagaccttgatttagactctctcttattacgcaattatgctttttaagaatctatgtgcttatataagcttgtgaattccatgcaaactttactagcatgattctaaacttggtccatacgttacacggtttccgttaccgtatcccgttgataagtccggttaccgcgataaccgacaataatgaagacctttgacttggatttgagctaatgagacaagcattagtagcttccaatccagatgatatccttccatgtttgtaccaacattgaccaatgatggctaccaagtgtactaatgtactgacattttcttagggccccaacaacataaaattgaccggagtagaccacctcatcagtgtgggcccagcggcgcagccaccacaaaatcccctgcgtgtcttccgagttttaaaaccgaacagccaaaaagaagaccaaagggaaaaaaaatctgaccatttcttgatttcttcttctcccttctctctctccatcactccatggaccaagagaagcatcaagccatggccggcgctgccgacgccgccgccggcggtggctctgttgcgaaggacacgggcgacgattttgagttctgtgtactgtcgtccggtgggctcgtctctgccggcgccggcgccgcggcggccgacatgtgcgtggccgacgaggtgttctcccaggggaagctgctgcctctaaggctctcgtcggcggcggctggcgatgcggccgggcttggtgttctgccgcggtcggagtcggtggcgtccaccgtggggttcggctcgcggtccgacagccggagcgcgagctccagcggcagcagcagcggctgcgtcagccggagcgagtcgtccaagagcgcctcctccgaccactccgccgcgcatccgccgccgcagcagcagcagcagccgcggcggtctctgtcgagcagcctgttctacgcgcacccgagcccgtcgccgcagctgcgcacccggccgccgcgccgcagcaccgggtcggctcccccgccgccgccggccaccgcgtggggcatcttccgcctcggcgtcgtcggcgccccggacgtgtaccctccacgctccacagattccaagaacgccgccgccgcagcaaaagtcggcagcagcaggagcgcacggttcgagccggcgagcaccgccgccgacaagaagcatccggtggtgggtctcttcggcgacagcttcgggtgcaagtgctcccccgacgtggtggagccagtcaccttgccggcggcggcgaagagggccaaggccaagaacaagaacaaggccggcgacaagaaagctcagagtgttcgtcgcagcaggatcctggactggttcgaggaactaaccatcaccaagaagtagtaaatctttcgcgtaaaagatcgtgtaatttttttttctccgagttactctgtgatcaaggtaacatcatcattttagttcttaaatttcgatcattagaatttcattcctctgattaaccggccgcagtccttaagacataagttttctttcaacttgttttgtacagattacccttaatccgtatattaattaccttcggaattgtcgcgatgacacctgcagaggtcgcagtatatattcttgtttcagatgtcgtttacttttcttttttgtttctagaaccttacacattatctcatcagtcatcaccgttcgcgtgttgacgcttgtcgaattgtctatacggcgcgagataccactggtgtcacgtcgaagcgaaataaccgcgtcgggttcgggttcgggttcttgtcctcctcaaataaccaatttacgaacccactacttatatcaagtaataactcataataattttttatgttatggttagatttatcgtatctatagatacatgtgagacgattcataaacctatttacagattaaattgataggtaacttatgaatcaatctgctaattacctatttattttacatgtaagcgagttctcataggttgatccgcttgcattcctatcgcgagtggagacggggacagccacgcgtgcacagcgtaacgtacaattacgtggtgttgccgcctaccaccgagcacacggcagcagcgagcagccgaaccgaacgcgtggttccaccgcgcgtcgccggaatttgcgtgccgacggcgaccgcccgcgggtcggtgcggtgcagcagaatccgctctcccgacggcgacgtacacacggcgtccatccctttcccaaaatctcacctggaacgcgaaaaaacaaaacgagaaaaaggccactgtagctggctggctggagctcatgtgcaacgcatgcattgtctcgccggttggttcgtgctgcactgcgtattcactcttcagatacttgtggttttttttgttcctttttcctgcgtagatcgagattaggtgaggtgagcgtgagcgattcttggagcggttcgtgagcttttctttcgacgattaggattagctcatccaacctcacctaatctcatatccttttgcacggcattttgggtcgctactttctgaaaaaaaaaggttgttgttgccacatactacagcttggtggtcgatctcatggcttgcttgccggatccaaactttagtggaaagagagatgcccaaatgtgcacgtcgtttctcacctgatgccttttcgtttgccactttgccgggccagtgaaaaggcatactccctccgtcccaatatattaagacctaggatcggatgagatattttctaatactacaaatctggacaggcttcctaatatattaaaacctaggatcggatgagacatttcctagtactacggactgtctagattcgtagtactaggaaatgtcccatccgattctatgttttaatatattggaacggagggagtacattatgggatagagcaatcgagtgaaatgcacggtaatcaaatcagtagagcgtgaggtgagtgaggtcagtgtacatagaggttaaagagaaaaaattaaagtaagaaagctacgcctacactagattactagttgctgtaaaagaatttttgtgtaggagaa

SEQ ID NO: 61468 - DNA, 1797 bp, Oryza sativa
aattcccgaggccactaaaagtgttactactccactactacacaaaactaatcaatccaatctatactagcctaatccaattgtgcaggattacgtacaagtaggaccggccgacaggcattgcttccagggttacattgcatgcctctcaactgcacacaaggttatgtactgtcacgaaatgtttggatctcgtcgtccccatagccaacctggtagtactttcagtatcagtacatgacacagcaacagaaaatgaaaaaaaagggtcaaaaactgttgctggcagctgcgtcctgaaaacaacattcactaacagaggatctgagggttgccttgacggtgaaatggtagacactctagacttaaaatctcgtgctaattaaagagcgtggatgttttactgcaaacagaactgaatgtttgctgtacgattcaccagtagtcaccacgcttcatcgctgtggctgtgcagtgtaggacgtgcccgtcttttcgctggcataatcgatagcctgtgttagcctgtggtgtgacaagccagtgtggaggtaaaaaagtaccgggttgtttgggctttggacaccaacacgtgctctatgagcatcgtgctgttacttgcgtaggggccgtcggctgttacaccgaagagcaacggccaatctgtggcaggttgagttgacttaagcgagtgatttctaatccagctttctgtagcatggagtatttctgcagcaacctagcagggtcggtccatttccaacaccatgttgaagctatgtcatggcacaatcatcgatcttaataaaacgttactccctcagtctatagcctcattgtttattagtaaaaaaataatttataagtacatattttctatgcgtgttcttagtgactaaaaacaaatattgtaaaataaacttctttaaaaaattaaaattaagttctaaattttaaattttgacttataagtataaacataaacaaaacaatgaggcttctaatgtggaatggtaggttgctatattttgaaatggagggaatataacctaaataaatattattatatcatgtttttgctataaactttgtgcttttaaatcatcaaaaaacattcaaattcattgcgtggttttcatggtttgccgggtgacaaggcaacttgggctgcatccctactccttagcttaaatagccattgaaaatgcatttcaaagcttcaaaaacaaaaagataacaaagataaaattgtgccctacggttggaaaaaattctggctccaccatggctggaggtggatccacccatgctatggcaaaatacgcttcccacattcaaaacggatgcaagtgagacagggttgcgatttgcatatacaccgtacaagtttttccttgttttagtacggagtagaaaataaactagcatgcagggtttttgatgtgggataatgtgctgctcgcttgcatccctagctactcaaaacaattgattaggccataaatcagtacacggactgatcaaatattatagattatgaagttagatagcttagaaagaagttatctgtagcgcccgttccgtcgtggcgcctacgggaaaattatctcttaaaaaccctaattgcgaaatttatttctttgcttgttgtctagtgtccatgccatctcaagatctcaaatccccgatctatcgtcgagttcaattccgaatccaaaaccttccaaatcaaatccctccgcaaaagtctattttgcctcccccggggtcgatgggctgaattttctctcggcccat

SEQ ID NO: 61469 - DNA, 12975 bp, Oryza sativa
cctgcacgacaactacaccaagccgtgctcctaccgctcgcagtacgtcactcaaaccaccactgcccaagaaatcatgtccgatctcttcactgctttggttggtttgattaaaatttgaaaatatacctctctttcattggttttgtacaaatacactcatttagaaaactaggaagaaaatccgcgcagatgcgcgggcatctgatttattcttttacgaaaataatgcttacagaagtcatatatcaccatttatactccgtgaaatagattgtacattttaatatatttaaatgataaggaggcctcctagattaaataaaatcatttgccccgactacatataaatgttcttaggacccgttctatactccaactgcaaacttcaactttcttatttttcattagcacgcttcccaaattgtgaaacgctatatttttgcaaaaatattttatatagaagtttaaagaaaaaatcaaaatttcaagtttacaataattaatatctaattaatcacgtggtaatgaactttctatacctaatcacttcaacttactacatatgtacctattcatggatgatactacatatgtaccaagaaaatacgcctaatacatcattaaaacaccgaaataaccactacacgtaagtgtttcatgcctcacctattttcaaatccatatataaatattgtaaaaaaaacacatgtacaaatcaatgggacgacatcattgaagttacaaatagatgcctctctaatgggtgaagatggatgcgatcaaaataatattttttaaaaaggttttgagtatatttgtggtatattgtagataccatttatcgtgttaatcataaatactcaaatggttatggtatagatataggatactctaatttgaaaatgagcgaggttatcaatcgatggtactaaaaaaattataactaaagagacatactaccatgataatttctagggcaccatattattatttatattttgacaaatatctatagtttaaccattagtttattttcaacacctattgttggtaatcacatgagacacctttactaagttgaaaaacatatttattttttaaacttattaacaataactaatatgtgggcgaatatttatagtcgcatcggtgaggtatgtgacatacatccatcaaatatgcctgaaatgttgaaattccttaaccataagaaaatataacatgagtagttcatttgacatgttacttgattgttcatttgttgtcaaaactatttggcaaaggaaacaaaatatacatatacgaccataaatctcattaagaggttatgttatagcaatattattaactcaaaatattttttatgattattttcacatctacgtaccatgtatgatactcagttctcaaataccaaatagttttgaaatattcataaaaaactttgagaatattaatctcgaacaaattaaaattatagtaaatttcacaaaactataggtactttgatcatctgttgttttgtgaaatttagccttaaatctacattcttaaatcatgtctacttgagaaaatatgaaactaaattttggtgtttttattttttgttttacatatgtagatttgaattagcgtcgtataattttgaagtgatttttgaaaccctaaattatgatgtgaaattattttaaaaattatcatgatattaattactatttgtcagccccaatgcgtcatgatgtatttacgataacagactttaaaaatatttaactaaaggaatacaacggtatcacacattaaatatataatttgaaaatattttaaaatgtgaacatttatagaacgttgatttgatatttgatatttgtatcctagatctagtttgtggaataatatattttatttttatatggtataaattctattttagagatcctcgatttttttaatggttctacgtacgtatgtctttttttggctttatgttatatatgtagaaagttctatttttgattttttatactacatacatatatttttttggcttgatattttctttttcttttgcatatggttttttttttatcgtaagaacgtgggcatgtttttgttcttgctgtcggaatgtatttaaggtttaatgttttttcccaatcttacgtacttatgttttttgtttttcccgacgaacctattttctctcgtacatacatatggaaggtattagtattacatatatatatatatatatatatctaatcttgatctaacataatgggtccacttatttaaatgaaaagcaatggtacatatagatataatctaatggtttaaaataacgggtccaacaatttaagtgaaaattaacagtgagattaaacagtgtcacacggcggtttgggattgttagtacaagcgcgcgcggcacatgactgtttaggaatgtttataagaagtttaataaacttttagtatttaagttataaattgaagagtttgttctaattaaagtacttataggattagctactcctttatttatttgtagcgagtatgatcatcaaaaggataaatggtgcattacatggtgtgtgctttgcaaatactttctatattaaagttttctaaaaacaaataaatcatttttatttttgtaatatttaatactcaattaatcacgtgataatgatatgtatcatttcgtgtcctgataaggtcacttaattagctagatcaaacaaagccttagtattccttaaagaaaacaaaaagagtaattattaagtctatttaaatgagtaagacacaaatagctaaatatgattttatgtgataattttttaattaaaatatagctaatatgtgatgtactcgtaatattttttaatagaaattcagatacctccttttcttttatatagtaggttcatatatgtacttggaaacatatatcttcccaatcgtaagtacattatgctcttattcgtttttttgttactagcaataatgcccgtgcgttgcaacgggtgaaggtaattttaatcatgcatactggtgggaaaaaagataaaggaatcataatcataataataatattaatgaaatgaaattgcagtgacctttggtcaaaaagataaaaatatataattgattttccgttaattccattagctaaaaataatataatatgaagtaggaaaagttattcttgaattttagcaattttcaaaaagcttaaatagaacaaactaattatgtaaataaaaacaattttaatcacctaaataaaacaattagaactgcaattaaaaaatctgttgccagcttgtttaaacatgagccggtgggtgcgtgtggcatatatctctcactcgtacatcgtggtaaattttttacatagaaaaaatgactgtgcgttgcaattataacaaatataaaaatattatatgattaaggtttagttttacatgatatgagctctttaagaaaatatattcataatgaaataaaaaaaagttcagctgaagggacctaaagtgaacttattccacacagagcgtacacgcggtccatgaggtggcccaatagtgtgggcggcatgggaatagaatcggggaggaacaacttaagcgacctaaggtgaacttattccatgtgggtgacctgggaatggcgttcagcctaacgtgggagaagctgaagctgtccgatgtgatagatggtcctgattgatcccgacctatataaaagttcaacatcccaaaccctaaccctaaaatcatttctcctcccccctctctctctcaaaacaacatgacggcggcctggcatacctacatccctgcgacggcggtggctgttcggcagcgatggcaacaccctccccttccacgcgtcggtgttttcttagtattgttgaatctgatcttgtattcttgtagtagtgttttctctagaatttaggtccaaattttgatgcggcctctcattattttttttctttcttttcttttttttttggccatcggagagggattaaagcgggatcgatcgcacgtgcgatggaatttttttttgacggacgaaaactataacctgaagccatacaaattttttaattaggtatatatagaatcggactttctttttttcatgttttttcaccctttttttggttactacggacgtcggaaatgtctttaattttttttaccgcgtcatatataatcggattcgattttttttcgcccgatttctttttcacgctttttttcacggacggacgacggaaacacttttatttttttattttttattatatataagtagtagagaagagatagagatagagaaagagaaacgaaaaatattttttcgcaacttttctttttggaatcggacagaaaaaaatgttcacgcttttttttgacggacgacgagattttttttaatcggacaaaaatatttttttcactattattctacttttttaggaagacggaaaccgttttgtcgcacctttttttattggacagaacaaaattttcgcacttttattcgcgcttgatttttttccatacagaaatctttctttccttttttttagggaatttccaagggggtcggacttcttttttttgtttgtttttttctcggcatttttttttctcatggacgaaggaagcaggttttactttttaagtagttctagactagatagatagaagactagatagattctagatagatagaagtagtatacgtacgtacacggtaatttttttcccggtaatagaacgtacatgtttttctcctgtgaatagttgtacatacacgggagacttgttttttcttcagtttttttattgtggcagattatctaagataatgggtccaccaatttaaatgaaaatcaactatacacatagatatgatctaatggtttaaattaatgggtccaccagtttaagtaaaaatcaatggtgagattaaacagtgccacatggcggtttgggagtgtttatagaagctccacatggcggctcaggagtatttgtaggaagtttaatggacttttagtatataataactagtaaggtagcccgcgcagttgcgcgggcatcttatttaaatttgttattaggattttgaatattatgactttgtctctcaatgaaagaatttgaatgttcctttataacacatgattgaaaaaaaaagtataaaggccggaaacatgttagaaatacatgtgtaaaacagcgaataaacaaatttcggacagtaaacgaattttgtacagaggacataaataacatgaattttaaaatttgttaacccacatagatgaaatcatcatctttcattgcataaataaactgcagttaaccaaataacctttccgttagcagcttgattttatcgatcccatgcgaagggaaaaaacatacgcatgcatcttattactattttattaattttattgctatagagatataccgtaaccttttggatatcagctaatcgttatgtgcaccgtgcatggatacctcgtaagcaatatgatttagggattagtagatagtggtagtgtggatatatctcgtaataattgatcaagtatattgtatactacatattaagcgttttagtagctttctaaagagcttatcggagtagctactcccttatcctatatatctataaagttcattctcaataagtgttctcaataagtatagttaatgctaattctctcttctctcatgaagccataacacctcaattgtttttagcccttggatgattcatcaagggtgcaaattgcatctcttctccccaaaagccactccatacaaatcaaccatttataacttttgaataattgatgaaggtacaaaatattcaagcacatgaaagaaaatcatatagtaaataagatattttttctactactcatatctactattttatcacacaattctcctacagcaatgtgccggccatctagttcatagtgataacgtttcccggactgctaaacgtgttatattttatctttttctgataatttctattattttctctaatttattatagtactatgtacaattttaagagtgttcataagatgtttaatggactgaaacttttctatgtttatttttgcatggtatcagtaggatatgaattttttcatcagacttactataatgtattcgtgcaaattaaaggacggtatagtgatgcaatcaataggaatcccaatcgcacactttttttactataatccaaaggaggtttaaatttttaattttaaatcccaactatagttttgagctgagttcaaactttttaacaaagtattgctttttggatttcacagagaaaacaaaacgaaagagaggaacatgggacctgcgtgggtacatacttatttacacctagaagtggggacttttagagataaattaaattggtagttttttaagatagattcaatgcatggataaaacaatggtctagcaaaataaatgaaaaccaacggttaaatgctgtttttcttagaatttatgtgatttattatagcgccacgtgatagcttagaagcgtttataggatgctatgtggcggcttagaaccatttatagagatgctatgtggtggcttagtagtatttagacgaagtttattggactttcaatatataattaatagatagatggtagattgtcagtaataaaacgaattaagctgagcataaaaccaacatatattttttataagttaatacatgcaaggatgcacgcatgcatgtaaccctccatgaagaggacatggacagatgtaaccatggtgcttttgctctcaacaacttatgaaaaaaaaaaagaacagatgatgcatatacatgcttgagaggtgagcagattgccggattggacgttttatatgttagctgttaatttttcttttcaatctgtaattgttttttggttttttatcttttttttatttcggtattttttatcactttcggatgtattttctctcatatagaaacggtatattagaagtgagagattatattttaatggatctaataatctaatggtccaaaatatagatccacagtttaagtgttagatgtttcacttttttcttacaattctctaatttattatcgtgtcacatggcgatgtatgagcgttcgtaaaaagccacataacaacttgagagtgttcgtaggatgtttaatagacttttagtatataatagatatattgttatacacgatgtttaatttaatggatatttattatttgctagctagaaattaaggaggccaaagtgagcaaggagagatgacgtaaaattatttgcgaccacatgatagtatatgttattattttttgctatttgtaggagtatttgtcaaacgatgtatttcttatatatcaaaacacatggctaatatagataaatagaatatgttgtagaaaattataattatttagttatctaattattttttacataataaatttattatctaaaaattagaagatggatgggatgaagaaaagagaggttgtgagggagtaacgtacgtacacgtacatgtacgtgaggagtggaggcccatgaggggagcgggagtggatgggatcttggtttattttgtttaatatagatctaatggtgtaaaataatgggcccgctatattaagtgaaaatcaagggtgagatgttttgcttttttctagaatttcttggatttctctaatttattagagcgccaagtggcggtttaggagcgtttgtaggaagtttaatggacttttagtatataatagaaaagatagatagatatttacagaaatataccattgtcgcgaaatgaaagcgcgaaatcgtgcgttactgcatgatgtcgcgcgaggtgtgcgcgagaccgctcggtctcgcccagcgagtgcgcgagaccgcgacttcgcttacctaacccgtgtactcacgctatcaataaattaattagtgtaattagcaattaattaattactattactcctttaactaacatcattagtaattaattaatcgttaatcacttgttaatcgtccactgatcatgagtcatgtcaggccatctcgcaaggtgatgaagcgagaccgccggtctcacgtcctgctgttgcgataccgtggcggatccggcggaatcacgccatgattctgcgagaccgtggcaaagcatcacgttgtcgtcattttcgcttaacggcttagcgatatcgtttcgatttcgctctttcaatcagcgacgacgatatatttgtgctaaaaattttacatctcggatatttataaaaaagaaataaataaatagtttactttcaaatttaattcttacaattgctgcaatctcgtggttctcctttgctggttttgtttggaaaatctgagtccgatctgtgtccaatacggaatcctcttcgttttcccttcttgtgtccgacgtggtgtcttccttgattcttctcttgtgctgccacaatcacgaccaaaatagaaacagactacgtgaccgagtccatatcctatgttgcagcccttctagatcttagtcctgcacgaacccggcttttcccaagccagctaccaacaaaaccgctctagtctccaccttcggctcggcctcaacgtgaaatcatgcacaccgccgtggtcctgacctcctgagcttcacgtactgccaccacaaatttcactgttgtccaacacctccagtcaattccatcgacaacgaacgacatcaatcggactcgtgcctataacagtaccaaacttgtagattgtacgccgctgttgtaaccatccatcgtgcaccaccttgtcgtcaacacatctccatcagcaccaacgatccacccacaccgacttccgattgaacactattaatctagtcgagagccgaagccgacgagtcgtatgccgtcttcccagccgccgaatgacccgagtgccacgtctagccatctccctgtcgaacgcagctcatcgaaaggccccggccaccccgcccagagtgttcgattccaccgatcgagaacgccgatcgcctccagcttcaatcaaccccgagcgtgaggcctcacgtctccctgttgaaagtagctcaccggaaagttcgagccacctgcccgcagtgtccgacccatcgattggatcgccaatcgctttcgccgccatcaacccgagcaccacgtctggtcatctccctgttgattgcggccatcgaacggttcaaaccgctgcctgaagtgtccgattccaccgatcaaattccgttgatcgccgccgtgctccaccttgcgtccatgcccgtccctggacaacctgtgtagttatcgcaacgtggagcacctccctcgcacctctacgatggatctcccgcaggctctgataccacttgtttgaaaaccggccccgaaatcacattggaaaccaaaccgcggaagaaaatgccataggagatccaaacacgatgatgataccgaggcacgatatttgataacggagttcagccgaggcctagatctccaggcactgattacgggcgctcctccccgatccagcatattacagcgtatcagagttgtaacgactcatggccgatcgccgtcggcagacgctccctctcgctatgctatgtcgccatgcagttacaataggcacgcccctctatttatgagagatcctaggatagagttcgagtcttactctaatcctatacctagtacaactccaagtcataaactgtaaccgattacgtacacatattcgacacaaactctaacagcccaaacatatgagtcacattttgaggaggttgtacgttataagccatatgaataatcgaccagaccaagtgagtaacatgacattggaagaacaaatgttgaatggttccgtccttatgacaaaagcaacatttcttactacctttccatttgcgcttggagcgcaagtttaaacattagcatcaatccacaaatattcaaaccacacgcacaaaagatttatctgtccactcttacaaaaatctcagaaactctaaatataatggcaggatgacagattcaccaccatggcaccatccccaaataggaaaaccattcttattgggtaaactcaaacaagcaccagtcactacaaaagctaaacagaacagcacaaacatgaccgacgacgacgagcacttctgaatagagactagctataataattcatagaagactactctgggtcgtttggcgtatgtgacctgcttccgcgtccagctaactcgtaaacgaccactcttggtgtattggcgtatttacctgcctcggcctccagctcacgcactattgacttggtgatctcaccggctttttcaccggccgtcatgtgcacctcacgaaggctcgcgaggttatccatgccgaagacgccttccagcgtgttgaacttcatatcaagcctttcgaggttgcccatgccctctccgagaagacgagcaatggcaggagcggcgcgtccaagcggagcagcttaaggcagtcgaaccctccatgcttgaccaagatctgcccctctgagtccgacttgttcttttcaagaatgtccaccaaatcaaggtccttgctggatgtccaggacgaaaatataaggcagaacatacgaggtagcttctgaaggagctccaaggtatcagttcggagcaccgtaactgacagggttaagttcttcagttcagtgagatgagcaatccacctgggcaccttgatgaacatgccgtacagctggagggaatggaagtatctcggtggtgaggtcagagaatccagtgcgtcgatgaaaccggagcactcatcattgatcaagagattcttgagcgagctacctccaaggtattggatggaagagagcaaggccttgaagccaggagtaccctcctggatttgtagcttgtgtatcccgagcttcctaagggcagtgtacccgtggaaatcattaacggacgtcggctccccagtgatctcgatcccggacaggatgtgcagtgttcgcaacggcttcttcgttgcctccgctggcaacttgagtgttacctgtgccattgtgtttccaccgagtatactcgtcagccgttcaagctgaacgatggcatcaggcagcttctggacattcgtgtcccttatgtcaagggtctctaagtaccgtagcttcccaatcttggaagggatgctgttgatgtctgttcctcggaggttgagatatttgagaagaagcatcttgaagatgtccttgacatgctgcttcttgaagcccttgcagccttccaggtccagcacctgtacaatgccgagcttgagcgacatgaaaggcagctggttcaagctcccaaacactgtgactgatcggacatgggacaggttcattctgtccatggtttctttggcatgcttcacatcgctgctgtggatggacaggcgacgaactttattactgggtgtccgcatgagccagtgcccgccaaccacggtgataaagttctcctcgctggacttggacatgatgtactcgaggatcatgtcatgaacctggcaggtcttaactttcccgtcgctgctgtgatccacaggcttcaatatgttccttcggatgagcagattgaagtttgtttccgcgcgttccttcatgctctgcccgtgctcctcgctgataaagccttccgctatccatcgcctcgtcaaccgcttcctgctgatcctgctgtcctttgggaacacgctcaggtagagcgagcaggtcttgaggtctgcaggtaagctgctgtagcagtagttgagtatccttgtcatgccttccggggtatggcagtccacggatactggaggcagggagacgcagatctcggcacactgtttctcgtatgcctgtggcttgcaagccacaagaccagctatggttacaatggccacaggcagacccttgcagaggtccaagattttcctcgagacatcaatgtgcgcctgaccgagcatcttgtcactgctagtcatggattcagacacgctctcttggaatagcctcttagcgtcatcatcagatagacgatccacatgatggagcatgtctttctgtctgtcaaggatgcattcccctgctacggcttcgaatcgtgtagtgaccacaactctgctgccttcttcatccggtagatattgtctgattgtctgccatgcttcggcggaccgtacgtcgtcgaccacgaggatgtagctgccaatcaaagttgatcaaatgcaggaagtcagtgatatgcgcgatgacggagcattagagccaagcttgttagtattgggattccacgtagtattgtttttcttttaagttgtatcggattgtatcgtaatatcaggatactatgaattttcttttttaagtttaatttaatatttatattaattatatatagctattctataaagaaatagagtaatagtaatagatgacataaaaaagagagatttgtcaatagaagacccacccactaatgctaatagttttatttaacattgattttatagatacataaacacaaaagcgttcaaatagttttgatttttaaatttggaaaaagtacgaattacccctctgaactatcacggtcgtccgaattacccccctgaaccacaaaaccggacattcttcacccccaactatgcaaaccggacgaattacccccctggacccaatccacggtggttttgatctacgtcgcagtccagtcagcaatttatttattaaaaaataggtggaccccacctgtcagtctctctcttatatctctctctcctccaaacggcgacagcggaggcagcggcgcggcgaaggaggcagcggcgaggcgaggccagg

SEQ ID NO: 61470 - DNA, 36733 bp, Oryza sativa
tatgaggatcttcgaatacggccagcaaatcatctttgagattgacgaagtcaccacaggcgcctggctatcgacgggcacgtcgtctaccactgaaagcacaatgcgttatcgacgggcacatcgtctaccactaaaagcataatgccgttaaatcctggaaaattcactcccgtagggagtcgaacccaggaccaaaggtgctactaaagctcttgtaaacactagactaccggccctttcgcggtgggagtcgattttgatactataccgtagcggagctgtagccgtaaatataatattattaccgttaatattgtggatgtccatattagcgtccaatttggtattggggatgtggaggtccatacattaaaccaagattaaaggtacagatgcatatattttataagtttgtggacctatatccaagtttaaagaccgactgtctatttttattcagattttttcggcatataagcacatgcaaccttttaattacaaatgtaagcacacgagatttgaatttttatttctaaacgacatgcccatatgcctgccttgttactatcagtaacatgcggaaatcagcagcctcggtaactctcttctttgcggctatcgtgttggtctcttacttagctatattcagatttactggaaaaaaatatatgcatgctacgatgatttgtaaaagctgataagtaaaactgctctgcaaaacaaataaagattattagcacaaattatgattttgatgatcctcgtggatgaattagattgaaatatagaaaaatgttacacctactatgttattccaatttctaaatcaaatgctaacaaccggctaagaggaggtggactgttggtctatacgtacacgtacttactcaatttagcatccaattagattgtatccggttgaatagaatcaccgttgcatcttgcctataaataaaaatgtgggtttggcgtgctcagatttggaaatactgtgttgcatgtgcttggataaaaaaatacggatttttattttggcaaatacggaaataccaaatggccatgtaccaaacaggccatgcattttattcaatcctaaatgcacttaggccccctccgaatcataggaataaaaaaaatagaggaatagaaaaaacgtaggattctattaggaatacaagtgtaaaatagatgattgcaaaacgtatgaaaaacacagaaatgaccgtttgattgaactgcaggaaaaacgtaggaatccgatgagagagatggactcaaaggaaagtttcaagagattggagcgcttgctaaattttctccaaaatctctataggatttgtccattccatagaaatttcaaatgataggatatgattcaatcctttgtttcaaatggctttataggaaatttttctatagaattggaatcctccgaaattcctatggtttttccttcaaatcaaaagagcccttaagctgtgttctttccccacctttcccaactcacaccctcatctttcacgcgcacgcttttcaaactgataaacggtgtatttttttcaaaatatttatatacaagagttgctttaaaaaatcatattaatccagttttttaaaaaataataaatacttaattagtcataagaaaatacatcgctccatcttatacgtcgctccgttttacgtgtgcgggaggtgagttcccgactcacccaaatcataagcaccaaacttgagtttctgctctccatagatgatatcatcctagactcatgcatgcactttgacagtgcgtgttactagttgggttggttaaaataaaagagaaaattccaccttttaaaattaatagaaaagatacccgtgcattacaatagaataaactaaaattttgataaacattagatccgtactttgaccttttccgaaaattcctcaaagtcaataaatttcaaagtggattcaattttttcctatcaaattacttttttaaaaaagcaatcttccctcatttaaaatttgttcagattcttatatatcaaaatccaccgcaagatgaaaaaaaatccttatgatcccgcatagggactgatgatggatgaaaaaaaaaaagagaacgataaaagaaagaacgagactaccgatcaggcgcccgattcaggcgtggaaaaatcgaacgctgacatcagcatgcttgtatacgtgcaaaaccactttatgctatttttttctcttaaattatttattcaaatcatgattcgattgcaccattaaattcgttgcaattaaatatttaaaacaagatcacacatggatatattccgataaatttttttagcttattattgaattatttttaaatgttgcacgttgttccaccaaatatatcggaattgtttcactaagtagatcgaaaatgtttaaatgatttaaatcggacgctgtttcgccttatataaaaacaatgtttcagcaaatagtgaaagaatgttacaattcactgcaacattagatctatacatagtgaaacattgtgagtatactaggtgaaacattttttttggaacaaaaataaaacgaattcccttaatagagggtttccaaaatatgtgggtgatttgttacaaaagaatgttttaattcattgcaacattagatctatacatagtgaaacatcgtgagtacactaggtgaaatatttttggtggaacaaaaaataaaacgaattcccttaatagtgggtttccaaaatatgtgggtgatttgttgcaaaagaatgtttcaattcattgcaacataagatctatacatagtgaaacattgtgattatactaggtgaaatatttttggtggaacaaaaaaaataaaacgaattcccttaatagagggtttctaaaaatatatgggtgatttgttgcaacagaatatgtggtagaggcacgtggcaggaggggatagggacacgtggtgggtccaggggatcacgtgcgcgtggggggtgcccgatcctgctccacccccgccggtggcgtccgggtttgagcattttataaaagaaaacactaagaattttatataggtaggtaggtagcgaagatattcctcaactactttttttataaatcgatataactctaaccattattaatatctattttttcaattaaaattttaattatacaattaatcctactttgatatccttgctgatcaaacacaaacatatatatacatgaaacaaagcgtaaaaccttaatatatatagattagcacaacactaatatctcatctatgcacataagcagcccatccaagttcatgatgaacacaactatcgcatacttctggttagcatcgaagctttgaacgaagcatgttttaatttgtcaggcatgtcggacgaaacggattgagtacaaaatcaactctcgcggatgcacgtgctttggaaacaacggctgtggatgcacacgttttctgtaacgatcacgagcgacgatgtagcataccgaagcggagggaaaacagatcacacaggacaccacgatgacgtgtacagacaggaatcagtcccggatacaaacgatgtactgaaattccgacaaaaatacctttaatttttataatatagtaaagataaattgaaaattctagagttcataccacaatattcaacgcataccctgtttgtttcccctactatgagaggatgaaattttagattatcgtggcacgcttttcaaactactaaacgatgtgttccatgcgaaaactttctatatgaaagttattctaaaatatcagattaatcaatttttgaagtttgtaataattaaaactttaattaatcacatatttttaccacctcgttttatgtgaaacacttaatctttatcttcatcttcaggagattcaaacactagaatggaagacgcataatagttcaattcgccgttttggtggtgggatagggatgttgggtatagaagtatagaaaatcagctggtcctggacaaggtttattatggacttttggtttagaccttaaatatgaatttatcgtactcttttttaaaaaaaaaattcttcaccatctgccactacaatttaagaactacatctatgattttttttagaaattttaaatttggttaaaattcctcaaaccctaaccgccgataaccgatctcagctcgtatcccacggtaataagagccccgtaaccacgtgatttcgcaaaccctggtcccggcatgcagaacggctaatgattaatgaactgacgcgtagtagaaataaacaatctgtgtcagcgttcgctacaaactacggagtactacatttgtaatttggattattgcacactcactggcaccttgcgctgactgggcataacctgagaatagagaagagggtttttgcacctgggagcagttaacggattgctgggttaggtttagactttagatctggactaacctctcacacgccgctgaagcccacgttgctcacagttccgaccttagcgtatgacgccggcgaggcggcgactgttcatcgatgtcgtagatgcagagatccccgtcgttttccctgaaattcttcatgaactagacgcggttccgtttcaggttgcacgcgcaggcgtagcacgaggtcgcggcgatcccatcggacaagaggaaaacttactccgatgtcgggcacgcgcgccaagcccggcagctcgtcggagaggtcatcctgtacacggagactgcgctgatcttcctgtcagcgaagtccaggaaaccgagaaggacctggaacagctcaccgtcagactgcagcagccagacgttgccggtgtccactgtccacgccttgccggtgtactggcgtcgaacttggcgaccggatcggagaggacggtcgggaggagaggtcaagtcaaagtggacggtgcacatctcatccgcgttccattcgcataagatgaatcgcagcgtccctcccacggcggcgatggccgggatcgtgttcttggtgaggggtgtggaagtaatgcggaactcctccaggcgtcgccgttgacgaggcataagcacatctcggggtcgtgggtgtcgacgagtatgacatctgcattggcattggctggactgcccgggcacggacgccggcgacctgacgggatccgcgactcgtagctggactccgtcttaccggcacggggcggactcgtgcaagtctaacgcccaatggagaagttgacggtggcgtggccacgtggggaggttggtcatggttgatggtcccacacggaaaattcggcctaactacctggaaggccaccactgcaagtggcccacaaagaccaacggagattggatagctacaaataaataagtccactttgacaccctcgtaccatctgattcgtatgcctcaaccattagatattttgtggttttcactgacgtggcacgttgacatagtccaccctaccgagacatcatgtgggacccatgtatcagtgtccagcttcctctatctctttcttttcttatcactctcttataacaggtcatcctttatatgaagtgtgatgaagtcatccttttataataggtctatgacggttgtaggtcagtggttaagttggtaaatccatgtaatagttattggggaccaataaggaagcgccatgtggaagctagcggttagaggtgccgaggttggtttggccgaaccacctctggccaccgactttctttagtctctgacaagtgggtcctatggtggttgaggatgctttggccccactttagatcgcttttgactgtcatgtgggccttccaatccttgtactcgcacttgattggccggaggttcattttgtctcatggcgggtgaattctcttcttaaatgatctgtaaacatatttctaccaaatctagtgaaaatagttaataataaacccgccacattctgcccctatggcaaaattggttatatagcatcaaaagttcacatttttggttttatagcaccgaaagataccggttcactttaatagcattcaaagttcatgtaaaagtagaatgcatggcaatgaggggatagaaacgtcatatcgtgtgtgtggctgggtaaatagcgatcaacgcggacggaaaacgatcgagaattgacggaagtgttaaaaataggagtggggtgaactttgggtgttactaaagtgaacctgtatctttggatgctataaaactaaaaacgtgaactctcaatgctatataaccaattttgccaaatggggccagattctgttacggcggcagcgtcgagccgccgaggtgttatcgtgtccgcgtccaagcgacggcgctccgctgcgtctgcgtctcgccgcccacggcagcgacaaccataatgcggtcgctggctgctgatgattcatgcgtgatcgatcaactcagagagagtcagttaattccttctggaataagtccattttgcctccctcatctcttgcgcttggttgaatcgcatccctcaaccgcaaaaccgggtataacatatcccccaactcccaaaaccgttgtaaattgactccccggacggtttcgaaggcggttttgtcccacgtggcatctttgaccccgttgaatggctgagtcatcaggtgggacccacatgtcagccagccggctgctggtactgcgtgccgacagggtggccttttcctcctcgtcatcgtcgttctcgcccgacgacgaactcgagctggcggcggcgggctggcggccacgttccgcatcccgccgcagctagagtgcacgcaacaggctgggagggggctagcggcggcgttctgcatctagtcctcttcgtcgctgtcctttcccgcctccccaatcaacgccacctggtccgcacggtggcgagcaacgatgacggcaggaaccccatgggtgtcaacacgaggtcctcgatggtctagcgatcgtcgtggaggcagtgtgcggaggcgatgatgtacgtgccggagatggagaactgtgccaccttgacgctgagcggcctggcgacgtcgacggtccacggcgtggggaagtcgaagagcgcaacatccaggaggatcctttcccttctcccctctctctcctaggatgcgggcggcaggcagtgagcatcggctgccggcgggagaaggcggcaccgatggcgacaccaccaccacctcgcggcgagcgggacggcatcggctgtcggcgggagaaggcggcaccggcggcgacaccaccaccacctcgcgacgagcgggacggcatcggctgccggcgggagaaggcggcaccgccaccacctcgcggcgaacaagacagcggcggcgttcggagagtacaagatctcccaggtccagccgaccgcgaccaccctgtgcgctcctcccaccgcccggccaaccgtggccacccggcgagctcctccccggtgcccagccggctgaggcatcccagcgagctccatccgcgcgtccaggcggccgtggcctcccggcgagctctatccacgcgtccgagcggccacgacctcccggcgagctcctcccctgcgctcggctggccgcgactacccagcaagctcttcccccgcgtccagccggccgcaacatcccggcgagcttctcccctacgcccagccggtcgcggcctcccagcgaggtcctcccccacgcccggcaagccggggcctcccggcgagctcctcccccgccgtgccgctcgagccaatggaaggcggctgtgagagatgagaagatgaaagagagaggggaggggtgataggtgggtcccacctaattttttacagtgaatgccacctagatgccacgtggatgccacataagctaaaactggactcaatactgccttggaagtcgatttgcaccggtttttggagatgagggagtcgttatacctggttgtggttgagggatgttattcgacaaagggtaagagatgagggaggtaaaatggacttattccattccttcttccaccgccataagtgggccacaaaagaccaatggctcataggcagacaattttcgtctccgagtaaatcatgggctttatatgcggccgaatttcaaaccaccggtcaatgggggtatctagcctgctacatcaattgaacgtaggtcaaaactgaacgtgtccacaagaaactgaattccgcttccattttagtatagctggacaaattccagtatttttctcagctaagatgaatcagataaacatttaggagtactaagtactgcgagtcacacattacaacatacaaaagaaagctggtaataaacgagggttacagtcctccaaagaacagattctaggaatacaacagtagcaatatctatagcaatatagaaaatgcacagatttgaaattgtataataacaacagtgttgatacaccttatcaagcaacaatgaccacaggctccaagcgttcggctctgcagcttgctttgcggccgcacatatcgccgcatcaaaagcctgctgctgcctcaatggcacatcagatacagggagaacatccataccagcccaagttgctgaaagcctgaagctgaaagcaacttcattcatcttcacgttttgttcgcagcgtccattaaaagtttaaaaccatcatttgtttccagctaactgtttatcactcgtctagtaagattaaggccttcagttctgggtcgtctgctgcggaggagggacttgagcctggtgcagcgttgctggtgcaggttgttgtgatgagctagcttgcgactgtgctggtgttgccaacatcggctgataaggcggatactgcggtggcggtgggtatggcatgcgaggtgggggcatgtaaccgccatacggtgggtagtagggtgggtactgaccatggtaatattgtggtggcatagggtaactctgtcctgagctgcttgatgcctgagcttgggctgcctgctgtggaccgggtttgccatcaccctcctgtgacttgaccaaggcacccatcctctggggatccattgaagggtacagtgtccgctctgctcctggcggtgctggaatgttgaagtagtatgatcccgatggtgcttgctgttgtccctccattccaggtggttgaggctggtcaccactctgctgctgagatataacagccctggggagcattcctccatgtgcaacatgcccttgccttccagcttcatcgtcttctggctttggtgcttgaggcttaccccacatgagcttcaggcgtatacccttgatgactaacttgttggcaagctcctctgcagctttctcagcaccttctcttgtagtgtacgtcacaaatgcacaggcacgttgcagaaccatccttatggactcaatttcaccatgtgcgtaaaattgatccctcaaatcctgctcggtgattcgattattaaggccaccaatgtaaagtgtccttatactctcatcgtctggaggtgtcagggatggcatctcaccggccttacccaaaagtttcaaagcaactggatcattaactctgtaatgagcaagaagagaatgcgtcagagaatgtgaagtaatatataaatagaactaagtgcaatatgaaccaaaagagtacagtgaagaaaaaaaacaagtcggttcatctcacggacatgattaaaccatcagtaggtgtgcatcaacaagatctcaggtgtgctaccacaccatattgtactaaacaatgtaaagtccaatttgattgaaatataccaagatttcttttacttcatcattcatccatccatagacactgatgatggaattcatatccagagttacaagtactatgcatgcagatgctggtttgcatcctgagacactacacatggatttagttttgatgatagtcttaatattaaaattagttagaaatagcaggtctaacagatataaaaaaggatcaataggcatctttggagtataatgatcattaattgttgcctcttaatgagaaataaaaatatgctaatatccatagagaaccaaaacaagcacacagttcaaaaaattgtatgcacaatcagcacaaacatacccatagtaacgatctttaatgttctgctgagataactctccagtttcaggcatctcatgtcgataagggcattcagcacctcttgtacattcaccacgcacatagaaactgcagacatgagctcgattcctcttgtaatatggtgccgtcctctgaagcttcagaatggtgtcattgggacgtgccttcccatgggaagaatcataatctattccagccctggcctacattttgataaagaaagcctaccataagaacaaataatccatacatttagaggcaggaagaataattagatcatgattaacataggcagaaagcatgtgcaggcactctgccggaccaaactacttaaaaaagggtacatcgtttgttatttgagatcaacacacttaaagtgcattcattttatattccttacaacattaggtttctggtctaagaaaacccattaatttccttaatgtgttatgctactagaatagactagacaataaaaatggaaggaacactgtggacatactagttgcagggaagaaaaatgaaaatagcagtgatatggacataaaccattttagatgagtattgtgaaagttgatacaaataataagttgtgaaaaaggagacataccttgcgatcatgctcttctgcaaagtactcacggttcacatcactccttgggattgcatcatttgaattaatagcgagtgctgtatccctaacctggaccggtagaccatattcaagatctagcaggcagacctggcagacatttttcagtttgcaacatgtctggcagatctctgtcttcttgtatcttgcatcccggccaggtcgccaacggaagacagtaaacggacgtgcacatattttgcactctttatcatattctgctctcaactgccaagacaaacaagaaagacagtaaatcttgtgtccatatcaagatcataagcaaactaaatgtgccgacaatgataaatttgattagtaataaatgtttggatgtggagacaatctcatccacatctaattgcttagtattggacccctacacaatgcctggtcttctgcttgacaatttgttctcgttttcttggctaggttatcctccacaaataaaattctataatcatactactgcaatttgcgaaacaaacaccatttcggtacatgaaaccaacaaaatccaccctagagcagcaatcttttcggcctaactcgtcgctaaatcagaacaactacaacaacacacgtaccgcaatacatcccacagaaaccgacgcctaacttttgacccccgatctaccccaataacaacagcaatcgcaaaccaggcaggctgaaatcaccgcgcccgcagccaccacatgaaccaccaagagcgcgaatcaatcagatgcggttagggtttgtgggggggcaagagacacggtaccatgcggacgtaggggttgtcgccgaggcaggactcgcagatgatggggaagtcggaccgctcccacccgtccgcctgcgcgtctcgcagcagccggtgagccatctccgccgccgccgcctccgcctccgccgccgccgagaaagacgagaggaaagagagagagagacgaccgagacgaggcgagctatctgatttggctttcctccctctttaaatgggccttattgggccgtactaccttgcgtgagcaaaacgtgggctgggctggtatgggccgggtcagtgggccggaccagatcagcacagtggatactacagaaattttgttgcagcttgtggttgtcggtggttagctggttctctttcgtgcagaggaaacagttagaaacttaaaattattctgcaactttgtttttaagaaatttgcttaatttcgtattccctccgtccctaaatatttagcgccgttgatttttttaaacatgtttaaccgttcgtcttatttaaaaaaattaagtaattattaattattttcctatcatttgattcattgttaaatatacttttacgtatacatatagttttacatatttcataaaagttttttaaataagacaaacgattaaacatgtttaaaaaagtcaacgacaaatatatagggagggtgggagtacatcttgttgagtagaattgtcctgtatgtttgacactgaatatcctcttgaagtggcggttgtatattttttttctttcgccgggatggcgaagaatgctgaccgatgtatattaaggaaaaggggaaaattgtacaaatgcagtgcgttagagcaccgcctttacaacaaaaagcaaattacaaagtctgtaatctctctaaagctggcactgcagcaacattcaacgaggtaactagccctgctgatttccaagtaacccattcatcacacatggtcgcacacagctgcatgaccgatgaggccgttccctcgaaaacccgtgcgttgcgctctttccaaatcaaccatataatgaggatgaccccggcgtcgaacgtcttgcgatcgatcttcgcaacagtttgccgggtagcgagccaccaactggcaaagtccgaggacggcggcgagcaggagaggctcaaacgagcctgaacctgcacccaaacttgctgcgagaaggtacaggcttggaagatgtggcggctgtatatttgacgctatgcgttactggctctggtactcttgattgttacttgcatatttacattaatttttttttgttgctttgagtaagattggtgatcacaattgaaattcaactgggtcgtcaaatgtttataacgggaggatttacaattggtgatcagatcacaatcacagaagataactgaatttttttaatcacttgctatatttggacagctcctcctccccgttttcccgcccacgcgaacgaatcaacgaaccatcacccgggtgcagcatctcaccaccgcacctctcgctgcacaacgcgcagtacccgccgccgccgccgccgtcgccgtccgcgagcgcggtgcagctctcgacgaagggcgtggtcgccgaggtagtggtagcgcagctcggcgatcgaagaaccggcgcggcggcccaggaagttgacatggaaccaggcctcgcccctgtacgccgcggcggcggccaggagcggctcgacggagtcgacgtcgatctcgtcgccttctcctcccgcgctgcatgccggagtcttagttgcggacggcgtggtggaaggtgagcgccaccttggcgaagggcagcgcgagatgcatgagaagggtgaaagactgaagggaggagaaggacgacgacgacgaagaacgagagcacaccgacacctagacgagcgccaatactgaccccatcagtgcctaattgctctgcaaatgccggggtacatgtttttttttaattacagtatataatttaatgtttcgcttgttactcaaccgtcaatatttagacggtgttcttttagagggttggaactctcctctccattgtaatatttagacggtgttcttttggagggttgtaaccctcctcttcgcatgaaaaacggagcgatagattaatacacgattaattaagtgttaactataaaaaaaatgtaaaatagatcaatatgatttttaaagcaactttcctatataaactttttacaagatatgtaccgttttagcggtttgaaaagcgtacacacggaaaattaaaaatcagtttgaaaagtacacacgaaaaattaaaaatcagtcgatttgttgaccgcatgatttactttgagatacgtgcatctgccgttgagtgaaaaaatattcgctagaacaaggaatcgaacccatcagggatgccacaacatgcgccgtaccaactgagcaagcagcagacgacagctttcattctatacttaacttttttaaaactttcactgcagttacattacactcacacgattaaaacgtaagtgtatagatggccataaggcccggggcccgacggcccggcccaaggcacgacaaattggcccggcccaggcacggcacggcccgactggggtcgtgcccgtgccggcccggcccaacagccgggccgtgcttgggccgctccctcggcacggtgggccggcacggcccggcacgaaagaggtcggcacggtgggccggcacggcccggcacggtccaacggcaggcacggcccgaccgaggcctgttatgccgggtgggtataaataccccaaaccgcatcaaaccgacaaaccctaaccctagccacatcagtctggagtctcgaccgatccgccgctcgcccgctccgcctccacctccaggctccgacccctcagccctccacgcctccatccctcttcgtcggcgtctccgatggatgcctcgccggatctagcaccgagggtcagcgggctcccgctggaggcttgagggtcgtctcttctctatccttttctttcatctctttggctgatctgtgaccgtgagctcttcgtctccgcctctccggtcaccggatcgacggtcgcattgtcgatttcctctccattctgtacttttttttgcaaccctcatcgtttctcttcgtcagatactcagatccactcatccaccccccaaatctagtctctcctcttgtcttctcgtagatctgtggatctctatcatcaacggcaactccggtgctccggatgcgcaggtacaagctttttttttagtttattttctctattcgatcagatccgtaactactctctgctctcgtcgttgtttcatttgttcttgcaggtcgctgagcggcaggcggcagccaccgttgaggaaccggagtgcctgcgatggatggtgatccaacctcatgcaactacgaggcgagggtgatggggacgcagggtgatgacgaagatgacttggaggaggaacgcatcgaggtgtttggcaacactgcttcacctctgagagatctgtcgcagccggagccacacgatgatggtaccggtgccgatggcaacggtgctccgtctggctcaagtgctagcaacaagaggtccaggtctgaggtatgggacgactttgaagaactctttgaagagcgcaatggcgctcaggttcgcgtttctgctaaatgcaattactgtcataaaacattgtctgctcgttcaactggtggtactggacatttgcttaggcatattaaatcgtgcaaacctagaaatgttggtgctttgtctcagtccatgcttaggtttaatgctgatggttctgttagtcaatgggaatataaaccggatgtggctagaactgagttggttaggttgattgctagagaggatcttccacttacttttggtcaatctgctgcttttgaggagtatattcagaatgctcacaaccctagatttagtgttgtctctaggcaaactatcagtagggacgtttttaaggtcttcgacaagagacgtgctatgcttattgatactttgaagtctgttagctctgttgctttgacatctgatatatggtctggtaatgctaaggaggattatttgagtgttgttgcccattttgttaattctaattgtcaattagagaagaggattttgggactggtgctaattgatgtgtcacacaatgctgaaaatatttctgaacgtgtgctttctgttgttcaagaatatggtttgactaataagatcttctctattaccctggacaatgcctctgctaattctaaagcaatggatagtcttaaacctgctctgtctggttatattggtgatttatatttgcatcagcgttgtgcatgtcatatcatcaatttaattgttaaggctggtctagaaatcttcaaacccatgcttcaagattttagaactgctatttcatttataaatgcatctaatcagcgcattgctttatacaaaaacttctgcattgctaaaggtattcgtcctcgtaaatttggtttggacatggatgttagatggaatgcaacttatctaatgcttaagcatctcttgccacatagggtcattttttcagtgtttattgcatctcaccatccaatggctgatggtcagccattactgactgatttacactggacaattgctgaaactgttcttttattccttgaacaattttatgattcaactgttattttgtctggtgtttattatccaacatctccattaattatgcatcacattcttgagattgctggacatctaaatacttatgagaatgattggaaccttagaaatgttgttgttcccatgaaaaataagttcttgtcatactggtctgagattccatttctgtattcatttgcttttatcttggatcctagggccaagatcaggggttttagcaatgttctccaaattatgggacaacttattagtggtgattactctgcatatttaaatgaggttagggctgcattgtctgacatgtatgctaagtatgaaagtaaatttggtgctgtgagattacaaagggcaaccccaagctcttcttctggtaagaaaaagacagcttgggggaaaatttttggtgctgctgcttgtggttccagtcttggtgctggacttggtgctggtaatgctggtgctagtgccagtccaggttctggacttggtgatgctggtgccagtgcaggatctggacttggtgctggtgcattttctaggagaacttctgctaccgctttgattcaggctgtttcttctactgctaacatgaatgcatctgagttgtttgcctatcttgacagtgacactgtcaaccaatacgatgatgacttcaatatccttaactggtggcatgagcacaaccacacctatcctattctttccatattagctagggatgttttgactgttcctgtttctactatatcatcggaatctgcttttagcttaactggcaggatcatcgaggagcgacgacggcgtctagctcctgacatggtgcaagctttggcactaatcaaagattgggagcaagcagatgcaaagatgcaacataccatggagaatttagagcttataaactcttttgacaatttgtttcttgatgaagtaaccactgccactgggactggatgattgtattggacttggactttattatgaacatttgattaatgctgtgggctgcactcttttttcctttctagggttttctcacgaggtgtgagtttttacctagaaaggtttttaacgaggcagccattgcactacacagctactttattcattgaaatacttgtgtcaagtttttgggtgaaagtttatgattttgggtaatttttgacttagtgaaacttttgaatcttagaactgtgatttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtgatatgtgatcttagtcaagtgatctatgaatttttgtcaatgtgatctgtgaatctttgatctgtgatctgtgaatttttgtaaaggtgatatgtgaatctagaactgtgaattcaactaaggcatgttcaaatttgaatttgtcaactaagttgtgtaagttgtgttatttgaatttgttaaccaaggcatgttcaaatttatatttgtcaactaagttgtgtaatttaaatttgttaactaaggcatgttcaaatttgaatttgtcaagtaagttgtgaaatttgaatttgttaactaaggcatgtttaaatttaaattttgcatgttcaatccattgatccattgaatttgtcaatccactgaattactggtccactgatccactggtcctaagccgtgcctgggctagcccaggcccaatgggctgatcgtgccttcgtgtcggcccggcacggcacggcccagtagcaatcgggccgtgcctgggcctgacgtgcggcccatgggcaggcacggcacggcacgaaattccaatcgggccgtgccggcccgatcgctctcgggccgtgcctatccgtgcctgggccgggccgtgccgggcgggccttatggccatctatacgtaagtgcactacagctacaatgtaaattttagtatacgcgggtgcaatttttgttttacatgtacggaatttttttactcatcgtttatgaaatgaaactatattcgagctcagtctaatttattaatttgcttggatggataccaagctctcactgtactgaatggcatagtgcatccaatccccatcacagcggtccagcttgcgccttgacctgtcgaagtaggtcatctcctcgagcatgtccaccactcgttccacaactctgcgttcgacgtcgtaccggtaaatcatggcgtaatccacgtagaaaaatatgcctccttggtaatcgtaggtaaactggaagaaggtgtcaaaggagtgcggtagcacgacggtgcattgcagcgaccaccgtggcctgctgccccctccgtcggcggcggaagctgtccagagctcaactctatcgtcggcgggagcatgcacatagcacagcttgccacccagctccgtcaggtccccacaagcgacgtcagacatcttctgccgctccatgaacggtgggcacgggaaactggcgaactcctcgctgcacacgtcgaagcgtacaatccctggggtggtgcagctgccggtggacggcgacggtagggcggcgatccagtagatgccgccgaggatgcacggcgacgttttggtcttgatgaggtagggtgggtcggcgaccggcctccacgccggcgagccgagggacaaaacctcgcatccgacgctgtagtccgtgtaggtcttgtcgcagtggcggatgaagcagtggaccaccttcgtcttgcccgtagattggtcggcgtagaagcttaccgcttgcaccccgaagtagtccagcgcacagtccggtagctcggcaagctccttggtcgccgggttgcaaactaacatctgagtggagtacttcatcgtcgagcgcagcaacacgagcccgttgcagtgcagatgcatgccccagccgatggcgccaacgtcgtcgtcccagtcgtcgtcgtcgtcccagtccgcggcggcgtccccgtcgtcgacggcgtcgtccaagttgtcggcggcggccccgtcatccgcggcatcggccccgtcgtcgacggcgtcccagtcggcggcagcgtacccgtctgcggcggcggcgacggtcgacttcgagttcgaggaccatgttatcctatgcgcgaagtccgcggcgacgccatggcccggatagctaaagaagtcgatcgttcccctccattgctctggcacacaccagtctgccaggacgagcatggacggtgggtgatggcgcgccgccgtggtggagtggtgcagctggaggcgaacgaagtgcggctcggcgaccatggagcgccacgacttgcacacggacctgaaccgcaggatggacttgacggggagacggaggaggatttgctcgatgacgtcttccgggatgccagccgccgcggcgccggtgggttcgacgcaccgccgccgcttggccacgggcagatcaccaccatgtcccggctgattcatcatatcacgttttcccgcgctcgcacaagccatcgatagcaagcgaattccctgtaactaaaacaagaaagacttttataggaagaggatgcttgcattgtccgaatcgtttttactttttgttttttgattcggaatctgcatcagttctgcaatcaaatcggattctcgcctggctctcggagtcggagccgtacgtccgttaatcttgcgtgtcgagtataaattgcgcccaaatgaaggcttcgctgagagaggcccaagccagcattggcacttcggcatcagatcacttgggcataatggcccataggccatagctaggggtgaaaacggtacggaaatcatctttatcgttttcgttttggaatcggaaactccggatacgaaaacggaatcgaatattatcaaaaccgaaaacggagcgaaaacgaaccggcgtgaatacagtaacgaaaatttatcggaataaaaaaaccctcaaactgataaatccgattctcaagtctcaacggtcaacaattcatcataaacacaatcatataagtccaattgttaagtatcaatactacatcacaaaacacaatctatggaataaattagtaatgctgttgataaatcccaatgtagaaaaaaatattcttatataattttagatttgcataacaattttttttaaaaaaataaccgctaaacaccatggtattcactattcagtgcttaaaaaagtaatccagggtattttgtgatttctggaaattctgagaaaaattctaaaaattcctagaaaatttccggaaagtttccgaccgattccgagttccgacgaaaactgcccttatcattttcgattccgtttccgaggaaatatttctgaatccgtttccgtttccgaaaaatttcgaaaaaattccgaccgacagattccgttttcgaaaataggttcggaatgtttccgtactgttttcacccctagccatagctaattaacaacccggaaaccaaaatgtttttgatagtttccctttctgaacctgaatcaaccaaaaaaaatgaagacatccagttctctgtcattcgatctgaatcagcgaataactctgaagagattaatgaagaagtgattgtcagaggttctgctcctgtagttctgccttcctctaggcggcatgaacattggggtacctcaaccagagagcagctgaatttcgcaaaggaacaaaaaaaaaagacaagttaattacagatactacaactcacaagccattcaatattcagagatcagttgaaaaaaaatctggggtcaccgttttgagaaagaagagaatgaacagcaaaataaaaggggtgactcatctagaaaccaggacaatgagcataaactggtgtcatgatttaacggtaagtcagcaacagtgttgtctattgtataaatgtatgatacaactgtacaacagaacctttttttacagtgaatatacacaatgcatgtaaggttctctgaaagtctaaaacccattttcttggacatgaaagagctgactgagatgatcatggttttaatccatcaacactactaacaagacaaaataacaaaaggagcatgaatatgtatgcaactagcaagtcattgttctgaatcactgaactagcttcaggattgtctaatctatctattatcttattaaagtaataaaaaaagaagccatcacgtttggtctctcacggtctagaaattctcacattaatcggagaaaaataaaaagtagaatccatataataatacaatttaaaaatagctgaaattcggaattagaaataaggaatattgaaagagtagactagagattggcatgtagagtcctattatatttttttgttgtttcgctgattcctgattgtaactgcaccaagtgttatgttagtcgaactgttatcaatactaccgagacggtcgatttacattggttttaaaagtttgcccgattttattattaagggatgcaaatcaaaacacgttctatagttgaggggtgcaaaatagacattcttactcatttacattggttttaaaagttaggggcgcttggctattggtgcttcagtcggcgagcggcggaggtggcgcagggggctcttgatcgtggagttagatatgggcaagtatggcccgcgtgggggtgtgtgtggctatataagcttgtgttctggcccatctcgtagcagcccaaacgtgttcaaccgacgcagcaagtttcaggatactcgacacgcaagattaacggacgtacggctccgactccgagagccaggcgagaatccgatttgattgcagaactgatgtcagattccgaatcaaaaaacaaagaagtaaaaaaagattcggacaagcatctttccccataaaagtctttcttgttttagttacaggggattcgcttgctatcgatatggctcgtgcgagcgcgggaaaacgtgatatgatgaatcagccgggacatggtggtgatgtgcccgttgccaagcggcggcggtgcgtcgaacccgccggcgccgccgcggctggcatcccggaagacattgtggaggaaatcctcctccgcctccctgtcaagtccatcctgcggttcaggtccgtgtgcaagtcgtggcgcgccgtggtcgccgacccgcgcttcgtgcgcctccagctggaccactccaccacggcggcgcgccatcgcccaccgtccatgctcatcctggcagactggtgtgtgccagagcaacggaggggaacgatcgacttctttagctatccgggccatggcgtcgccgcggacttcgcgcttgggatgacatggtcctcgcccgtcgccaccgctgccgaggtatgatgtcgccgactgggacgccgtcgacgacggcgacgacgacgataacttggacgacgccgtcgacgacggggacgccgcggctgacggggacgacgccgtcgatgggaacgccgacgacaacggggacatcaacgatggtgccatcgggttgggcggggctctgcactacaacgggctcgtgttgctgagctcgatggagaactcctctataatgttagtttgcaacccggcaaccaaggagatcgccgagctgccggcctgtacgccggactacttcagggtccaaagagtatgcttctacgccgaccaacctacaggcaagacgaaggtggttcactacttcatccgccactgcaacgagaccctcacggactacagtcggatgcgaggttttgtccctcggctcgccggcgtggaggccgctcgccgaccctccctacctcgccctgaacaaagcgtcaccgtgcatcctcggtggcatctactggatcgtggccctaccgtcgccgcccaccggcagctgcaccacccctggaatgctacgcttcgacgtgtgcagcgaggagtttaccagtttcctgagcccaccgttcatggggcggcaggttatacgtgacgttagtggggccctgacggagcttgccggaaagctgtgctacatgcacgctcccaccgacggtaaagttgagctctggacaacttccgccgccgccgacgacgacgaaggcggcggcgggccgcggtggtcgctgcattgcaccgtcgtgctaccgcacccctttcaaaccatcttcccgtttacccacgattaccaaggaagcgtatttttcaacgtggattgcgccgtgatttaccggtacgatgtggaacgcggagttgtggaacgcgtggtggacatgctcgaggagatgacctacttcaactgttcaacgcacaagttgtaccgccgtccaggggactggaagctccgtaccattcagtacagtgagagcctggtatccgtccaagcaaattaattagattgagtttggctatagtttcatttcagattacacacatatatattaacccaattttatccgatattttgtaagactaacaaatttttcggtgcattgcaacatgtaatggaaataaggacaaccaacgattgggttcaacttttgtaattaattactcctagtcctgtaagaaaatatattcttcactcaaagcaagtcgaatttcaatcaatttcaatcagggggcgcctacggtgtctacaaccacaccaccgatgccgataaaaaaggtagagaaactgaataccagaaatagcgtgtccttcaactcttaaaatcgatgcaaaattaaccccaagaaggttagaatagcggtttcggcttgatgtgacgtctacctgtctagtttgactggttcctcgttccacgtgacattaattgatgtggcacctataaaaaaacagtgggatccacgtgtcaattagagcaggcacaatagcaggctataagccagctataaacttattttaaagatataaaggaagagagagaagagcagcgggctacagatctgtagctagctgtagcacggactccaagatgtaatgtgtgtatgacaggtggaaccgggcattaatagtatagcaagcaactaattagctattacattggctatagataatttggagctagtagtggactatactactagcaactatgtactattaaacttgctcttagtatctgattagaaataaaaatatgcaataggtcccaccttccttttcttttatttccttctcttttctttcttttttcttctttctcgctgcttcttcttgttctcgagatggggtcgccggggtagatgctaacgcattggagctcgctcccgcgataggctagctagcctagcactacggtgcatggcgctgtatgctgtttcttccattaaaatggtagggagagaaacatggagtagtattttcacttcactttttaagaccattgatattaactaattaagcttcttgttgatatttcacgttgaaaaattgagctttcaagcctgatctgctacccgccgagaaccatagaagttgatgcgctgtaattctgcggatcccaatccaccgtcgtcaggttgtacaccgccgagagcgacgaacacctcttccatggaaggccactcccatggatcccgcgccacccactgaacggccagagcatgggactaatcgtcggtgacaaacgccgtcgtggcgctatcttcccggacaagagctcggacaggatgacaccgaagctgacgacgtcgagcttgagactgattaactgggctaatatttcgtatatccaaattattccatacaaaattcaaaagtctactgtttaactgggctaatatttccccagtcggccgtctctctaattaaccatttttaaccttgaggcaaaaccagcataattctaattttattggaatttattctggatcaaacctctatctacacctatctccaaaaatctatacttcctctccatccaaaaatattcaatcatttattctttgttcatactcctattttgatcaagtcgccagtctaattgtcgtggcttgatttcctccccggcacaagaatcatagtatcacaaatgtttgagtgattgctcttgtgctaagaaacttattcccaattcctttcatcagaaaatccaatttcctttagtctcaaatattacatcaaggatccctaccacatgttagggagggggggggggggctaaaatcctatttattctcttccagctatttttaccaccttcccaaaattcatccaaaattagagaccacgccatttgtatttccttctcttgcctaattgagagtacttcattttcaattttcaaattcttaaagaaaattgttcgtgacgagttttacatttggttcttattgaattctattaaaattggagcattttgcatccttttcaaatttatatttcaaaacgcagttgtgagcttggggtctgtccgcagcccaacatgactgtaaccttactctatgataaatagactactgttgttgtgatattctgtcttcctgtgataccagcactgtttcctgggactggtatcagttaacaggttaatttggagcgtctcgggctagtttcgcccgggactagttcggggcgtgacaaaagatggtatcagagcacgggcttggccttagggcgaaacccaacgttaggatgaccctaaggatactaagttataaaatctacttgcgaaaagctaaggcttcttttgctttccttctttcagtaatttattgttaaaatagttattgatatgtttctctctctttcaaaattgtaggtggcagtgaacgccagttacagtattcccacggctttggtgagggtcaccatgtcgatcagctccgtgaccttgcccgtttccttggcttctcgtgtcccgagtacgcggggtactctgtggaccgtgttcctccttgctgtaagctgtttgtgtacctttaccctcgtggaggtacatagggggctggccttcacccacaccacttcaatgtggccaggcccactctccagatcacgtactaggaccactcttagactgcgctctgtgtttggcccatgactacagccaccgcctctcagggtccgccttccggatggtcccttccttccctttggccacacagacactaagtacccttgtccctactacgagtcgcaccccgtgctgacccgcatgattgagctttctgaggctcaagccactcagcacgacctgctccttgaggcctaccgctccctggctcgccgctacgccgctttggaggctcgccttgttgaggagggtgtctcctccgtggacactatctcttgggattccgatcgtctctgccatgccagccacctgtccttccacagttcccgtggttctactcgcactcccagcggcccgcgctcccccagcttgcgtgtgccatactcgccagtgtagtctccctacccacacccagtcagtcccttttacaccgctggccacaccccagttgcttcctctcgccgtggtcctcgctttatccgcaccgcgtggaagtgcgttgttggtccaaagaagcccgctcgaacacacaaaatggcgtcgcagggccttttgatgcccacctcaatcgccagcaatgcacttatattgcgcactgacctcccgtagaataagaacagcctccagtcggttgggcagataatcccataaggatttgctatcaatactatagagacggttgatttacattggttttaaaagtttacccgattttgttattgagggatgcaaatcaaaacacgttccatcgttgaggggtgcaaaatagacgttcttactcatttacattggttttaaaagttaggggcgcttggctattggtgctccagtcggcgagcggcggaggcggcgcagggggctcttgatttctaggctcaccgacgaggggagagcggagggaggagaggagctcgtcgcgatggttacggctcggggctctcggtgccaaggcggccgcaatttgatggatttgtccccttcgttgacaggtgggcctcagggcccacatggccgatgacgtcatgctcgcctcgccggaagcaacgagagctagctgctgccggccacacccggaccatggcgcgcgcccagccacggcgaccaggccagcgtcgtgttcgacgactacgtcagcagagggatgccaaatgccatgctcgattgtgttgcgtgcttccctgtgacatcaaaagcaacaaggtcagcaagcgaaagactcccgagcatttcaacgaacacctcatgcgcgagtagaacggagcggcagaagcggcgaactcgtcctgtcgcggcgacggtgaacggcagtagtagaggccccaacagcggcagcggccacagatcgacgcccacatgcgttctgcgacgtgccgacctcgcaaggctgcggcgccgctcggggttcggtgtgtccaattcggaacccggaacccaccgtgacggcgaaccacccgacggtgaacgacggaagtgttactgcatcaatacagagcactacccgtaactctagtatcattgggcctagaagatccaaacgagaagtccacaccaacccaaagtatatgggctgtgattgggttactggttgaggaagtctataaatactagaaggatcttctagaggcgtgcgttggaattgaatcaaaacttctatctgaagaaatcattcctcctcctaactctgcttcctttttcctctgctctgaaatgctctgttctgttctgttcttccttctcatccccaatttcatctgtgattcgatctagggttcgtaacatcttggtatcagagcacgatcctggagcggccgacattcaagacgcgtttgcaaggtcaagtggacgccatggagaagcagcatgaaggcttcgggaagatgctgtccagtattcaggaggcgatcggcgccatgtcggtgaagcaaggcgaggtgcaggagacgatgaacaaaatggagaaatccatttcaagttggcgacctcaggttgatgctgcggtgcagagcttgcagcgcgacatggagttgctgagaaatcaagtcggtgcggtggagcgacatcaagcggaagctgacaaatcgtcgaacacctcgcaggcgttggaggagcgggaggaaattgctcgtcgcacatctcagttgccgacgtcgccaaccacgtctctgccagtatcgcaggcgttggaggagcgggaggaaattgctcgtcgcgcacctctgttgccgacgccgccaaccgcgtctatgccagcctcgactggcgaaattggtctggatggccaccgcatttcaactcagttccgggggagggcatcgggggtagtcactactctcgtcccacctccgggcaagggtacgcactctctaccattttctcctcgtgttcatccaaatttttcggagtttgttggtcgcgaggagagtgggggatcagtggggcgtgggtacaatcacagattgccgaaattggattttccccaatttgatggcagtgatcctcagaattggcgtttaagatgtgaacattattttggggtttatggcactcatccagatttatgggttagagtagctaccatttatttcattggtcgagctgcatcttggttacgttcttcgcgagctcatttgctttgtgggaattggggagttttttgtgatacggtggataggaagtttgataggaatagacaccttcagcttgttcgtcagattgatcaactcaagcagtcagggtcggtgaatgagtattatgagcgttttgatgatttgtggagtcagttgttagtttatgatccaaccttgagcactgtgagttgtgtccatagattcacggagggattacgcagtgatattaaaaatgcagtgttaatgcattttccccaagatttggagactgctttggctcttgctatcttacaggaggaattgggagaggctggtggatctttggtgtccaaggatgggaagaaattgggtgatcacgctgctcgaattaaaagtgcttaccctttacctttaccaccacccaaatttgtgcatgctggcaagggagatgataaaagaacagctgaagttcctaaagtggccaattcttctgataaattggttgctctcaaggcctatcgacgagctcaaggtctttgctatgtttgtgctgaaaaatggtctcctactcacaagtgttcaggatcagtacagttacatgctgttcaagaactcttcagtgttttggcagctgatgtttctgagggtgaacaggatgctgattctatctctagtttgatggctatttctttacaggccattcaaggcacggtttctgcacatactttgcgattacaagggtccattcaaggctttgatgtgttaattttggtggattcaggcagctcttgcagttttctcagttcagtggttttacctcatctcactggtgtgaaatctttacttactccagttcaagtaaaggtagccaatggtgctgttctttcttgtacctctgagttgccggctgcaaaatgggaggttcaagggcatcagttctctactgatttcaaactgcttcctttggacaattatgatatgatcttgggtatggactggttagagaaatatagtccaatggatatcaattggcaggccaaaacaattcagtttggtcttcttgataagtcagtggaacttaaaggagtggtaccggaattggataaatgtgatctggtctctattcatcagttacagctgttgcacaatcaaggagctgtggagtccttggttcagctcactgccagtgacggctctagttcttctcaaaatgttccaagttcaattcagtccattttggatgaatttgctgacatttttaatgaaccagacgggttgccaccttctcgatcttatgatcacactattcctagctggttgaggtcgcgaaggttgacgctgttccacgaccacccggtcctgggggccgggaggtaccgcccgttcgcggcgctgtggagcatgaggatgtcgccgccgtcgaggtggagtatgtgcaccgtccacgccgcgcggtcctggtgcaggtagacgccgctcccgtcctcgccggcgcggaggtccgcagccacacgtggtgcccgtcgtggaacttctccattgcctccggcgagcggcggaggcggcgcgggtctcttgctttcttggcgctcccgtcggcgagaagaagagacggcgcggcgaggggagagcggagggaggggagcagttcgctgcgctcttggtttcttgcgccgcggcggaggcggcgttggccaatggcctcggcagccaacctgcgggcgtcggtgccggaggccgtggcagccagtcgacgatgaagaggcgcccgccgccagccgccaggcgtcctccagagcatctaggccgctattggcgttcagcttcggcggcgcacggacgcagaatccttcctcctgctcggaggaaggccatggcgacgggcggtggtggtggatgctggcgctggcggtgggcgcgagctcgacgcgcctcctcggcgtcaagcggggccttcatgcaacgacggagacccattggttggttgttggtgttgctggcgcgggacgtgttctggcccatctcgtagcagcccaaacgtgttcaaccaacgcagcaagtttcaggatactcgacagggcacgcaagattaacggacgtacggctccgactccgagaggcgagattccgatttgattgcagaactgatgtcagattccgaatcaaaaaacaaaaagtaaaaacgattcggacaatgcaagcatcctcttcctataaaagtctttcttgttttagttacagggaattcgcttagtatcgatatggcttgtgcgagcgcgggaaaacgtgatatgatgaatcagccgggacatggtggtgatctgcccgtggccaagcggcggcggtgcgtcgaacccaccggcgccgccgcagcctgcatcccggaagacgtcatcgagcaaatcctcctccgtctccccgtcaagtccatcctgcggttcaggtccgtgtgcaagtcgtggcgctccatggtcgccgagccgcacttcgttcgcctccagctgcaccactccaccacggcggcgcgccgcgtactgtcaggctggcgtatcctacaggaacggatgggatcgatatgcttctttcgctacccggggcatggcgccctcgcggacctcgcgtatgagatgacatgctcctcggccgtcgccaccgccgacgaggatgataccgccgactgggacgccgtcgacgatggggatgccgtggatgacggggacgacgccgcggactgggacaccgacgatgacggggacgacgctacggactgggacaccgacgatgacggggacgacgctactacggattgggacaccgacgatgacggggacggcgccgaccggtacatcaacaatggcgccatcaggtttggcctccctctgcactgcaacgggctcgtgttgctgagcacgatggagaactcctctatgatgttagtttgcaacccggcaacgagggagttcgccgagctaccggcctgtacgccggactacttgaggatccaaagagtaggcttctacgccgaccagcctacaggcaagacgaaggtggttcgctacttcatccgccactgcaacgaaacctacacggactacagcgtcggatgcgaggttttgtccctcggctcgccggcgtggaggccgctcgccgaccctccctacctcgtcctgaacaaaacgtcaccgtgcatcctcggtggcatctactggatcgccatcctaccgtcgccgcccaccggcagctgcaccacccccggaaaaatgctacgcttcgacgtgtgcagcgaggagtttaccagtttcccgagcccaccgttcatggagcggcaggagatatgtgacgttaatgggaccctgacggagctggccggaaagctgtgctatatgcacactcccgccgacggtaaagttgagctctggacagcttccgccgccgacgaagggccgcgatggtcgctgcattgcaccgtcgtgctatcgtacccctttcaaaccatctacccatttgaccacgattaccaaggaagcatatttttcaacgtggattgtgccttgatttaccggtacgatgtggaacgcggagttgcggaacgcgtggtggacatgatcgacgacatgacctacatcaaccgttccaagctgtaccgtggtccaggttacttgaagtaccgtaccattcagtacagtgagagcctggtatccgtccaagcaaattaatttattatgagttcagctatagtgtcatttcagattatatatatacacacacgttctgtgttcacaaaggttgtgttccaagaaatcgtacgtacggaaaacggagcaatctattagcgtataattaattaagtttaagataatttattttcaaaaatggattaatatgatttttaaagcaactttcgtatagaattttttgcaaaacacgcaccatttaacagtttgaaacgcgtgcgcgtggaaaaagagatgggagagttgggaacttaagaacacagctgaaaaaaaaacccaccttactctatttctatctgttcgttgttaacctctaaaaatagggtaggattgccctcttgtggtccacctgattctatttcaacacatttatattgaccaaattttgtccaatattttgtgagactaattacaaattgtccgtgagttgcaacatgtgataaaaataacgacaaccaatgattggattcaacatttgtactccctccgtttcgaaatgtttgacaccgttgactttttagcacatgtttgaccgttcgtcttattcaaaaacttttgtgagatatataaaattatatgcctacataaaaatatatttaacaatgaatcaaatgataggaaaagaattaataattacttaaattttttgaataagacgaacggtcaaatatgtgataaaaagtcaacggtgtcaaatatttcgaaacggatggagtatttaattctagccctttaagaaaagatattcttcactcaaagccagtcgaatttcattcaggagccgcctacaatgtgtgcaaccaagccgccgacgccaagaaaaagggaaaccgatagagaagaggaaggagagacatgtgcggtccaccaatttttttttatttagagtgaattactttgacatgtgtgttccacgctaactcagccaccacgtcaacggaaactgagtactatactggcctgggacataggttacacatcgagggacgcgttataccttgtattgcggttcatgaacgaatttcaaacatgacgagaaattaaggaacctaagtgaacttattccgggaaggaaagggtggtcggcctggcagaggaagaaggtgggaaggagagcgatgggccataggaggaagaaggttggaaggggagcgataggccggaggggaaaggttagtcttctgcaagaaatggcctagaacaaagatggggatttgaattgttttttcaactggttatttaactgatgatttttttcagtcatttcaattgctagctgtatgatatgacatatgattcatcatccatacatttgcagaagtttttttctacagcaaaaggtgtacatgaatcaaactcggcacaacgtgaagggaatccaagtagactctttgccatccgggagctagccaacaactcgtggccggcccaaacactttttttttctttgaaaccgtagccaggctaagttggagttatattaaggagaatagaaagtatttaatatcaccaaggaaggtgaaagagagaaaaaaaaagaaacatgaagaaaaatagaaaagaaacacacactaaatgaaataaaaatctaagcggatattctcgcaatattttttgccccacacatgctccatagcttgatttcgtcttatattttggcgaggagttgcggtatggtcttatcttgattttggaacacccttctatttcgttcacaacatattttccataccaccaacaagtggattgacttgagtgctttagccttgtttttcccaccttgagatgttcttctgatccacgaatccaacaatgctttattttcgtcacgtgggtgttctacgtcgctgcagttcagtttacttatttaggaatggaataagtttacttatgtccctcaatttgatgcagtgtctgaaatggaataaggtcaccggaggtccctcaacttaacagcgagattttttgagatcccttaactacaaaaccagaaatatgtacccctaaactccctcaaaccgttcactgtagatccctcggcagtatttttgcccggttttgctgacatggcaacctagtcagcaaattttttttaaaatattacgtggggcccacatgtcagctgcacatcttttttttcttctctcttcttctccttctcttctctcttctctcttctctcttcagcgagcgcggcagccacagacagagcggcgtgtcggggttatcctccgtggaggcgacgagcacggccgcagcagcgacggcaggttcccggactcggagccagcacgttcagccggagcaacggttgctacaccgacgccgcattctccgccgcgcgctcctcgtcgccgccgggctcaccgttcagcttctccttgattgctctcgtcaataaaaatgtgggcatcattattgatagctaggagcactacgtgcttgcagacggcgaacgacacgaccagaccggcatggccgccgcggcgaacgacacgacgccggcgccggggccgggctgcagctcaagctgctggtggaagcgctcgcgtcgcgtgctgtacacagaggcgcgtaaggacgcggtggacttcctcatcggcctcctccgcgttcgtctcgttcgtcgctgacgtctcgctggaggagttcggtgactcgctgcatgtgcccgccgatcccttgcgccggcgaactcctgaccctgccggagagcaactccgctgtcgtcaccgaccgaccactactctacgtacacgtacgtacgtcgtcataaaacttgaataaactttgcaaaattcgcaccatttgtacgtgactttcatgatgatgatgccatgcttgtaggtgacgaggctgaggtgtggcggcttcgtgttcggcacccagatctgccacaacctcgtcgacgcggcggggatcacgtagttcttgcagaccgtcggtgagctcgcgcaaggcgcggagcgtccggtcggtgtgagcgagggagcccctcgacgcgcgccacccgccgggtccggcgtacgaccaccctgagtacgagccggcgtccgacgaggccagcgacaagcttcgtccaggcgacgagctcgtgcaccgcaggttcctcttcggccccgacgatgtcgccgtgctgcgcgaccagctccccacgcgcctcgggccccggtgctcgcgcttccttctcctcgtgcccccaggcccagatcgccgctttccgccgcctacagcggccaacgccgcccctctgcctgcttcggccgcgcgccgccgcccgctgccgcgctcgcccgccgcttgccgcgtcggcgtcggcaacctgctggctccgggtccgggaacttgccgtcgccaccacggaggagaaccctgtcacgccgcttcgcctgtggctgtcgcgcttgctgaagagagaagagagaagagaaggagaagaaaagagaaggaaaaaaaaaagatgtgtagctgacatgtgggccccatgtaactttttaaaaaattttgctgactaggatgccacgtcagtaaaaccggacaaaaatactgccgagggacctccggtgaacggtttgagagagtttaggggtacacatttctgattttgtagttaaaggatctcaaaaaatctcgctgttaagttgagggacctccggtgaccttgttccgtttgaaattatccccgaaccgatactagatataatgtattgttcaactcctaaaaccaatataaaattagtcccaagacggtttgaatagcggtttcggcttcatgatgttgtctagttt

SEQ ID NO: 61471 - DNA, 1163 bp, Oryza sativa
ataatttttttattaggataaatttataatattgtgaaagtgcttctcacgagaaatctcgcataacatttccatgttctcaagctaaggattttattaaaattgcatttatagtcgaagtttctgaagtttgaccagatcttttcgaaaacgttttgatcaccttagctgtataactcctagctggaacttcttgcgagtcgcagtgctgcttggccggctgtcatgtaatgggagacctcagaatcagcttaggttgccgacttacttacaatgagaatcttgtagcagtatgcgttttgttcatgccagtgtatggagttatttgtcctgctcctgccccgagtacagcaatggccatcgtagtaactggatgtgttgcgatcaatttttattatcttttaaactggatagtatatttgattcctgatctcttttttgctgcaaccttcgtgactaatgtttctgatcactggaaactaatctggtgttatgtctccctgctgcttctcttattgcaagtgtttggccacatggataaaatgttaactttcaaaagacattctcattttttagcatgtgttatcgttaactttttgagactggtgactattcgccttactaaaaaaaatcatataaatattatcatttattccttacatccccaaatatgtccccagatgtaagaacctacaacctgatgaacttatcaggaatgactggagtctgaccaaatttaaatttatattgctaggacatgttccattcgatttaaggtttttatattttattttgagacagatgaagtaagtattttgttgtgatttcaaaaataaaggttctttaagtataacctatatgtttatatgtttaataaaattaaacaagacgggagatcaaacgtatgaaaaaacacgtcatgtaaaactagtactccaataagaattgtttctggttaagtgctccagcctccggattggagcatatcgaaacgtcaatctagcaacgggccccctgtaatttaagggtgggtgggccaattcgccggcccgccaacgtgtatgcgagttacccatgtcgtctatgctacagaagagaaacgctctctctttcttctcaggcgagacgatggagggcgggcaccccgacccggccctccccag

SEQ ID NO: 61472 - DNA, 29915 bp, Oryza sativa
  unsure (1)..(29915): unsure at all n locations
aaaatgaaccaaccgggactaaagatcaaaaaatacccctaagcttttaaaccgggactaaagatgtttcttagtcctggtttttattggaaccgggactattgtgtaattgggccgatcgaccaaagatggtttctccaccagtgtaaatccagccaccatgaaaaccaaaagcattacattaacataaaaatggagattaacagcagagataaaaccctaaaaatatacagaaaatcatcaatatgcttttgttcaactaactcaaaacaacacagtttatcagccagtagcatcaaaaatcgcccaaaccacaccaaacgaactaattaactccgaatcacaaaatactaccataaaactctaccacaaatcctctcaactaaaccaaagcgggaaacaacaaagctaaccaaaaaaatagatcccccgatctggagccaggagatcccgagacactacggcgagagattagaccagcacaaaatcatgtcgtgaaattaaaaacgaaaacgccatggatctaaaactaaaacgccattgatctaaacccaaaacatcatggaactaaaacaaaaaaatcaccaatcaaatcaagctagctcgggggaacaaaaatcacttccaaaattaaaaaccctaactgcaatgaccgaagaataatagggatgcttgaggagataaggaggcgcacctcgtagcgttggacaaaatcgtcggagaatcactggagaaattgaaatcgccggaaagggataagaggatttgggattatcaatgtggggagagaaaagcgaaacgcaccgttcaaaaacgcaacaacgctatttctgatataactttatctttgatatttttccgcttccgcttctgataaggatgataaaaaaaaaaggaaaaatagaaaagcaatcaggaaacggggccatgcgaagaaagttgcggacggcccaagcccaatacgacagatacgcctagaccagaaaaggcaaggggaaaccacacgtttgggccaagataacgaaaggggaaatcgatcgctcggcttttatcccagagatcgattaggatttttgattcgctcctaccaaatttccttccgccgacggcgcctccaacccacacgcacgcgccacctcctaaccctacctttcttttcttccatatatggatctaatccctctctcgctagttttttaaccttcttccatatatatccatctaatccctctcttgctaagcgctcggaattacccacacgtgttggtgcatgcgcatgcgcgctcggccataacccccggccggcgagagctctcgaccacagctcgtcgtgccgtcgttgtcgtgtgcgtctccacggtatatctatcctgggcgtgcggcggcggtgtaggcagtgcgcgcgtcgcggctgccatcgattacaaattggtcggagaggcgagaaattagctattttcctatagtttcctctctttttttcatgttcttgttattagactggtttccctgtatgttctactatatccttctagacttgtttttttttaatttcctttctcctccaatttggatggggttattattttgtttgctctctcaatctagcagcatgctacccgcgcgttaaagggattaatatgccatcatatttttcatgaacaaatagtcaacatatatttaaattgtaagtttctttctaaattacagatgtaattttagtctatttatttacaatgtaagtctctaaattacataagtaattttaaaatttttacaatgtaatatatttaactttgcaaccggttatggacataataaagaaccgtggacacaaaataggagaaaaaaatgaatttattattaattgtacaagtccgcgaaaaatgagcacagaagagttggagcttgatcaagtgtcctagttagttacgctttcggatagctttgatctgacgcaaaaaaatctgactctaatcagcccacaaatatatatgccagcacatgtttagtaaaactgtattatgtttgttcacatatatgaacgaataggtaatgagtactgtaatagtgggttaattaattagcttgccagcttcaggggtgccaatattagttctctcatggtttccacaaattcccgatgttgttcttgtgcctttttctttggctaaaattaaaagttctagaaaacatcgtgtcatgctagttttgagcagaagtttaaaaaaaaaaagaggttatctttgaccagaatactagatggatatcccaataacttccaatggctctacggtttgagatagttcaatatgcaacttctttccaagggccgctctattatttggaaataattcaacatgaacttcccaagggcactacggttttagataattcatcgaattaataactgcattctgtagtttgatttgcatacatgtaatcctcaagatatctccacgtataactaatcttgcatatcctgcctattcagaattgagatatatctcatctaaactctcaattaataattgacaggtgcacacacaaacacgggattatggcggcggataagagccctatcgacgaggctctcctacatggcaaacacgaagaggctctcctacatggcaaacacgagcacgtggagcagcagctcctccccaccagcggcggctcattctgcatcaccggcgcttccttcgggaggagttgcctcaacctgagcaacgtgatatctggcatcgggatgctctccgtgccgtacgcgttgtcgcagggcgggtggctcagcttggcgctcttcgccatggtcggcgccatctgcttctatactggcaaactcatctatcgctgcatgcgcgccgaccgttgtgtacggagctacccggacatcggctacctcgcctttggccgttacggccggacagctatcggcctcatcatgtatgtcgagctctacctcgtcgccatcagcttcctcatcctcgagggcgacaacctcgacaaactcctccccggcacggtggtgaagatcctggggtaccaagtgcatgggaagcagctgttcatgctcgtggcggctgccgtcatcctcccgacgacgtggctcaagaacctgagcatgcttgcctacgtctcggcggttgggctcgtctcgtcggtggcgctgacggtgtcgctggtctgggccggcgtggccgacaagggcttccatatggcgggcagtagtatcttgaatctcagcgggttgcccaccgccctcagcctctacttcgtctgcttcgctggccatggcgtctttccgaccgtgtactcctcaatgagggccaggaaggattttcctaaggtatagtttttaaaatgtatttatgtgttgtacttggtagtaagtttgctaaaatttgtgataataattaacaatgcaaatttagaattatggttaatgaaattgaaaagtcaattgtggaaataaattagcaacaggtttagtaagaatacaacatattgtttttttattctatgtatgcacggaagacgcacacactcattattattttttagaaatcgtacatcagtatattactaatcatgcacactattagctcatggaagttttcttaaacaattttgatcctttcaccattcttttactgatacttatccatgatctaacgacatatattgtatcaaccgttgcattcaatggtccatattttcatatgatgtagctcaatgatgttgcattttaagttttacctttcacttagagagatttggcaaccaatgataattgatcattggattatcagttccaattatcataatttggtttatgaaaccatgatgatgatgatgatgatgatgatgatgataacgctctattcctctccaattaatgtgcaggttttgctgatctcttcggtgttgtgcagtctcaactacgcagtgacagcagtgttgggatataagatctacggtgaggatgtgcaggcgcaggtgacactaaacttacccacgggaaagctgtacaccaggattgccatcctaacgaccctgatcaccccactggcgaagtacgcgctcgtgatccagcccgtcacgaccgcgatagaggagaagctgtcgacagcggcggcggcggtagcggctgatgccgaaaacaataggctaaccagggtgctcaccagcacaaccgtcgtcttcagcacggtggtgctggcatgcacggtgcccttcttcggctacctcatgtcgttcatcgggtcctcattgaacgtcactgtcgccgtcctgttcccgtgtctgagctacctcaagatctacatgcctcgaggaggagttggccgcttcgaggtggcggcgatcgttgggatactggtcatcggagtgtgtgtcgccgtcattggcacctacacctcccttcaccagattataggcacattttgattgtacatttgtgggtatggtggtaggtttaggtagtaattaaataggtttcaaattcttttttttatttattttcttaaaaaaacaacatatatgttatactgagtgttaagaatcaactgagcggctatatattgcatgtgtactctcctggaatgcatatgtgtattatcactaaggaagtttcagaactttcattgtcttcatgttgactaattattgcagctaaaatttaaattttgaaattacttaagttttaagttattctgaagtttatccatcatagtttatcttcttctacccttagatttaaatcactggtaacatgtataaaagttgggatttgtaacatatatgtctgcaattttttttttggttttatctataaattattatttttggtttgtttcattcaaggcttattagcctaactaaattttgtcgattctgaaagtatggtgaaatatgacgcaaatggccatgcttcttatgagattaattttttaatgaaagatcggtagagtaaattccatttgttttctaatagatgacgccgttaacttttaaataaatgtttgaccattcgttttatccaaaaattttatataaatgtataagataattaaatcatgcttaaagtactttaagtgataaaacaacttaaaaaatatatattataattacataaaatttttgaataatacgaatagtcaaacgtgtgacaaataatcaatggtgtcatctatagaaaaaaacagaggcgatggcggcggctgcgatccagaccggtggatccctcgacgaaggcgaggagaggaggagaagttcaccggtgagctgcgtgccgtcaccggcacgcagctcgatctccatttacttcgccgtcttcccctactgcatgcaaacaatgttgtatcgagggctctgcaccacgatcgaagtggtcctcgagctctgggtactccgattgccttgcctagttggagcttcattaagccatgcatgctcgcgggaaggagctcaagctgatagcccactcgtggagtctgccaccgccaactccaccacacctcgttaattttgccgtcgtcgggcggagcagcttccagagctggcgcccggccctctactaccctcaccgcccgccgccttgctcctcatcggcgcggcccgctcgccttccttttccgtggctcgaaatggagtaacttgtagagccagcgctgctccaacagggagtaggaggctggctgccgctggacttcgagttcggcccacccgtgctgatcccctttcgctcttgccccgtgctccctctcgcagtggccctaccctcttccatattattttctggacgtaatgacatgtaaagcgccatgtagatgtcaagtgagaaaaaaaaacaagtcaaaatgttatgtaggataaaactgttgtttcaaatcaccctaggatttgatttgcactggttttgatagtagaaataggggtgggcagaaaaagaccgaaccgaaaagaccgagaccgagaaatccggtcatcaattcggtcctaggtagtaaaagaccgaattttgttcggtcaactcggttagtctcctcgggtaaccgaatagaccgaattattaaaaaaatgtctaaatacaacatataatccactatgtttaataggattaaattctaattttcacatccctactttttctagacatgcaacctaataagagtctttactcataactgcttatgattgttttttttgttatttttgtgttgaaaatttccattatttctttgcatatataaaaatgttattgtatttcggttaggaccgagaagactgagaccgaatttgtcggtcctgacattttttcgttgaaattcggtcttcacttttcaaagaccgaaattttcggttagaccgaatgcccacccttaagtagaagtatgacatatacttttgtggaggagggatgaaaatgaaactcggcctatagctgaggtatgcaaaatggactttttccttgttcctattaaggccttctttattaggccgaaataccagcccataggtggacatggatggtctcagactatggaccatgtccaaatgaggcctcgtagaaggtaacgaaagctagaggttacagagggccagcagcatcccggcatagccggttggctagcagtcccggtccaaaaccaaactcgggagtccaccaatgctgctaggtctcggtgccggtgggtctctcgtcggacctgggcttcagttgggcaccatgcgagcagcagacaccggcacaccgcgtgagcaactagcgaaacagcagacaccgcgcgagccgtgagcagcaaagctttcgctacgcatcttcgctagctgcagaatgccccccaaaccctttgctagctgcagaacgcccatccttcctcccgcccgcactcgatcgcccgcctacgcaggatgacagaatctttatctccaccacggtccacgctcgtacgccgcgacctgtcttggccggccgcgtgtatgcatgcttgaagagcttgatggacagtggacaattggaaaggttccagtgttagttctcacaaaaaaaaaaaagttccagtgttccaaatgaggtttacgggcgttttttttttttaattacaaagtacaacgtagacactcaaaacacaagcacactcaccgttatgaacgcacgcacgcaaaccataccggccatataagcatctttgaaggttcgtggatattcttaaccaaaacaaaaataattatctttatctttatctttatttttatatctatacctaattaaaagattcgtatttttcctttagtcacattttatttcgtccatatgtccgattccctccctctcagcgcgtgcatgggcggtttacaaaactagggtttctctttcaacatctatacgatatggttttgctttgattcttgggaaaacggaaagaggagaagataaggatcaaaaccctcaatttcggattatctcactggatgtggccagatttcacaaaggagggggattcaagccttctcaggcagatgcggcaatacagacggaggttggagacgcccctgtagtactggcccacgtgacaatgaaaggagtgggggaggctgattagacttggcgacagtgaaggaaagaatgggggaggatgattagacttgtagtgccttgctgggctggatgcgtacttgcgggccgaagcaaaggggaggagaagggagaaaagtgggtcggctaggctacgggctgaggaaggaaacgggctaaaattggcccaagagaaaggagaatttttatttagatttttgtttaaataaatgctgaaatgatgtttgtattattaaaattagccattgagatctgaaaatttcaagaaatttctagatagtgtaattaatcatggagaacttcataaaaattaaattcaggcatatcattttatttccacacttactttacttttcaattaatttaaacacctacctacttaaaaaaatcaagtattccaggaaatgtgtatttaagttaattacataatctaaatctttcttaaattctcctcgattttctcatcttttcttcccgttgtaacgcacgggtattttttatagtacctactaaaaaacgaaatatgtttccaaccaaaatttcgatcgtccgtcaaaataacaaaaaatttgttttttggttacaaggagggaacctgttttctttcgaaaacgctttacttcggacgtccgacccgagcaaaataatcggacgctaccacacgaaagtactcccagagtaggcactacatgcagcgatgggcccacaaaaacaggagaatgccagatgtgcgggcacccgatgtagtgcgcatgcattgggcgctgctaccgcttgggcgcaccacgccgcctgttgtgccacccacgtctctcctacacgcgtcctcgtgctgccacgtgtccccaccacgcggcaccagagaggttggcaccgtcccattgtatgacggtgccaacgactctggcgccccgataagttttttcagggttctatttatgaaataagtttttttaaaaggatcagggaggtcactttggtgttgagtacgtagtatatcactagaaacaacaattttaccgtcgccattcttccaaggttggtgtttacactctgatattcttcatatctcttatatttgctggtattaacataagagtaaagtgcatagacgggtccttaaactcgtagggttgtgtcatctaggccctaaagtctaaaaatgcagattcgggtctcagaacttgtcaaagtgtatcatttagattccaaatcgatatagccctttagtatcctacgtagcgccaatgtggcatgccacatggacgtgacgtgtcattttctttttttttctttcctttttccttttcctttttgttttctgatctcattcttctttttgtttcctttcttctgctcggctcacagagaaaggagaagaaagggaaaaaaaagagaagaaaagaaggaaaaagaaaaagaaaaaattttaaatgggttccatttgtcacatcatgttcgtgtggcatgcgacatcagcgtcatgtaggatctcaaaggggctgtggcgatttgggatttagatgacatactataataatttctgagacttgaatatacattttaagagtttatagacttagatgacacaatattacaaatttaagaaccactcgtgtactttactcttatcataagttagtagtcttcagtcaacggccggtaacctcatagaacagaataaagacagggaacaaactccagattcttcccgtcagctgacaaagcgggaagaattctagttttagtgaagcggtagaagtaactattttcaaccaaagtgtttgagccccaaatcctcgcttttgttgaaaacaaaaacagtggtagatgtaattataacatgtactccctccgttttaaaatgtttgacaccgttgactttttantacatgtttaaccgttcgtcttatttaaaaaaatttataaaatatgtaaaattatatgtgtacatgaaagtatatttaataatgaatnaaatgatatgaaaagaataaataattacttaaattttttgaataagacgaatggtcaaacatgtactaaaaagtcaacggtgtcgaacattttgaaacggagggagtattatcaatatgttttgatttgcctctcaaaataatacgtccgcatctcggcagtgcgcgtccccccttcgcccgtcacagtcggcgcgcgtgacggccttggagccagacgaaaagcaggtcgagaccgctccaccgcgcatatccacgcaacgcaactggtacgtgctgccttgacgcgcccagaaaagcggcacggcttccacatttttcggccaaatattatatccggccgtgtaccggagcacgtgccgagaacacgtcgccgtcgtcacgtctcccgccgtgatctagcgccaaccggggacgaccaatcacgtatagccggagaggtcaatagccgagtaggcgaccactcgtttggtctattggccagttagaatcgctgcaggttttaagcaagggggataaattaagagtcctggacgcgttggcgggacagggacgtgtgtttcgtcttcgagagctcgacttcactcgcaccgtgtccgtgtgttgcgtgtgtatatatagctgggcagccacgctctggtttccatcaaactagaactgaactgagcgagctagctgcttctacaactgtgcaggtagctaattaatctagcaatcctcccgtagattggaataatggcagatcagaaggtgattctcgccgagccgctgcttccggggaaggaagctgacttcgccgacgacgacgacgtggaggcgcagctcacttcgtaccacaccggcgcctccttctccaggacgtgcctcaacctcaccaatgccgtctccggcatcggggtgctgtccatgccgtacgcggtgtcgcagggcgggtggctcagcctgctgctcttcgtcctcgtcggcgccgtgtgctactacaccggcacgctcatcgagcgctgcatgcgcgccgacggctccatcgccagctacccggacatcggccagtacgccttcggcgccaccggcaggagagccgtcgcattcttcatgtacgtcgagctctacctcgtcgccataagcttcctcgtcctcgagggcgacaatctcgacaagctcttccccggcgcaaccatggagattcttggctaccagctccacggcaagcagctattcattgtactcgccgccgccgtcatactgcccactacctggctcaagaatcttggcatgctcgcttacgtgtcagcggccgggctcatcgcctcggtggccttgacggcgtcactgatctgggccggtgtcgccgagaccgggttccaccggaacagcaacacgctcaacctcgccggaatccccacctccctcggtctctacttcgtctgcttcaccggccacgccgtcttcccgacgatatactcctccatgaagaacagcaaacacttctccaaagttctcttgatctcgtcggtgctgtgcagcctcaactacgggctcacggcggtgctgggctacatgatctacggtgacgatgtgcagtcgcaggtgacgctgaacctgccctccggcaagctctacaccaagatcgccatcgtgatgacgctggtgaacccgttggccaagtacgcgctgctcgtggcgccgatcacggcggccgtcgaggagaggctgtctctgacgcggggcagcgcgccggcgagggtggccatcagcaccgccatcctcgccagcacggtggtggtggcgtcgacggtgcccttcttcggctacctcatgtcattcatcggctcgttcctcagcgtcatggcgaccgtgctgttcccttgcctctgctacctcaagatctacaaggccgatggcatccaccgcacggagatggtggccatcgccggaattctgctgctaggagtgttcgtcgccgtcaccggcacgtacacttctttgctgcagattatagccactttctgaggtggttggttgctgttggtctctgatagtagacagtagtacttacagacaatagtgtgaccacagtgtccttaaaataaagggcgcttgaaaaaattttcggagttagtttgtatctaagataaagctgaatcaataatattgacttaggtgaaaaaattgtatatattattggtgccaacaatgtcaatgttgtatttaataaatatcagatatgagacactaatttaggtttatttgtaaaaaaaaaaatgccaagtgactaatttgtttaaggaacaaatccataagagatgttgtcgacaatgtcaagggacaaatttgttaaagtaacaaagccataaggggaggatccactaaaaaaaaaggaatggacagcgatacctgtgttttgctatttgaatgacggccgatgcttccaaaatccaaacctacccacctaggtactacagacctgaagcaacgaagaacgaaggttttttcctctgctatcgagaggtctttcgttgcatgtcattcaaatatttatcaaaaatcttaaaagaacaacaataaattgaaattcaacctattcaagttgaggaaaaataataaattaaaatctaatgttttgttatttttgttttaataacctatatagattaaatttgaaattgcataattgttaaatatgcacgtttgtgaaacgatatataatatattaagctatattttttaacttttcaaaaaaaaagctatttaaatagcatggaaaaaaggaagagcattttactctctaatgggaatagttaactcacatatatagatgctaaatatgcttcacatgcatttggggatagttaactcacatatatagatgcttgattaatcgccagtatgtttactgagaaagagaagaaaaggaactgataagtcaaaggaactgataagtcatcgccccctacaagcccaaacaggcaaaggtgtacgatgtgggtcggagtgacatggtcgtggcttcgccgctttgggtggaggcgtggagcgatgcgggcagtggagcagcatgctttgggccacccgacgcaagaagagaaggctgacgaacatagggtggaataatttgtatgagtagcaaaggaggggcgtggctctgggtgcccggacgagacgctggagcggagctgctctggcactcggctcagcagcggaggagcgagctgtttctaatccggcaacctctctgctagatcacccagctcttcgcctctactctaggcctccgttgtcagattcagtagattccacctctctacctcattccccacctctattccttctacctctattcttccactacttctaatcctacacctggggagccgatcccgatcgtggcacgagttcgatccagaggcggtcaaattttaccgttcctccaacccaaacatccatttcatacttacggttggattttgctggcgcaggggatgcgaaccctatggaataaggtcaccatagggccctcaactgaacagcgagattttctaagatcctttaactagaaaaccagaaatgtgtacctctaaactctctcaaaccattcaccgaaggtcccttggcagtatttttgcctggttttactgacgtggcatcctagtcagaaaaaaaataaaaaattacgtgcggcccacatgtcagctgcacttttttcccttttcttttcttctccttctgtactctcttctctgattctctcttcagcaagcgcggcagccacaagcggagcggcgtgacggggttctcctccgtggagacgacgagcacggccgcggtggcgatggcaggttcccagacccagagccagcggttgccgacgccgacgcggcaagtagcgggcgagcgcggctggagcaggtggaggggcggcggtcagtgggagagcgcagttgcagcggctcaagcggcgggcgagcggcagcaggcggcggtgcgcggccggagcaggtggaagggcggcgttggcggctgtaggcggcggaaagcggcggtctggtcccggggactcgaggagaaggaaacgcgagcaccggggccgaggcgcgtggggagctggtcgcgcaacgcggcgacgtcgtcggggctgaagaggaacctgcggtggtgcacgagctcgtcgcctggacggagcttgtcgctagcctcgtctgatgccggctcgtactcggggtggtcatacgccggacgcggcgggtggcgcgcgtcgaggggctccctcgctcacaccggccagacgctctgcgccttccgcgagctcaccgacggcctgcaagaactgcgtgatccccgccgcgtcgacgaggttgtggcagatctgggtgctgaacacgaagccgccacacctcagtctcgtcacctatgatgcaacacgaaaccgccacacctcagcctcgtcacctacatgcatggcatcatgaacacgtaaatcacgcacaatacaaatggtgcaaaatttgcaaagtttattcaagttttatgacgacgtacgtacctgcacatagagtagtggccggtcggtgacgacggtgaagttgctatccggcagggtcaagagttcgccggcgcaagggatcggcgggcacagcgagtcaccgaactcctccagcgagacatcggcatcggcctcgacgaacgagacgaacgcggaggaggccgatgaggaagtccaccgcgtccttgtgcgccttcgcgtacagcacgcgatgcaagcgcttgtccaccagcagcttcagctatggcccggccccggcgggcttcgcctgcgccgtcatgtcgttcgccgtctgcaagcacgtagtgctcctagcaatcaataatgatgtccacatttttattgacgggagcgatcaaggagcagcggacggtgagctcggcggcgacgtaggcgcagcagcagcatctgggcggcggcgaggagcgcgcggcggagaatgcggcatcggtgtagcagccgctgctccggctgaacgtgctggctccaggtctgggaacctgccgtcacagccacggccgtgctcgtcgcctccacgaaggagaaccccatcacgccgctccgcctgtggctgccgcgctcgctgaagagagaagagagaagagagaagaggagaagaacaaaagagagaaaaaaaaagatgtgcagctgacatgtgggccccacgcaattttttaatttttttttgctgactaggatgccacgtcagcaaaaccgggcaaaaatactgccgagggatctccggtgaacggtttgagagagtttaggggtacatatttctgattttgtagttaagggatctcaaaaaaatctcgctgttaagttgagggacctccggtgaccttattccgaaccctattggacggataacccaatttttgttttgcgcctattgggccgtttgtcttgccgcctggtcgaactactcggcccgctggagagtggagacagtgggcccatgcaccgcgtgttgcgaagacgcggacggcctccgccgccgccggcgaagcgctgccctgccagtgccaggtgccagacgtgactgcgtgagaggccagcgaagagatggatggccaaaccatatgggcggccctacgattcctcgccggccggccggatcgattccgtgtaccgcatgctgcggccccatctccgacttcctcggcgtgccggttggatcgggcgctgcaccggatgctggcaagattgctgtggaggagatcagctcgctgctgtcgcgatcgacagtcgccggaatccattgaccagtagccgactccgcctgggacgacctatactttggcacttttattagcgacgacctacttgcttgtgcaggtaggcacaaatatttgtccagcgatcagttagctttctcataaatcggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacaatcagattgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaataaaccaagcatatagtcaaggaataaataatccaatcaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccctcgacaccctttaaaggatgacgcatgtaacatgctcccgagtaataaatcttccgggtaatatagaccaagcgtagctcatatgaatagcttctgatctgagtgattatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccgatcaaaagtactgaagtcgcatagccatggaggcgaagaaaccagtcggcggcagtcaggtcaaccagcaatgaatatgaaggcgctcagcgataaagttgtgtagttgacgacaacaaacgcaatcgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctatcatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcacgctaaaattaaaagtttgatctttatacgatgaactttgggtgcgtttagttcacgctaaaattaaaagtttgattgaaattagaacgatgtaatggaaaagttgaaaatttgtgtatataatgttatgaaaaagctagaagtttgaaaaaaaataatgaactaaaccaggccttttccaaatgggaattgtagataaagactgttcaatcatgatgaagctttacgtaagcggtgacgaagcaagtgcacatgtgccggcgatcacatgtctctttcttataaaggatcagacagcagttccatattggagtatattctccagtaccttcagacaaacgaaaaatcagcaaagtggctggttacccatcctaggctcccagcggtttcttgcaaaacaagatgtaacttcagcgcaaatactctctctctctttaatagatagcatcgttgattttctttaccacaagtttgaccatttattttattcaaacaatttacgtaaattatattattttgttatgagttattttatagcttaaattactttaaccataatttataccttacacatttatataattaaaattggtgaaacgtgtgttcaaaagtcaacgacgtaatctattaaaagacggaagaaatataaatgtagaaatcttgcaggcgaagcaggtaagacattggagggatgaccggatgatcaccaagtcagaaatggcgacttggtaccattcttcctggataattcgagctgaaggcattttgactcggacactacaaattaggtggatctcctcttctgaagatcacacagtttttcaggcttctgaacttgctcagctagccactctgctccaacgcacgcagcttagctcggagtgacaacggaatggctaccatggatgagcagcagccactgcacatcctcttcctcccgttcctcgtgcccggccacctcatcccgatcgccgacatggccgcgctcttcgcggcacgcggcgtcaggtgcaccatcctcaccacccccgtcaatgccgccgtcgtccgccctgccgtggaccgcgccaacgacgacgctctccgtggcgatgccggcggcgcaccggcgatcgacatcgccgtcgtgccattcccggacgtcgggctcccgccgggcgtcgagagcggcacggcgcttgcttccgaggaggaccgtggcaagttcgtccatgccatccagcggctgcgcgagccgttcgaccggttcatggcggagcaccaccccgacgccgtcgtggccgacggcttcttcacttggtccgtggacgccgccgccgagcacggcgtcccgcggctggtgttcctcggcaccggcgtgttcgcgcggtcatgccaggagagcatggtgcgccacaacccggtggaggcctgccccgacgacgaccccgacgccgccgtgtccctgccggggctgccgcaccgcgtcgagatgaggcggagccaaatgatcgacccaaagaaacggccggaccactgggcctacttcaagatgatgaacgacgccgaccagaggagctatggcgaggtgttcaacagcttccacgagctggagacggactacgtcgagcactaccgcacggctctcggccgccgcgcgtggctcgtcgggccggcggcgttcgcgagcaaggacttcgcggcgagaggcgccgccgagctctcgcccgacgcggacggctgcctgcggtggctcgacgcgaagccacacggctccgtggcgtacgtctccttcggcacgctgtccagcttctcgccggcggagatgcgcgagctcgcccgaggcctcgacctctccggcatgaacttcgtgtgggtcatcaacggcgccgcggacgacaccgacgcgtcgggtcagtggatgcccgaaggcttccccgagctgatctcgccgcacggcgatcgcggcctcaccatccgtgggtgggcgccgcagatgctcatcctgaaccaccccgccgtcggcgggttcgtgacgcactgcgggtggaactcgacgctggaggccgtgagcgccggcgtcccaatggtgacctggccgcggtacgccgaccagttcttcaacgagaagctcatcgtggaggttctcaaggtcggggtcagcgtggggtccaaggacttcgcatcgaatctggagaaccaccaggtgatcggcggcgaggtgatcgccggagctgtcaggagggtgatgggtgacggtgaagagggcgccgaggcgatacggaagaaggcagcggagctaggcgttaaggcgaggggcgccctggagaagggcggttcgtcgcacgacgacgttggacggctgatggacgcgttgatggcacgccggacctctgttgacgtatgaggtggcggttgacgtgaggaacgccgtcggatggtgaccggacagcacacgcgttgtaaaattctggttatacatatacatgagtataacgttgagcggcccccgcaattgcgcagctagcattaatttaaaattatctattttttatatatgattttatttaaaattatcatttccgtgattctaataattttatagtttttaaaagctatgccaatcgttaccctttactcctttgtatcctttttatttgcttacttgatctaccactatttatattcatcatctttagaactttaaaaattaggccttatagttttcagagttcattttcttgatggatttcttattcataatttttggaagtatcatcaaacatcgccaattaactactctatggcccgtccgttgctacttctctttattgtcattggattttaaaaatcgtatataattattgcttatgttctttttttactttctataagtctcgccaaatcattagtggctttgccactatacccagcccgcccactgtctcctttccttattgtcattgagattttaaaaatcaaacatgattatcattggggtttatttttactctctataagtcccgtaaaccgtagtgaccatgctgcttaatgacatgcctatcgtcacttctcttaatcattattgggattctgtttggggtttgtttatagtttttagatatcccagcaaccgccagcactctacttctttacagacctgttgcttctccctttttattgtcatttgtcatcgttgtgttctagatggatttttttaataaaaaatgcatatttttcattccaatgatttttattcataaattatattcctacttaaactcttataattatttttctatttttgaaatttattttatttgttattttgaactttaataatctcgtcatgtgttctagatcgtcctccacacttagaccggccgtctctaccttcttgtcgatgccttggacctcaccccctcgacctcgacgcctcttttcctcacacacgacaacaccaacctcattgccacagttggctccctccttattgatcccgttgattctgacaatcctcgatgccctcgccaacctccactctctctaatgctccaagatttggtctaggaaaggagaaagatgataggaaattgccttagtattggggatgatggttgagaactcgatggagggaggaggagaatggcgattagtcctcgggccaatggggcggagtagctgacgaagagaggatgaggacaaatcgactggagagcaaaaggattcagtggggaggagtaatggatctagagataaacaaatctaaaaataacggagaaccgagcgttgctcggttggctagagtcgccaggtgagcgagcagcccgcgcaggttcgatccctgggatcgcaactcatgtttcccatgcactgaggcctattgcctccaatctcatggtgtgtgtaagtgtgcgttctgagttgtacccttctcaaacaaaaattaaaaataacggctagcccttaatttatctcgtggcacagaatcctgtctcgtagtttttctgttttagtttttttcttttcatcttctgaagccatgtcttctccaaacccatttagaacatttgaatcgggttcccaaaagcatactattcttgatatatcgcatttactctgatatatcgcatttactctgcagtgcatgcattattttagctatactagaaaaaatgcccgtgcgttgcaacgggtaattgatattttaattttattattgttatacggtttagctagggaaaaattcactgtgggaattcgcttgaaattttttttcagaaaatcatgagctgcaattaagagtatgtatttcatctcaagttagcatgcgacttttttcaaaagatttcttatacgactctttttatactttcaaaaggaaacaagcttaaaatccaactcaaacatggatattgtcgacgtctgatatcgcggttccggtatttgcatggtatgtggatcgtcggtgttagggtatacgcgagactaaggtaaaagagatggagacagggatttttatacaggttcgcccccctgaattgtcaggtaataaccctgtatcctgttggccggagccagtcgttgttcttattcaccataatcacacaagtataatatttggggtagcctatctaactgttgtcgacatggcggtctgaaggtctgaatcgtagtcgacaacagggtagccttcctcctcgaatccgtgcccggcgagatcagagatagcgctttcgtctctcctgacagtatccggagacaccgtagggtactagccgtgcatatccctgaagtcgatattcggcggcgtgtcttggcgtatgtaggcttctatgtcgattgtgttgggtgttgattctctcgtgtcccctctcctccaaggggggcttgtatttatacccataggtgtccccttgtccaagtagaactagggaaaccaatatggatacaatccgagtagtcattgtcgtttccatgtagaactctggttgtctttccttatccggaactccctcgaggtcagtttccgtataagacatggtatgtggtggttcctgccgagatttagtcaactactattaggtatgtggtatccataaccctgacagtagcccccgacttcaatgcaaatgaacgagttcatattctcaaccgcagactttggaggaactgttatcgagctcacgtgaccgttctcggtgagtttagagataacgttagacttcctttatcagtctcgtgcgggcaccgaaagggtttgtctgagtcaatctctgatgtcaaccgagaaagtacagagcgtacgactatgtttctcgtcttgctgtaatcgagaatttggattgaagtcaagaaattttatctcggcgggtacaccatttctttattccatattccttgtcgagatccaccaaaccgttctcgagtgatcgagaaggcgtagagtctgcgacggagccttgtcaacatttgtcgtactcgccttagtcgatcttggtgtggaaccatagagacatagagtcttcgataatgtcgaatagaattttcctgaactcaatactcataaaagaatattagttagaaatagcccccgagcgaatgctcaaagggtgacatgttataatatgacagactagtaaattgaatgtacagaccagtgttttgtatacgagcgtcttctctcttaccgactccgatcagtcagtttgtagagtcatacactctccctagcccccagccttgtcgtcggagaatcgttctcggatgacaaggctcttggacctttgacctgcctcggttgaacaagcactgatcgtagcccccagccatgaagttggaaaactcaatttccgattacacggcttggttaatacgcacggcgagaactcttacacgaccagatcttacatggtctttcgtctctgaaggatccgacaaggccttatcggctctgggcgtccccagccgaagttccctcaggttcctcggaggccttgtcaagacggcgtaaagggacagtaggataggtttcaaagctaggtgtcatcgtggtaagggatctctgggtaaaacacttggcgatcttgtgtacctgatatcaattttgttcgagaaccaggtagtagttgtaactcaaccactagaagtaaatgtacgagagattgctacgattgactggttgagaaccagtgagtaggtgtctctcgatcattcgaagtcgtggtgtgaggaccgctgcgttatagcagtagtcgtacctcgatcatctgaggttgcggtgcgagagattgctacgtattggttcgaggaccagcgaacgtgtagaattatctctcgaacaccaatggaggttgcggtgcgagagattgctacgtgctggttcgagaaccagcgagcgagtagagttatctctcgaacaccaatggaggttgcggtgcgagagattgctacgtgctggttggagaaccagcgaacgtgtagaattatctctcgaacaccaatggagacgctagagttggtttatgtgcatctcatgtggccagcatgactcacacacccaacttgtagtatatccggatgtccgttcgcaatcatgtcgggtgatcaagccgacggtgttcgcgaggaattatccgttaacaaccttttctcgagtagtccagccatggccggtgctatgagataggtcgtcggtcttcgttgataggttgggcgcgacgactctgcatttgccgagatcgttctcgataatgtggtgtacttgaccacaacctactcgagtgctcaattgttcttgaaaaatattttctagaagacaagacatatagcagataatatcgagtatgtactcaaaaactgcatggatcttctagtattatcaggatataacgagcagatgtaaatatcagggcattatgtaaaccataaacaagcatgattcatacagaagagagcagagcgagcccccagcgtcggtttaacgtcggaaacactcgcgcgatagatattgtatagaaacatgctctaggtaaacataataaattatagatctgacaatgctgtatgatctgaataggtacgataaattccagataaaatattgcgtatctttgtagatacaagccggatgtatctacgaaattagtagatcaatttaaaaaaccaatctaccaattaccttgttgcgtactcgttcgatgtcatgcgatctgacatcttttggtacgccgcgaagcttgaggcttggatgatctcgatagaccaagttgtcgatgacgataattgttccgatcttagtcggaagatttacttggacaggttggatctctccacggccgaagtcatcgagtagcttgttgttggagaatccatctcttaaacccatcttgtctaaatcctgaagcaccaaaatccccctacctggcacgccactgtcgatatctgatgtcgcggttccggtatttgcatggtatgaggatcgtcagtgctagggtatacgcgagactgaggtaaaagagatggagacatgaatttttatacaggtttgggcccctgaattgttaggtaataaccctacatcctgttggccggagccggtcgttgctcttattcaccataatcacacaagtacaatatttggggtagcctatctagctgttgtcgacatggcggtcggaaggtctgactcgtagtcgacaacagggtagccttcctcctcgaattcgtgcccggcgagatcatagatagcgctttcgtctctccagacagtatccggagacaccgtagggtactagccgtgcttatccctgaagtcgatatccggcggggtgtcttggcgtatgtaggcttctatgtcgattgtgttgggtgttgatcctccatggtgggtgttgattctctcgtgtcctctctcctcctaggggggcttgtatttatacccataggtgtccccttgtccaaatagaactagggaaaccaatatggatacaatccgagtagtcattgttgtttccatgtagaactctggttgtctttacttatccggaactccctcgaggtcagtttccgtataagaaatggtatgtggtggatcctaccgagatttagtcaactactattaggtatgtggtatctataaccctgacagttatgtatttccaaaaacgaaagaaattaaaaatcgactcaaatacgaatgacatatcaaaatattagtaaaaatatctttaatttttatattagtagagatttggtacgttgatttgtatctcacttaagctttgtacagcgcctacaaatttgacggcatggcccagcccctactaaacccgaagacattttggagtttggactcgtgtataaacatttctggaaacgccgtcctctcccgaagagcacaaacttttcaggcttctgaacttgctgagctaagtcactctgctatctactctgttccaaaacacacagaagaaaagctcggagtggcatgagcatggcagccattgatgagcagcagccactgcacatcctcttcctcccgttcctcgtgcccggccacctcatcccgatcgccgacatggccgcgctcttcgcggcacgcggcgtcaggtgcaccatcctcaccacccccgtcaacgctgccgttgtccgccctgccgtggaacgtgccaacgaggactctctccgtggcgatgccggcggcgcactggtgccgatcgacatcgccgtcgtgccatttccggacgtcgggctcccgccgggcgtcgagaacggcgcggcgcttacttccgaggacgacgttcgcaggttcttccacgccatccggcggctgcgcgagccgttcgaccggttcatggcggagcaccgccccgacgccgtcgtgtccgacggcttcttcacttggtccgcggacgccgccgccgcgcacggcgtcccgcggctggtgttcctcggcaccagcgtgttcgcgcggttgtgcaacgagatcatggtgcgccacaacccggtgggggcctgccccgacgacgatcccgacgccgtcgtgtccctgccggggcacccgcaccgcgtcgagctgaggcggagccaaatggcagacccgaagaagctgacgatccactgggcattcttacggcgaggtgttcaacagcttccacgagctggagcctgagtgcgtcgagcaccaccgcgcggcgctcggccgccgcgcgtggctcgttgggccggtcgcgctcgcgagcaaggacgtcgccgcgagaggcgccgccgagctctccccggacgtggacggctgcctccggtggctcgacacgaagccggacggctcggtggtgtacgtctccttcggcacggtgtccagcttctccccggcggagacgcgcgagctcgcccgaggcctcgacctctccggcatgaacttcgcgtgggtcatcagcggcgccgacgaaccggaaccggagtggacgcccgaaggcttcgccgagctgatcccgccgcgcggcgaccgcggccgcaccatccgcgggtgggcgccgcaggtgctcgtcctgaaccaccccgccgtcggcgtgttcgtaacgcactgcgggtggaactcgacgctggaggccgtgagcgccggcgtgccgatggtgacatggccgcggtactcggaccagttctacaacgagaggcacgtcgtggaggtgctcggggtgggcgtcggcgtcggggccagggacttcgggtcgaacctggagagccatcaccgggtgatcggcggcgaggtgatcgccggagccataaggagggtgacgggcgacggcgaggagggcgaggcgatactgaggaaggcggcggagctagccgcgaaggcgagggcggcgccggagaagggcgggtcgtcgtacgacgacgtcgggcggctgatggatgaattaatggctcgccggaccttccgttgacgtacgagataatacggagataatgggttggtttggtttatagcctaattaggccatatcaaatttcgtcaataccaaattttggtaagttttggtataactaattttggtaaggcaaaattatgtttagattgaagccaaaatagtctaagttcactattaaaatagcctattttttttagatatgtcaaaatttggcttcaaaccaaatagacactgaacactattaaaattaccaaatattggtaagcctaatttaaacctcaagccaaaccaaaccagcccaatctcttcaacgcgtacgtctgatccgttgggattttttttttctgtttcgcaattataagtcggcgaagtagcctactgttcattaaaggagtggtgaacagtgagagtgataagattctgtagcaaatacagtatcgttcaatatttattcaccgtataagatcactagtacgtacgtttcaagctaactgtacttgctgtgatcggttaacattttctatgcaacaataatggcaatctgactacgatagaagggtttgcacaaaaaaaaagactacggccgtgtttagttgatttggaaaaaaaaaaattgacgagtacggataaacatttaaaatattaaacgtagattaataacaaaacaaattatatattccgtcagtaaaccgcgagacgaatctattaagcctaattaattcgtcgttagcaaatgtttactgtagcaccatattgtcaaatcatagtgtaattaggctcaaaagattcatcttgcaatttacatgcaaagtgtgcaattggtttttttcgtccacatttaatgctccatgtatgtgtccaaatatttgctgtgacgaaaaagtcagaagtttaaagggaactaagactgtgttaagactgtgtttagatctaggggtgaaaatttttagtgtgtcacatcgattatacggacacacatttgaagtattaaacgtagtataataataataacaaaacaaattatagaatccatctataaactacttgacgaatttattaaacctaattaatccgtcactatataaaaccgtgcagtatagatgtgtgattttgctgacgtggtgtcctagtgttgacgtaaaaatcgaacacggcgccctgggagatctgcttagctcctgtgcaagtccaaatatgatgagatgcgggcgtgccagtcagtttgatcctgccactgacaagatatgcaaacagtagatcaaacagccgatcggctgacaagccgatggagtagttccagccgatagccgataatagccgatgccgataccagccgatagcgataggatttaagcgatcggctatatgtccaatgtagataatgatataaaggcagtcggctgatgataatataatatagcaatataatccagtagaaaaccaatcggctaataatatgatatagtagaacaagtattgatccaaaggttaaagcatatatcggctggggatccgatgtcaggaaatccacaagattagattaaacagtgaaacctttgttgtcatcggctaaatccaacttatatgtatatgcgatctttatgagccgatgcaacgtccagatcactccctggctgaaaccccgatgaaacccttattggcaatcaagaagcaggctagagattatggttct

SEQ ID NO: 61473 - DNA, 4592 bp, Oryza sativa
  unsure (1)..(4592): unsure at all n locations
cgcgcgccattgatttgccacttggtatccaacacaaacacaatctgctcgagatatctgaaggaatcaaacgcccttttcgttcctgagaaacagcctgcaatcaaccgctcgagtatgttcctgcagcaggtgtgacaatccacgacgactccatgtattgcagataagggtccaattcctttgctcaagaattcgactccaatagcaccttaataatggctttaatggcttggacactcacagagtaacacatgctctttaaaaatgctccttccataccatggaccagctctgatgcctgtcagctcccttgccctttcctcctttaagaaacaacaacaacatccaaaaaaacaaaatgctcactccctgatgctactatgagtcaaacccaacacacatgtgcctcctcctcctccttcttcctggcattaaattagccgagaccggcctgatccatttatctcccaatttatcctctcctgtctgtcacaagcaaagcacacgagtagtacccctcagtcccaaaataaaccaacctcgtacgggatatgtggtttattttttatggtgggagtagtttcttttcagggctgcctcacgtaacatgatcacatgaccaaaccggccggtccagccgagtagccgaccacatcgatccatccatcatccaaccagcggcagcacgcgactttgcaggggacattcccgtgacgacgcggcgggcagtagccgatcgatcgagagccaatcacgtcgtcgtactaatcaaatcaatacacttgccaccacacgagagagtatatatgtgttcctgtccacttggcccttttcaatgttcttttcgatgccaaccaaatccgttaattagtttctctctccaggatgaagagtacttgcacgtactaccactacactgccacgacagcagcagcagttgctgcccccggttgtccctgtcaaactctctctctcagtagatccggtcgtgcagctgcagtacgacgttgtagttgtcgtcgtcatcgtcgaggaaaaagtgcagccacagcctcgtgcacaagtagtagtagtagtgctgatgcgatgagaatcggttttgtcacttttgtttatggtttgaaagatagagagagagagggccttaaaaatgtctttttcttttgcttacttgtgcacacacactgcattgcttcagtagtgtgtccaaatcggcagggcttttttgaaaaggccagctcgagtcagtcaacctccgtctaattctcatataagaaaggcagaagagaaagggaacctatggtggagtatatctgatcctgtcacttgagtcacgcacacacactgccgccaaagttcaaaagaaaaaaaagagcacggcgatgatgtgaccatcaaatccactttgctaactaagccagcactaatactaatattcccctaatatttacattcctcctacgcatctatagtaaattgcacggctctttatttttttctcattgaaatatagaaaggaagaaagaaaaaaggttaccatgagcaagaatcttgtatccaagtcgctttaatttccccaagaatcttggagcaagtgcacacaccatgagcagccagacgacgagttgtgattgggcattgggcatgtggcgcgcacacacaacgtcaggctcgcagccaatccagtggcccagtgtgagattgcagtgagacagtatattgggctaacatgtgtgcgtcagtcagtcagtcagtcagcgcggctgctttgtttgtcccgtgctgttgtgttctgtgtctgaatggagtatttgcaattaaccgaggcaacagaacctgccatatcctgcctgcatatgcatgccagtgtcttgtagtagtagtagcagcagggacagagtacaataaaaaactgttggtactgctttggcatggcctgcacacctgcactgcagagaatgttccaagtgtactcctgctgatgctgatgctgcagttgcagtcatgtgtcccaagtcccaaagtcatgtgtgtgtgtgtgagagagagaaaagatttgatgacgagatggaaagcgttttgtactttagtacttctaggagaagtacagcaatgcatgcagtgcagtgcagtgcacagagatatagtgagtgagtgttgtatgatgatgagataataactcccattggcagcttctttgacgcagagaagtacgatgtgggggctcctcatgctggctgattgctgctgctgctgtcgtctctccctttggttttcttttgggagtactgtttgctttagataacagaggccggccgtcaacgtggggactatgccactatatatggtccaggaactcttccaagctgagtacttgacttttgttatactcatatactataagccatgtagagtaagtttggtatttatttatgaacatatgcaccaaagcttccactaatccactcctactgctgatcgagcaagaaaatattctagtggttcttaaataactctattatcataagttattttgtggtatgatgaattctcggattgagccttatgatatgttgttgtgcgagtgatatcatattagatctggaaggtgttcaaatctgtctagtattcaagtaataggatttttaccgggtactatgcatttcaagattcagagaactttattaattttgacaaacaagaagttcaacaatatgcatgtttacactgtagtcagatttgagagtacttttacagcatggtttgtagatttaaacaaactaacggtcaaaattttatttttagcaaccatatcaagttgaacgccgcgacataaaacaatatcaatttgggagcatggaggatctaacacgggggtgctgatggatccctatggagagaaggaaagaagagaaggactagaagggtagggggctagaggaggaggaagatgagcccctccaaacttgtcctagatccgccccagtttgggagtagtggtggccaggaatagacccaggattggctcaagggtcgggctagggctagcccatgctgagttgcgtcttacatgttgaaaaaatgtacatcataatgggcctccaatcctatgccttgggccttaggacggatgccctgaggcctaggccctcccccggtggtagtcatgccgagggggaggggggagggtaggataagtaacttgatatgcttatattctcttatgaacaacaaatggtacgcatacaagtgtatccatccacctaggtttgagtatcagttatatcttaataatattatcatatccttttagagaatcataccaaaacgtactttctatccacatgcaaaagaggtagctctcaactattgagtaactcttaattaattttataaaaagataataataaccactaccctgatataaaagtggtgtactgaaatatattcactacaatgataaatattatagtaagaaaacttagttgtttcaacttaaattttatcaagctaaacatatctctacctaatccaaagtatgatagtttcagctcaagcttcataaatttgctactcccttcacccccattttcatcatcccctaaggatttttatgtcttcccaaaataaacattatctaataagtatctcttccggcctcatcttttagcctatgcttatgcttatcagacaaaatttgaatttccaaccttaaatttgaagttgattttgaggtttttttcatcaaagtttagttttcagcctttgcttttagatagctaagaatacgaatataaaaattttatccacaaattatttttcgtttgcaaatctgtcgttttgcttattccccgaataagcaaaattgtagagtcgttcgtttatttgtgcaaaaagttaatgtgcaccattaagattaatttctattggtgcaatgtcatgcaatattttagatatgagcaatacatgagtcacgaaacgatgaaacaccttaaccaatgagaattaatttaaaaatgataaatattttggtgttcttggttttggtgtcatttgcttagagaaagatcaatctggaatggatggagtactatcttacacaaccacaacaatgatacatatgataaatatacttaaataaaaacaaagcaaaacatctcacccaaaatctatagccctaaactctttcaagcatctctagatggaaaaatccatgtagctcaccggcaaacaacccctcttttaaagtaaaaaccaaccaggtccatagcgcatttactcacaccagtcaccactttccctgcgcccccggctcgcatcccaatacccacgctttcctacccacgcgggcaccccccccccccccccaacaacgtnccttttcctgggtaccgagctctaaatcccctatagggggggggttacaaattactgggcgcggttttacaaccttgggactgggaaaaaccttggggtacccaaattaaatggcttgtgaaacaatccccttttcgccagctggggtaataccaaaaaggcccgccccgatcgcccttttcaacagttgcccaccctgaaatggcaaatgg

SEQ ID NO: 61474 - DNA, 13656 bp, Oryza sativa
  unsure (1)..(13656): unsure at all n locations
aacatttttaacatttcaggctacggaaaaataagaagccggtttcaggttgctttcagcttgaattctgctttattggttgagggttacccttccgtgttagctgtaatatcagtgggatcatcctcatcatcctgaacctgacagatctaagagctgcatgtagtgtcgtttgatatgaaactttggggtttgcatattgccgacgccttacgttttcacgtgcattagacccacagtaatacgttgggaatgtcacagtttcaccctactcagcatggaggtgatagtgattttcaggtgtggcaacaacagatgatgtacaagcaattgcaagagtttcagagacagcagcaggtacaacagcttgatcatggagccaggatgcaaccctcttttggtcagtttcaagctcctgcaaaaccacttccaactgatcaactctcggcaatgacgaatgaaatgccaaacaatgaatctacagcttatgcatggtcacatcaactacatggtagtagtgacccagggttggcaagcaattctcaaatgttgaatcctagcagtaacacaaattgggagcaatatggtggtgctcctggtgtagccaattttgtaaacggttcaatgttttcaaacactccgattcagcccatgagaccgatgggattagctgcacaccaaatgaacccatctttatatccaataaatactaccagcagagatggatctggaaatcagcactctcagttcttagggatcccaactgatccacggaatgcaatggcaagggcagcagcacatcagtccgaaaaggcatcgatgcaatttagctctttaatgagtgaacaaggtccatccagctctatgcaaaatttccttgggaaggtaggtgataatattaaggtgggcacccctgttccagtaaatcatctacaacatggtgttcaacaccaagattttcatggtaggccaaaccaagttgattttcaagcaggcctgcgtgaaaaatcaacaatgcaggtagagtcaggaaatggtggtgctagccttgatcctaccgaggagaagttcctatttggcaatgacgaggatagcaactggggagctctgttgaggggtggcaacgatcatggcagttctatggataatgacaactttggtggagctctgccatctctccagagtgggagctggagcgcccttatgcaggaagcactacagtctacaaccagtgacaacagtcccaaggaagaatggagcggcttgagcttccagaaacaagaacaaattatagccaacaattcaaccttgcaaagtcatgaccagaataaattttcagcattgagtggtgccaatctagaaaatcaacggccttcatcagctcctagctacggtgatggaacaatgcataatccaaagtttgctggttctcagcatgctgcaagaactccttatgagcaaagggacacgaatgcaacatgattctttttatgccactggtaccaatcatcaatcaactgcaggagtcaataatggatattttcagcagagcatgaaacaaaagcaatctgatgattacagtagacaagaacaaatgaacgcatcaaatggcatttgggcacaccagaaacctgaaatgccaagaaataattcacactcatctggtggacatgctacaccaccaagtgcacatggattttggatgtcccaacaaaacagtattgatcataatatcagcagagagtctggtagcacccaaaatgactggaaaagcaaggccccccttgtacaggacatcaacagtaccccaaacgtctttaataatgatgggagcttttggaagtctagtggaggcaatgcaaattcagtccacaggcctcaacagatgaagcctgatataagcaccatgcaaatgccaaatgacagttcggacggtaaaagcactagtgcgatgggctcaaacatgccaactttaaatcaggatcagtatcaatccattattggtcgaactggtgaacatgttgggcaaaaccataatatgggacgtaagggtccagagattacaggatcactaggaagaggtgcagagcaaaagtcaaatgaccacaaccaggattacctaaatgtgctccctactgaaaggcaagggcatggttcaaatcatggacaacatgtgagcagtgattttgctaccaggaggcatcctttctttgctggaaaagaatcccaaaatttgggtcaatctggtcagcaagcaatgggatcatacatgttgcagaatcatgccatggataactcaggaatgaacattaggcattcttcaggcaatccagtgcctaatcagtttccatctcagtcgcatcagttgcataataacctgaaacctcgattcattcctagctcccaggcttcgagtaatatggcttcagtaaatgaggtatgcctgccaacttcatgtacataatgaagagtattgttatttttgtttgaatacattttattaatgtacttttagtctgtttattcgtcttatttatgaagtaatttcctttttagaaaatgctgatgagagaggagcaatttaaatctcgacatgttccaaatagctccagttcaccaccctttggaggatctgatgctggcctgcctcaaaatcgagcagttcaaaacaggtatttcctatttcttaattactcaaatcatgtgttgcttgccgaattctagatcttccacttgtaagagtttaggtttattttttgctgtaatttatgcaatttgtttcctacacttgttcctttatctactattataaactaagtgaatgacggtggtgagtctgccatcgcatcaccaccaccatgggattttctgtgaaatgtatactacttgaaaaatcttatctggaatctggataactataccatctgcactcatggtttgtaatataattatttgcctatttcaattaaaaaatatatattcttttaaacttaagagtttatgatgtacgtattctaaatcattgcaacacatgggtatttggctagttatttttaatgaagtaagctattgttaccggttagttttggtgccctctagcattaatgagcgaactcaaatttgtggagaactgtatgctgcctttagcattaagataacatcaatgctcctttcaatgtagaaatcgttgcagcacatggtatttggctgtgtttttaaaaatgaaatgagctattgtaactggttagtatatgcgccatctactactaatggagtgaactcaaatttgtggggccctgtagcctttaacataaggttgcaaacaacattaatgctcctttcactgtaggactgaagcattcctttgctttatattctatttgggatttattgcaggactgattaactcttttgcaaacagtgtattttttccatgcatagttcttcgatcttttttttttctgtagccactttatgcttgaaattcttcataaggcactgacacatttgtgctttatgcagtcaacatatgcttcaacttctgcataaggtggacaattcaacagatagcaatgctgctgctgatatgccaaacagttctcctgataatactggtactgttcagcaacagcttaatcaatcttctctgcaaggttttggattaagactcgcaccaccatcacaacgacaattgactccaggccatgtatggtctactcgtgctgatgttgatggcaagcaacctgagcactcaacaaagggagaagatcaaacacaaccttccgctgctagccagtctttgccacctgggcatccaagttcacaaccgacaccgtttaactcttcagaaatagatagtactggacagcaaactgggcaatttcaccagtttggttcaggccaacaataccctgtctctgagtcaagatctggttctgtagcgatgcctcagcaaggcagttctgcaacagtgttcaagaatgtatggacaaacatatcagcacagcgtctagccggtgtgcaacctaacaaaattacacccaatattctccagtctatgatgtttcccaatagcgctgcagataccaacttatggggctcccaaaaggcagatgatcaaggacagagagcatcaactccatctgatgttgccacaagttctaccaattcacaaaatcaagaaacaaagcaaggtggggacagtgatgcagggttagcctcttctgagatggtaaatcttgattcaacaggagctactatgtcgagagaatccatacagaagcattcgtcagacgggaattttgccatgcatgtttcatccttggcacggttgcaccagcagggaatcatgaaccctaaacaaggggagaaccctgcagcgaactttcaggctatgaagacttctcagaacactgctattgggttacatggaagcccgacaccgtcaaacattcagcagcagaattactctttactccatcaaatgcaagccatgagacacgtggatgttgatcccgcaaatatagctggaaagaagcttaaatcacctgaaacaggttctgatgcttcacaggttgactggaaatctggtcagaggtttgcgcatggaaccaataactcggtcagatcgtctgtagataacattggcaatgcaaatgtcccagggccattccctgctgacatgaagatgctaagctttgctccaaggaacaatgaagatagaggtccaagcataccttctcaattcccttcaagagaacctccctctcagggtatggcagttgcagcacaaactgagcagcaaactcaagttcagccagcaaatgcatcatcagatttaattgaaagaagtgagaggcccaggataaaccctcaaatggcaccttcttggtttgagcgctatggaaaccacagaaatggtcagaatctttccatgttcaatttgcagaagacacctgttccgccatataatgtccaaaaaccttcttggaacatggacaataattctgctgagcaaagaatcgattctggccaatctgttaagcctgggcattacatttcatcgaaaaagatggaagtttcagtcccttccagtataatgcaaaggaggccaaagaagcgcaaatctgcagaatctgatcttgtttcttggcataaactcattgagcaccccaaaactttgagaaacatgaggtaattccccaccctttacaggtttagcctgtccttagttgttactttttatcactagtttctgtgacaattgtgtttctatgttgaattgctttaatttatggtcttgatattgctctctgtcgtgacaatcttcaattggcttgacagcacaactgagatggactgggcttgggcagctaataggttaatggagaaggttagtagggccttactgtttctaccttttaggtcttgagcacaacaatctttatttggtactgaattaagtttcaaaaaacaggcagaggatgatgcagaaaatctagaagatgtccctgtaaattatttatggcgcaaaaggttaagattgaccacacggttaatccagcaaattcttcctgctataccagcaaaggtcctcaaagcacaagctgcatcagcttatgaaggtgtaacctataacatcgctatgttcacactaggagatgcatgcaacatggcatcatataactctcgcactcttaccgatcatgaaaataagtaagtttctgtaaattgaatgagttttgttgtgccttatttgcttattctcttatgagcatgatagactgatttatttgaataaacccgttgcttaattctctcgttctaagcctggcactattcggcagctcatctgaacaaacaaatgccaagaaaatggaagacagattgtcaaaggttgtggaagtatttactggaagaatcaagaagatggaaaatgactttgtgaggtacacacgtttgactcccacctgacgaatgcagacattaatgctattcctttatttatgcacaaaagttttcattatgcaacatctgtcgctaaaagagttccatcatactccatccatcaaaaagtcttaagacctattccattttttggtttttccaaaggtctaagtcttatttgtagtcccatgtgctaaattaaatttttgattggaacccaagaagtcattttagtacttattggttgcatgttcattggtccacacagtgaatgaattaattcattaccatctattaactacacaacaagatgtgatctgtgttgcacttcttaaaatccctgacaccagcttccatcccatattttacttgtcaggacagtttgtttacttacacccctgggatgctgtctaaactagattgatgttaattcttatcatctccatttttcattattgcagcttgaacaagaggtcttctatgctagatgtgcaacttgaatgccaagatttggaaagaatttctattgtaaatcgtctgggaagattccatggccggaaccatgcggcgggagtcgaggcctcatcggcttcagaaatgattcctcgcagaatttttcccgaaagacatgtcatgtcttttgcagtgcctggaaatcttcctgaaggggtgtactgtttgtcactctagtgcattgattcctcccatcgttttttacaaactactcaccctgtgatttccagtgctccttgttctcatgcaaagcatggcctttcatacagagcaaccaaatccaggggtagtcgaaaaaaaatcgaaaccatcacataataccatggtgatggagaagccaaggggtgcgtccagccgatcaactcagtgctggctgccgttgttcctcccttgtatcaagtataggtcctgtatattgtggaaagcaagttgaaactacggatctcgcatcatttttctgatgaaggaagagtattagcttcatactttgttagagagcccagtgctttgctagcttagtacatctggcgaactatgtagctatttgtcatctttttatccatgatgatgaagtgttggctggttagagggggggaataataacgggaaccttcctctgggttcttttgttcgtttaggatgggatgcaaattggctagtgtgtccagtctaactgaccagtgttagtcagcagttaattactagagttatgtagttccgaaagcattcatggaacaagtggcgggtaagggagcttggaaacttgttgtaatttgaatccccgtgatgtcgaaatctcaatgggttcttgtaaatttaaaatgaaaatataactgaggtaagaatgctcttgtgcttcatgtaaccttttgtttgaaccagatgctcgttttattgttagttgtattcttaagcggatgctgaagttggcattgatatatgctttcaacactggatagtcccatcatttgtctgtttttgttgcttcctgcgtgagtcggttcgtgagaaaggtaataattttggtaaagtctaaatttcacgcgtttttggtgcgcgggttaataattagagaaactctaagcataatgaaatttcaagaagaagattaatatttactccttttcctcaaggttaatactcacaaaattttagaccaaaggctaatcctcgtgttttaggcatagtgctaaaatcacagttttttaaaaaatggtaatattcataaatttctatgtccaatgctaataatactcatgatttttttggacgaagaccagtgctccttcgtttttatgcttgatgttaatacttgtgaaattttatgtgaaggataataatattcatatgttttggaccctaaacctatactttctgaatttttgggtcaaatgcagtggcggagccaggaatttaaacctgtggggtcaattactagtgattagtgatttatatttaagtggggtcatttctctaaattcttttggatttatacataaaaatcaaagtttatagtatgtttttcaaaaagctgtggagttagccgaccccacagaaatagtctaaatccgccactgataaaaaatgctaatactaacttgttttgaggcataaggctaaaatttactcatttttgttcccaaggttaatagtaatgctaatattaatgcacttttgggtgtaagattaatacttacaaaattatggcataaacactatcactaatttttttggccaaggtaaaactcataaaattttggctgaaggctactattggacagctttcaaccaaattctaaaatgcatgcatttttgtgcccaaggttcataatcatgaaaattttaatcgcatgcaaatattcattctcttttactattcatgctaattttaaaatattaaatgttcatgattttttggccaaatgctaagattcaagggtttttggtcccaatgttaatactaatgaaacttttgggccaaaagataacattcatactcttttagcctaaaaaacaatactagtgaaagtttgggccaaagtctaatactcatgtgtgttttttttttttttgcctgaacgctaaaattcatgcatttttattcccaagacaaataagcatgaaattgccagataaatagccagtgctccttcatttttattcatgtgttttgggccactgaaccatgtacttttgagagagattaatactttctcttcaaaaaaaaaaagattaatacttgtgttttcagatcgggtcgaagaaccatactcatgcgtaatctggcaaaatctaatatttgtgtttttttacccaaggtttggactttttaagttttaggcccatggttagcatgcgtactaacatgaatattacacatgaaagtatgttagtttcatgatgttctcaataatactcatgggtgaatcattactcatgtgtattaacggaacttcatgtgtaatattactcatgtgtatttaactcatgaaattttggactgaaagctaatcattcatttttaggtcaaaggtttgtactcacgaaattttatgccaataactattactcatgtgcttttgggacaaagtctaaaattcagcatttctggacccatgttgatcacgaaattttaggcagaaggataatattatattgttcatactcaagaaattttaagccaaaggcaatgttcatgcaattttggacccaaaatctatagttataaagtttgttcccaaggctaatattcatgtcttttttggctaaaattcatgaatttttgttcccaaggaaaattgtcatgaaattttaaaggggtatattcatttgttttggggttgaaggctaatgttcatgtgtgattggtcccaataaggttctcatgaaactttggagcaaaactaaaactgatttattttttaaaaccaaaggcttaatattcatgcgtttttttggcccaaagttaataatcacaaaattctggacaaaaggataatatttatgcatttgccaaaggtgatgctcatgaaattatgggccaaaagcaaatattcacacatttttgcttaaggctaatacttattaatttttgggccacaataattgtttatttttggatccaaggttactaatcaaattttctgttaaagaataaacatcacgtgcccatggttaaaatgttaaatattcactccttttcgggccaaggctttcatgcattttggacctaaggtgaataattttggagcgaagggataattagcatgtttttcccgacccaaggccgaacgcaatttccaaggtaaataagtaaataactatatacacgattctcagcagatggatgatattcacgtgtttggggggacagtttattatcatgaaaatttatgcaaatagctattcatgtgtttttttgtggttaatactcattgaattttatgtcgaaggctactcatgttattgagacgagggctaaaactaccttttttgcccaagcaaaacgttttgagcacaaagttaaaactaccgccttctctaaaatagaacttggacagtgattcaaagctaaaaggacactatattatggacgaagggagtgctcacgaatattgggacagtctaatactaatgtgtttctgtgccaaaggtcataaaatttcctgcaaaagtgtaatattcgtatgcttttgggcctagagtgaatgcctatgaaattttaattctaaactcaaggccaatactctttaaaactttggaccaaaaattcttttgggtcagaggttatgttcatacatttttcccaatattaatactcattaaattttggaccaaagccttaatactcatgcttttataggcccaatgttaatactcctggaattttagctcaacgactaatagacactcgtttttgagcctaatgtttaattctcatgaaactttggaccaaattactaatacacgaatatttccaggccaaagccaaaattcatgcattgttgaagcaaatgaagcattcgtgaaattctaggctgaggttaatacccatggttaatactaacaaaatttaaggccagaggctaataaacattgactgttatggctggtaatagacaatgagatgaaggagaaatgagatgaatgagccaccgccaccgttcatttcataatattcgcggcccgtcatactgtatgtaagctcccaagggctcttaagataagatatgctgaacaactaaaccacggcaagatcggcactgatgagtgttgggccctacagtagatgagcattgcattggtaagccaacaagagcatcacacaccctttgcaagatgcccaagtgagtactcctgatcaaacccaaggtaggaatccgacaccaaaattagcttcgtctcctgaaaaagaatcgccccatcagtacatataaaaaaggttaataaggatcagtggaccagctaagcacacagtttgagctagatctccaacaacgtatctaactctcccagttatttttgaaaagacaaaaataacagaatcatccagaacagtggcacggaaagcttagtttagtggtactggtagttctttttcccagttttttattgctttactttgtacacattcctctatgttgcttgctaaaaattcaagaaggctcagaaaattgacacaataggttgaattcgaataatgaatagagtagtttcgacctgtaactggcaaggagtaaaattccaaccattctcaatctgtccagctaagttcaaggtacatacaacttgtctattcctcaggttcaacaatatacatcatcctgaaatactgctagactaacattttctagctgatacacaatgaaatatcacaaatgacaagacaaaaggtaatctattaacgatttggtgtcagctttgagatgctgaaggctcgttatactaagttgctaatcagtttgtcattgctattgcctagaactaaaaatcaaaagaatcaacaagccaaaatatggaacatatggaagtcacgggcacagacatcttgaatcactcaaaacagtaataaaaatctttaccttgagcttagcttagcctagaaaatttgcacatggtgtagtgttttaatacctgtatatcaaacattgctggcaattccatccgagtgttaaccacccgatccataaaattaattcttttcagaccatagagctctgaacttctaatgttcccaaggaccagccaccaagcttcttgttttgcctacagaatacagtatcaaaatgttgaatacagatcagcacacagtcccagcacataattctatactttgtattatgaatcattcacttagatttccataacatatatcaattttgcagattataagttgatttgtttctttcgtactgttatgctgagccagtattaatttacaattctcaaaggtagttattcttcaggcatactcttgcatggatattcaaaatagttaccccttctttagttgttgtcctagaatgcatgaagtaaaaaaatcatacacacaaaagtatttagatcagacaaattatagtacaatcttcaccaaatcttgtactcctatttgttttatataaaaaccatcatataataagaataggaaacaatcaagcatattcatcgaagaggtcatcaatgtcaaaaagtgacaaacataaagaaaatagtaatataagtaatattaaaaccagtagcctggtacttcactgtgattagtgaactctgtacatttcatgtaatcagtatagttactgaccttgggaaatctaggggaaaacgctcttgatgttgaacggcgcgcatctttcatttgcaatctaatgcttaaaattggaggcctggactggtccttatcttcattctgaagcttaagttttacatccacacaagggaaatgctgcagatcctgcataatgcaaaatccagcattcattcatgagttaatgatgtgatgacatctccatcgagaattatgtggataaaaaccaatgagataattgcaaggaaactatttttgagggaaacaagtcaaacaactgcacagaaactacaaaattacccagctatacaaaatgtaaaggagtgacacggagttttgacttgctacacaatagagaaaaccttaggatcctgagacattttgttatatcgtacaaaatattcaataactacaacagtaaatactgtagagctagaaaatttaaagttctgctgagcacggttcaaatactgctggttatcagcagaaccggatttcccactgaggtccagaatttgcatcgctcctgtgagtgttatctactgctatttaatgttcattagactgagggtacatacatatttatgtgttctttgaagctgataattctacaaacttctaaagtaaactgagataaaaacgagtatggtccatgatttacttggtaaagttgaaaaaaatgtccaacccagggttttaaccctggtacaaagcatagtgataggtgggtgaacctaacacatgatatcttaagcaggattgaatagcagattccctagcattcttctcatttttagaatacagtacatgaaacaataataacactaaaaatgttgggtggtgctgatttcacaacagtcaccacattctgataagagaaaaaaagaatctgctctgtttgcatttcctcttggctgcaaaaagggctgggcaaagaatgaaatacagcgatgtgattgcaaataatctgttttcagctaccattgtaaaataccaaaaaataaaatcgttcttccaaataaggttagtatgtccaaactctcaagcagtacctggtacaactcagaagcagaaaatggttgaagcaacctatgtaattcttcacgagagagacctagtaaggctggaattgttgaaactcctctgcccttcagatgatctagaagattatcattcatggatggtagcatccaaagagatgaatctctctcaaaccagagaccctggcaaagttaatgaagtctagttcaaaacaatatatctatttgggattttgatacaggactaacaacaaattcagatagggggggggggggggggagagagagaaatctgagacaatgaaattgacctgtatgatcatttgggngggtncaagaggtgtctacctggcg

SEQ ID NO: 61475 - DNA, 3824 bp, Oryza sativa
tccccatccctggcgagctccccgcccgcgaagccggcccccgcgcgccgtagttcgcgcgcgcgcccgcggggttgccgcccgtgccgcgccgtctgcgccgtccgcgtcacccggtcccgctgccctgccgcctgcagccgcgcagccgctcggccccgcagccagcgcgcgtgcccgagccgcgccactcaaaccgccgcgcctcccgttgcatcccgcgcgcgcgtgccgtggtggccgaccgcctggtcgccgccgtcgtcagcgcctgcccacgcctgtcgcccgtgtcgccgctccgctccaaaccgccccaccgtcatcgccgtcgtcatcgcctcggccccgccactccgagcgcaagccgccaagggacggaggcagagcccctcctccctctgccgcgacgcccccgctcccctcctccttttccccaaagcggcaaggaggcgagccccctttctctccctctttttccctttcctcttccccgccggcgtcatccgcctctgtcgccgttttggccgcaagcgccgagcgccagctcgcgccttgaccgcccaaagtcggtttccaaaccgacattgccgccccctttaaacccaggcgccctcccttcctcttttcccctcccaatcttccctgtttttcgcctccacgccattgccgccgccccccgtgctctgttcgccgtcgccgttcgtcgttgcgcgtgtcggacgagccggcacgagcaaggacgcggaaggggactccgggcgcgccctctccttcctcttccccggcccgaggccggagagattactcccgcgccgtcggcctctcgtcacagcgccccacctcatctcggtagtgcctccctccgttcttcctcctcgttccatctcctccccttagactcgggtagtagcacaagtagcctccccgtagctagccggcgccgccccgactgctgccgtcgctcgccgtgtgctcgccgccgtcgccgcccgagctcggaagcgcctctcgtcgccggcctccctcgatgcgttttcgcccaatccaacgctagcatcgaattcccgtagccgcgtagatgctctcgccgccgggaatcggcccctcgtgacctcgtcgccgtttcccccttctcccgccgccggttgccgccgccgcaattcgccgccgtcaagctccctccggcgaatccgagccgttggctcgtctcccctcgtctcgtgcaaccacccggtgtgctcgccttcgcctgtatcgccgtggttcgctccgccgctcgccgctgtcgtccgccgtccattccggccggcgtcgtcgtctacctcccgccggcccgcgtggcagccacgtaggcgccacgtcggcgccagctcggccaagaccgggtcgagccgaccccggtcagtccctccccgtgcgcgtgttccaccgcgagccgtgaggctgcgcgtgggcccgccgcatccgcgtccaccgcgaaccgcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcctcccctcccgcgcgcgcacgcttgggccgccttgggccggccggcccatttagctcggccggaacgctccgtttctctcgggccgcgccctagccgcccgaggaaaagtctatttcccctccctcttttctttcttttcttttatttttcaaaaaggatttaattcaatccttttcctttagaccaaaaatccaataatcttagaaattcaatatcttcccaaccgcaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggactgcacttactctgcttgtcccgtctgcaaggctcgcgtgacctcgtcgccgtttcccccttctcccgccgccggttgccgccgccgcaattcgccgccgtcaagctccctccggcgaatccgagccgttggctcgtctcccctcgtctcgtgcaaccacccggtgtgctcgccttcgcctgtatcgccgtggttcgctccgccgctcgccgctgtcgtccgccgtccgttccggccggcgtcgtcgtctacctcccgccggcccgcgtggcagctacgtaggcgccacgtcggcgccagctcggccaagaccgggtcgagccgaccccggtcagtccctccccgtgcgcgtgttccaccgcgagccgtgaggctgcgcgtggtcccgccgcatccgcgtccaccgcgaaccgcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcacttactctgcttgtcccgtctgcaaggcagattggcggacctacctaatttgttgcatttgatccttcctttgttaattgtgataccatgtccccttgtaaccatctagttgcgtctcgatattcgtgcaccctgcgcgagtatcgacggacgccttcaaacttaaaattttgagtaacaacttgggtaaaacttgggttttacaaaagacttggaaaacccgacacctgggtcggtgcttgcgaactaaatgaatttccaaaaccgcggaccggggaacgtaccgggtgtacgatttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtgtcggctttcaaaatgccttgtcatgaaagcttggaggtctcctgacgtggctgatccccacgggctgggtgatccgagttagtaatgtcgtgtgggtaaagtgtaccccctctacagaggttaacaaactgttcgaacagccgtgcccacggtcatgggtggatgtgaggtgattcctagcgtagttttgtttgactactgcttgtgaaattgctgttgtggaaaggggttcgatgtttgaaaaatccgtagctgatggaatcagctaggcccgggtggccgtttgaaagttgttggcccgggtggccgtttgaaaagctgttggccgggtgccaaccttgtttcaattctaaagactgatacattgcacatactccgaccggacgagacgcactgtctcatccgtgtcgtttgagaagcactcacttagtcgtttttagaaaagagttcaaataaaatcaattgcaaaaacaacagcctccccttgaagcctgcattaaacacttatttcccatggcttgctgagtactcccgtactcacccttgctctatataaataatcccccccccagttgctgaagaagatgaagcggatcctgctgatgaggaatt

SEQ ID NO: 61476 - DNA, 1711 bp, Oryza sativa
ttcaaatacatataactgaatattgaccgccaaaataaaatcactacttgacaaaatttagatataaatcaaatactttgaaaacagatacagtattgaaagaaaaaaaatacaagcactagaataggtaagcccttgcccttcagaataaaatgtatgtagtactgcagtacagtaaaacaggagctgaaattgttgtacaaaaaaaatcaagactgagtgactgacaactaaatgcaaaaagggcaattactaccttctttgatttttataaggcttattctaattttaaagagtcctcaagattaaattttgaccgttgttttctcataaaatatattctaggtatccataaaaaatattgagcaaaagagctttgaaatgtgtctatattggcttttacactaaatgtacttgtaacttgataaatccttgatcaaaatcaacaaacttgagttttgaaataaaaatacaccttataaaaatcaacagaggggatgaaagtaagagctgttcaaactgtttacacaattggagacacaaaaaagaacattgagattaattgtttatactcacacagcattttgaatgtcatataggcgaattgattcatcatcacatgctgtcacgaggtaatttgtagccttgctgtggaaatccatagaactgattcttccattctgaaatacaaataagccccataagaagaatgaaatggccagtgcagagaatattttaactaagtcagtagatactaggcaacattctaatgtaaagtgaaatatgtacaaatggttcatcaaagaatatgtactgaatatacattaattttcagagtacacattgagattgctaattgacatcccgaccaacatacccgcaaggaattattgaagaaagagcagccaagaaactgacaggtgtgattgtacatgatgggtgaaaggcccgaattaaacaacagtagcatgctctacagttagactagatgaatttctttgttcttcacattctctgtttagtttcactcacactttatgaattgctaatatctcacgatatgaaatgtaaatatattaagtacaccaagagataaactgatatcttttcgattggttaacattgtttacaggacttattacatgcaaaaaaagtttccagtccaagctaccacttagctgtcagggttgatctacttagccctctgactgcgaaagtgtctagataaccccatgaactatctaataccatctaaataaacccgataaggttttacacatgccttttgccaccatagcagctaatgtgtcaatgcttcaacaaatctatactccatttgaaagatgcgatggtggttgtggcaatgaatctgccaccacacctcttcatattgcagcaatgttattgggttgccacataaataatcaaggcgagcactacatatagtaaaaaacaaattaatgttgtttatttcaggaaataatattatgtaacattttgttttatccctaaaaagctaggatttagctagtaagttgtaatcaaattctaaagctgctatatcagagagaaaaggggtgaatagaaaagtaggaaagagaaggcaaatgaaagaaaaaaaaaagagagaattgtttcagttccgtggtgttccacgtaagcaccttagggggttatttagtttttttttctaattcaggatttcaggggt

SEQ ID NO: 61477 - DNA, 5027 bp, Oryza sativa
tcctacctagaagcgaagcaaacaaacaagcaggtgaagcaagaactgcgccgtacaatgggggtccccttgatggagaggagaggcaggggatctgctagcttcgaagggatgggggccagcggcgcgcccatgacgccgaggaggaggcggaggtcggagcggcggaacgagtcgcccgaacccccgggactggcggcggcggcggcggcggcggacgacgccacggacggcgtgcgcgccagctggccgcggacccatcggccgaacccctcccgccgcgccgactcctccccgccggcgaagtcccccccggcggcgaggcgctccgggtcgggcccctcaatgaggggcgcgagggcctcccctccgggccgcaggctccccgaccgcgagatgagcggctccgcgaagtactgctgcagcagcttctccggcggcggctgctgctgcttctccttgcggcggcgcgggatcagcatcctccccggcgacgcgctcctcgccggcgacttcccccgcgacctcgccggcgacagcccgcgcaccacctcctccttcagcgccgcgaagaacccctgcttcctctccttctccatcgcccaagaatcacaaacaatgcagccgcctcaaagaaaaacccaagaaagcttccgcctccccggacaaagactgccactgccgaccttgcttcaagacgagggcatggagagtacggcgcgaggagtggagtagaaggtgagctcgctcgctcgctcgctggctagctggagtggaagcaagcgagcttagctagcggagtgcgagaggtagaaggcgatgtgggcggaaatggaaaagcagccgcacaaaagaacaaaagataaagaggagatgagagggggaggaaaccgtttgacgtgagagcgcaggggagaaagggaaagcggcgaggtggtatgtcggaaagagagaaaaataaatcaaaatacgggtacttttgacaaaataataatcaaagcatgttcacttgcttcatgttactgtagatgtttgggtctgaatttttggtcaggttcatgggacgaggatgatccgtagagaacacagcacgttttcgaccaggatttgatcatttgatgtgtggggggaaacatgtggggttttgtagcgtcagttgttgatttttgcctcgttggaattcccatggttgattgattgccggactgcgtgatttcgggctccaaataggtacatgcatatgccgccaagtcgccaaggcgagaggtagtaggtaaaacacgaagtttcaaaatcagtttgtaaacctcgttggtttaagccccaattgtgtgctagtactagctttatcgagactagcacgctttggaggcggagagaacgctgtcaaaaagcttctccactgtcttcagtgcttgtaaccgctctacctgacccgatgccgtactcaacccacatcctataggtgctctgtattccttctcagttccataatgtaatgcgttattctatcggttccatgggccatgattttccatcagcatctttggtatctcactcaactcataatgacaccgggcaatcatgtaatgttcgtgataatgaaggttgcttttccccgtgttgtaaacagtgtggctgatggccactcagccagccagccttgccccagcggaaacggagccacccggtgagggaaggaaggtcccgggccccgcctcacgcctgctccaacgtgcaactatcgctttccgctggtcccagcaccgtgccgccgaatcatggaggagtagtaggagtagtgtgtgtggctaccgggcgcgatgcgtgcgagtgtggcgggaacgccgggaacccgtcccgtgcagcggcgcgcggcaaccaacgggcagaagggcagaaacgcgcgaccgctcgctgctggtgccgcattgcaacgggcgcgcggacacgtgacgcgcgcggctcgcgcgaggggacgagcagccgttgggttgggttgggccgtgcggcgcgctgctcgctgcgggcgggcgcggcttgaccgagtcggggtcggcgggagcggcgggcggggggcgggggcacgtgagcgggggggcatcagatcggagccccgccgatcacgggaggcgatggcagtaatcgctgcctgctagtgctagtgcatcaggccgtactgtggtagatagaggcggaggcgacgtgcatcaaggggtgtttacatggagctaacttttttttagtccatgtcacgtcgaatgtttgacgctaatttggagtattaaatatagactaataaaaaaactaatttcataaataagagctaatcatctgcgagacgaattttttaagcctaattaattcataattatgaaaagtttactgtagcatcacattgttaaatcatggcgtaattagacttaaaagattcgtctcgcgaattagtctaaggttatagaatgggttttgtaattactgtatgtttaatactctaaattagtgtccaaacattcgatgtgacagggacttggaataagtctatgtttcccaaacactttctcaggcactcagagccagactaataatacaaccgaccggttagctataaggttatttgtagttttctctcggcctatccatataataggttagtctttacaattaatataggacccacttatctctctcacagagtttcttgattcttgtgtttaagccgactgtaagtttacaaactgcttcttctctctcctctcttctcttctctccttcatcttaacatttagccggcttatagtctactattatacttgctcttacagggtgagtaggttggctaatactgctttttttttaccttgcaatcgttttttcccctcttctgtgtggatatcacagggcatgcggtggttgtatgccacggatattgcaggggcgattttttttttccctatcatgcaggacatgacatgttgtcaaccgattgtgcaacagaaacccagctcagagctataaactgtagtacagtacgagggtgacagtttggtctttggtgcagtgactagtgagtactcgtaactctttactaattgcatttccattatatattcatgtgcttaggcattgatcgtaattgtgtacagtttactcatctgtcagtcactgctactacaaattgcagtaccgcataagatatgtatacttttggcattgcttagggctcattcggttcataggatttttaaaacataggaatactagaggaatacaatggcaaacctatggattgaaaaacacatgaagttttcctatgttgttgagcaagccaaccaaagaaatgcaaacattaggttggagtagatattttttcctatgtttttccttcaaaagtagaggaatggaaaactttcctatagttttcctatggtgcattcctatgaaacgaatggtagtttaaaacacattcctcttcttatgcttttcctttacagttccttcgaaaggaattagccttttgcccttcgctccaagcttactaaaggataaaggtatataaactctaatatgagatagtgatttgtaatgctattatagtacatgatactcatagttgtgccacaacaggttgcgctatgacaagattgctataaggacactagttacaactattacttctttttatttcagccctttatttcctgcatggtagcccttctcacctttttattaacaaataagctaaaaattttatggtttagaccttataacataaaaaaaaaagttacgtacatgcccctaacctaccgatggatctacttgttagccagcctatcatttttttccttcctcatcaccctctctccctccataaaattttggctacaaagaggcggaaatagagttcgatccatcttgtcaaaattttagtattaccaaaacttgataagatttattttggctacaatatgaacaggctctacgaatgttgatattttcctgcacatgcatcaatgcatcatcagcgctcgtcccaattcgttctacttatccagcccaatgtaaaaaaggcccattaattcaggtaaaccgtgggccgtctcactcgagccgcaccccgtttgcaaccgagaatgctgtttggcgatcgattgccccgggatgggggcagcgatcgatcctctcccccctccctcactccacccctccaccggtttccttttctggcaccgcattacttttctattttcgtaaatttatacacctaaagtttatacacctcaagtttacacttctatagtttagagaccaaaagtttataagtcaaaagtttatatatccgattcaaatttgaatttgaattaaaatatttttttatatatggtatttctatacatctaaagtttatacacctaaagtttatggacctaaagtttataagtcaaaagtttatatacctgtttcaaatttgaatttgaattatatctgattcaaatttgaatttaaattcaaatattttctatatatagtatttctatacatctaaagtttatacacctaaagtttatagatccaaagtttataagtcaaaagtttatatacccgatttaaatttgaatttgaattatatctaattcaaatttgaatttgaattcaaatattttctatatataatatttctatacatctaaagtttatacacctaaaatttatagacccaaagtttataagtcaaaagtttacatacccgattcaaatttgaatttgaattcaaattttttatatatagtatttctatacataaatttttctaaattttgttttttttaaaaaattgtgtggtgtactgtagtagaaagagaagaaggggaggaggaagggggagaacaggaggagaggcaaaccgatcgctgcacgatcgccctgagaacgatcgcccattagcctcccccgttggcaactccgtgtcgcttccaccatggcgaattggcgattcgctccacccgtcacggcacggtagcagtgta

SEQ ID NO: 61478 - DNA, 2283 bp, Oryza sativa
cacaggcacactgctagtactgcgactgagccacctccgtactccgtcgtacatacactacactactccctccgtctaaaaaaaagacaaactctgagttttcgtgtgcaattttgaccgtccgtcttatataattttttttataattcgtattttcattgttgttagatgataaaacatgattaatattttatgcgtgacttgtctttttaatttttttcataattttttcaaataagacggacggtcgttgggcatggaaagcagagtttgtcttttttttttggacggagggagtgagtttgtcttttttttttttttgacggagggagtagtttctggagaccgtagagcggagagtattcgtctgcataaaccgtagtagtttcatggagtacttgagggtgtgtttagttggggaaaaggaaatttttggtgtcacatcgaacgtttgaccggatgtcagaaggggttttcggacacgaatgaaaaaactaatttcagaactcacctggaaaccgcgagacgaattttttgagactaattaagccggtattagcacatgtgggttactgtagcacttatggctaatcacggactaattagacttaaaagattcgtctcacgatttcccccataactgtgtaattagtttttctttttatctatatttaatgcttcatgcatgtgtccaaagattcgatgtgatgtttttgaaaaaaaaattttgggaactaaacgggccctaaattgaacagcgcggtaggcagcccatttgtcccgtaaactcggcgatgtaacaaaaatgaggctctcatagggaatacatccaatcacacaacctttccatgtacaccaactagcaaatgtcacaaaaaattctataaaaaattatacatttacacctaatagaattactccaaagtcttatatttaaattcattatattttagctatataaaaaacgaaaatctgacaattttatcttttttcaggctaaaatataatgaatttaaaaacaagatttcacacgtaggtgtaatattattggaaatatgtgcctaatttttctaaaatttaatatgatatttgttagttggtgtataggatatattcctctgatatattgccataactagctagatatagatcaaggagcaagtctagggcacgcttttggataaaattgagtagcagatgcacggtaagcggccaaggaggctgttgcctgttgagacatgacaaattagtgaaaactcaaggctatctaagctgttgcctacttgcctgtaaaattagtgacgtgaatgaaaactcaaggctggttcaaattacagggaaaattagcaaatttcacgaaccaaaggaaaacgtcgaaataggtgaaacagtggaacttcatcttcgtaataagtagctcttcacggttttcctgcagagaagatatggttcaaatgaatccagtgacagtaagttataaaaacacctgaaatgagaccttcagaacacctaaacagtatcattcgtaatgtcgtgtttaccatctctgacacgtctcagtgacacaaaataagagaggcctacagtttttatgtttactataggtttcaagcgatcaaagaaagcacatgagaatatagagttggtgattcttgatgttttatattgtttttttttacgtaatgttttatattgtctaaaacagattgcaagtgagagtgtaacatactactaacatgctactccatccttcccctaaaataagggattttgacattttacttgcattgtttgacaattcatctgcaaatataaaaaacgaaaagttgtgcttaaagtactttggataataaagtaagtcacaaataaaataaataataattctaatttttttttaataagacgaatggtcaaacagtgcaagcaaaatgtcaaaatcccttatattaggggacgaagggagtaacatattaaggatgaaagcaagtacttgcatgtttggaagatcagggaaagaaatagcatgaggactatactattgggtgaaggatattaagaaatcatacatggataacaataatggaattgtcgcaagttcagacaaaagaataaagaacactgtcctggagagtgcatccactctacaaaaaatgcataactatacgcacaaaaaaaggtggccaaatggttttattgaattgtaaatgttcaactctgttatctgttattgaaatgtcatatacatcctttttttccttttgaaaggagtaatggtcctaacaa

SEQ ID NO: 61479 - DNA, 10750 bp, Oryza sativa
ttgatgtgcccctccaggccatggtgttggactgctggtcctgcaaagcacctctactcttcgcatgttgctggtggatccgtgaccatcatctgaaatgttgagcagtaatttcttcagtacaacaagcctctcccttagcttccacctgtgatgcgtggaatcctcagttcagaatcctgtgttctattttcttcagcagatcatcgaaacactcaagtatacagttgtactcatgaaacatgagacctctcgccctacagttagatggagaacataattagatcaccagagctatttattcagtgtatgcagtgctagtgaagcgacaggaatatgagaaacataccattcacgatgattgcaatatgtgagaagatgatcagcaagggtgaatggtcgcacagatgggcgaatcctcttcgttgtgtcatggacttggcacaatgttgttggtcgctcgaacgatttgttgcttggagagtgtaaaacgacaggatttggcagcagcacatagtaatagtagtaaactgaatttctgctgattgaagggaggtgtttggctgagactgacaagcacctatccctacaaaggaacagcacgaggttgccaatgctgctaagagcacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagctttgctctctctcttcatttaatacattccaagtaggaaaatatgctgacatggatctcttgtagagagcctatagataaccattgtgggtgccctaactggaagcagttcccagctgctgacatccacctcgaagattgtgaatgcgcaacgttgccatgactccttggcctcccttgtcgcactcccatggcggacaacgaggagcatatgcccacaagagtcgactaggttgtaggagcaggagactggatgtctggatcgccgaacttggcagggacatgagcaacaacggggccaagcgggtttggagggtagacttgcacaatctgccttgtcaatcgccggaagccgtagagtcgaccttggaagggcaatgtgttcaagagctccatgtctttgtggatgacctcccagcttgggtggctagcctcacagccgagcactccagccgtgtaagggaaccagacgatgacggcaatgggggtcatcggagacgtggcgctggtgcagcatgtagagcagggagttgcggttcttgaccacctggtggaacacgggggcgaggggcgggaggtcgacggcgacgccggtgaaggggttgagcacgcggacggcggtggtgcgcttgtggaggaggatgatgaggccgtcggtgaagcccacgatcctgtggcaacggagctccgggaggcggacacggaggctcctggccgtgcgggtgtggaagaaggtgatctcgcaggcgtcgtcggggcgggcggcgtcgccgtcgcacagcgcgacccacgcgcgcgggcggagcaggtgcttccgcagggtggggtcgcgcggcgagggcgcgcacgcgcgccagccggagcagacggctcggaatgcaatgtagtccaccacgtcgccggcgagcacccggccggcgacgaggcgggttaggtcggtggggagagacgcccagccgcctacctgcgccgccggagaagtggtcaccaggtggcgcttgcgcttccgtccgcctctcgccggcgccgccgcggcagccggagctgaagggggagcacttctccccattccacagaagtgattcaaaccacaacgcgggcaccacgaaatcgtcggatgctatataggctaggctggcctcctcgccatctccgaatccgactccgactccgactccgacaacgcaggcacagcaatccgaggagttcacggaaacccgagcgcgcacctggattggatggacgacggagaaacccttggaccttgcgaatccgaagaagaagaggaagatccggaggaattacctagcaccgcaagatcgccgccggaggcccggagatggggagacggccgccggagagggggatggtaacgagtgctccgctccggcggacggcacggggaatagttggatacacgagtacaaacactagccattaagccaggcctaacgggccggaatgtgttgatgggccctcccacgattatcttccccaagagtaagttaacttgaggtccctcaatttatcatcgattctgaaattgatccctaacaccgaattaccagatagaacaggttgctgaatttacaaaaccaaatcacctgaaattctaggcagtattaagcttggttttagcttacgtgcttttagatgcaatatcaagttctgaacacatatttactttgaatcagtgacaattatcgaactatagggtgaaataaacagtcaacttttttttctcaacaatccaagttggcatgcaaatcattgctgctatgaagttaccttctgcactctgcactaattaaactctagaaattttcttaattttccaacaaagagaagatgatggtgttactttgttacggttattttcagtttgcgtgagcacttttattatggatgtttgcatctcacggtgcagagtctgagatatttattacatcatcaaaacaaatgtgaacacttatctttgtttttgcttattaggacaaggcattaaggatttctagcaacatgataatattatcgtcacatttgggctgtgatttgtgattataataccacgtaaacgtcaagtcggatgaaaacagcggcactatgccgcataggatcaaacaaccctcatcgatactacccgggtgtacaatataagagaggctttttgtacccgatgttgtggttgagcgacaaaatcagacttggtccatagctgagggatgttaaatgaaccttttccccatcaagctcatcccaattgatctactaatccaacccagtttacagcccattaattcagtttggaataagttcacctgaggtcccttaacttgccaacgaatctgattttcgcccttcatccagaaaactatatacaacgggtccctcaactatcaaaatcagtgcagatgaggtccctcgacggttttgacggtggttttggctgacgtggcgcctacgtggaaaattttacttggtcttcatctgatgtggcattgacgtggcgcatacgtggcaatttgatcgaaaaaataataaacttagtaggacccgcatgtcagtctcacacacaaatcaataaaagaataatggggcccacgtgggcccacatgtcagctaaaaaataaagatggttgggcctacgtgggcccccacaagtccctctcggctctcctttctcttcctctttggtctccctcgtcctcgcggggagcggcggcaggagcatgccggcggacggagtggcggcggggcgggcggagcgacagcaggccggggggcgtcgggccgcgtccaggagcaaggaccgacacaacaaggtgtgcacgaacgtctccgaggtcgcctgtgccgtacgccgcgctcacccgccagccgctgctccgctgctatgctcccccatcgccacttcgcccgccgctgccttggagaagagaagagagaagagagaaaaaagaagagaaggagaagaaaagaaaagatttgcagctgacatgtgggccccacatactttttaaatttttttttgctgactaggatgccacgtcagtgaaaccacccatgtttactgccataggaccttgtgtgtacggtttatatgagtttaggggtatacatttctgattttatagttaagggacattaaaaaatctcgctgttaagttgagagacctccggtgaacttattcgtctctctcgtactgcactcgtttgtcacttcattgcgcttccacgtctcacgacggaatcaatcgatcgagccgttgccgactatacacggttgcattgcaccgctgctgtccgctttgcgtgttcgttcaaaaccagtccagcgtcgtggcagaggcgaacgaaccatccgtcgatggcgctgctgcactgccaaagtaccaagcgtatcgtttgccgctgctgctcgtgctctcgctactggaaatcagaaatcaaccagcgtatcgtttccctgacacgggccagcgaccaggtcaaaagtgagtgaaagaaagaattcaatgttgggtgtacagtgtagtagaatgtagtacgcctgtatgatcgcttcatgaacatagcacccatatatataagcagccaagcaagcattgcatccccatgaccccatatcaagaaccactccatacttacaattggtaggcgacacagctcacataggtcacaaggccatggctaacactaccatggcgagcggtatcaacgaggtaaaaaaaaaaaaaaaactccttcccgtgagatttcttttcatgacttcaccccctgcttgcgttcctggttttgtacatctctcaggggaggttgctcgcctttctcatcgtcctgtacgcttccacgatcgccgcatccatcgggcgcaggatattgggggcgcgcctcgccgcgtggcgctccgacggcctgggcgccacctgcatgtccttcgcggcgctcacgctcgcgatgcaggccatgctcgcgtgcgtccttgaggagaagcccgccgcggccgcggcggcggtggcgaggcgcccggccagcggcggccggctcccgtggctggtcgccgccgtgagctggatgtgcgtcaccaactacttcgtcgcctacatcgccctcggcggcaacgtggcgcccacctcgctggagtggacggccgccggcgtcgcctccgccgccaacctcgccatcgccacgcgtaccgtccgggtaaaatcttcttcttcttctttttcgatcttatactagctgttcttcgcttctttgttgtgttcttgctaactttctttctcgttgtcttcagcgtcacttgggtgtgagcaacccggccaagaacgagtcgtagatctgccaggagccaaggaagctggagtttttttggagatgactgctcgatccggcgtgtttaccagtagtttatcaatcaatagtaccttgttatttcattgccctagctttgttcgtgaactttgctgtagtttctgtatgatctccatggatccagtacttgctagaccttaattatgaaatggaaacttgcagactactactccctccattccataatataagtcacaaccactttttttagatgttacataatataatataaggtatacatgcaagcatgcaataaactatgacatcttctccattaaattataacttttttaaatcctccactctcatgttatctaatcctattagatgcatacattgtatacattgtatttattaggatgatctaaactacaagatgataataattatttcttggtctttaggttaagggtagttgtgccttatattttgaaacggatggagtatgttttttcaccttctatttcttaaaactgttcttttctatgtgctggaggggaatatgttttctgtgtattgggtttcattcaccaggcgcgttggtgaccgtgtgcccgtgaaatgatatcacagactttttttttccaaaaaaagaacacgtccgaatggttatattgtgtagccaaaccaactagttgtgcaacagaaaacacaaaacgcagtgctataaagtgcaacaaaacaccatagttttggcaccttattggtatctcgagatattttttttgttagaccaaagcaaatcttgatgagtataataaccttttgtgattccgttttcatcataattcataaattcacaagcttgggccttgggcatttgcttgcgcctgtgtgtgcagcaccgctggtacagtgaagctgacactcggaaccagtctacggagtactccctcttttcctaaataaagcaaacctaacttgccaaggagcttttaaagagagaaacaaaagaccacaatgtccttaattaatatgaatgttgtattgaataatgggtaggtgaggggtattgaagtaataaaatttctcgttttgcggattggtgatagtaatatggtagaagttagtttattttggaattaatttgaaatctaaaaattgatttattttaggacggagggattagtaagtagtagctgcagtatcatgccccacgcagagcatgcgtggtttggtttgtcgttgctcgctagtgaaatcaataagcgcgagttcgagctcgagcagctgaaaaaccactgaaaagtgaaaaagcaagaaaggagtactgcgtccagtctgtactcctgcaggctcgcctctttccaaaatttgccaaagctggaattaatactgccaatattgaccagttcaattgggagtttgagacctctaggatgatcactggatcatgaacactaagcctatatatcagcaggcataagcaacaagttccagtccaccaaacacacgacataagcagtcaagaagaagagtagcatagcatggctgcgagtgatctcaccaaaggtgaaaccctagacgactcctctcttcctcctctgaattttctgcacttcttgtcacgatgtgtacgtgttcttgtgctcgatttctctgatccgatccgttccatcaatcccagggcgagttcatgtccttcctggtcgtcgtgtacgtcgcgacgtcggccggctcgctgttctgcaggctgatgtcgtcgatcgcctccccggaggccgccgccgcccgtcggcgatccggcggcctgaacgacgccgtcacctgcgcggtcttcgcggtgctcacggcggcgtcgcacgccttcatcgcgtgcttcgtggaggaggccgtcgggcccgcgccgccggcgacgacgacgagggaggagaggtgcgccgcgtgggcggtcggcgtcttgaccggcgtcgtcacctcgctgtgcatctccagctacttcttcacctacatcgccgccggtggagtggcgccgacgtcgctgcagtggacgatcgccgccgtcttctccgacgccaacttcgtcttcgtcacgcccaccatcatggtaattaattaaagattggatctttgcatgcctacccgtctaattactgttaattagctttcttgtgtgtagcactaattctaaactagttcgatctcgttgtctcttcagcgtttcattggcaggttcaacagtgccagggatgactagatgttccaggaagatggatgagtagttttttggagttgtctgattcaggagatggatgcttgagtcgtcgtcatgcatgttgtttggctgctgcctacctatgcatgttttaccggttttgattaccttgatgttgtttttgtttctcttatgcccgtgatcttgctgtgttcttgatcttgccgggtaattaaacttctaagatgtggccttggaatgttgtatgccgtatgcggctccatttgatgatctaatctaccagtttgtttattttggtatttctgctaatacttgttcaaggagaatctgttttctggttgtgaaactgttcttttccatgggattgtaggcaggatatgtaggtagtgcgttgtatcatgtactacgtgcgaaattgcagcatcttcaggggtagcaatagcatagcccagtttgaattcgagctgctgtctgtcactctgtgtgtatgtatagcacagcgaaacttgcgtgtagtttgtcacgttgcattcctagacatgggccctgtttggatcaggagggctattaaataatcctctagaatcttgctatttaaaagtattaaacatagattactgacaaaacccatttcataacccctaagctattttgcgagacgaatctaacgaggtatattaatccatgatttgctacggtgatgctacagtaatcagccgctaattatggattaatatacatcattagattcgtctcgcaaaatagcctaggggttatggaatcggttttgtcggtaatctacgtttaataatcctaaatagcaagattccagagggctatttaattttttttttgagcaaagggcgatgccctccatttccattaaagaaatgtaaatattcttacaagaaacagagtctgaaagaccaaaatgacatcatgcctaaagcacaagctaaagttttcctaaagaaagaactccaattctgccacacagagccaaacagaagatcaaactacctagtaagacaaaagcccataatcgactatctccagtaaacgccatcagccattgagcagtcttctctgtccaagacgccacccaaattgtgatttaaaaacttcatttgctatttgctttagcagttgtactccccattgcaactttccttgcctttcctccgaactctgcaaaatggcccaatccaacattagagagcaggaattatacaagatatcaacagggctatttggtaaaatatgatcaaagcaggctttatttcttgctttccaaatagcccagataacagctgccacacccactaacatcaattgttttgttattttatcacaagtttgaatccaagagcttagcaagtgcttcaggtctttaatctatttcaagttaaaagcacatatcacaatgttccaagtaaatctaactgacacagatcattccccttcttccacccccttttgattagattgtctttggttaaaacatttcctttagtcagtaaccacagaaaaatcctaactttcagaggaaccttaattttccagatttttttgtatgattccctcaccccagttgatgtttcctgaaatttcaaagccttatagaaagatttaacactgaacatcccattttttgtcagattccaaacagtgacatctttttggtcactcaagaccagctcatcacaggaagttttgatcctattccagtcaactaatctatcacccatcaaattccttcgaaaggtcatgctagcccaacctatctccttcacctttgccaaagtcacaaactgattgtttgttattctatacaagagaggaaattgatctgccaaaggtctaccacccaaccagttatcctcccagaataagatgtttttaccatttccaggtttctttgtgcagaatttgaaaaagatgtttttgacttccattatcccttgccaaaagtgagaggctcctgcttttaatttagtggcagacagaatgtgtttggataaatatttttctctgatcatctgttgccacaaaccatcagtattctcaagattccaaatccatttccccaacagagcaatattcatgaattccatgtcaaggatccccaacccaccaatctctctgggagagcaaactgtgtgccaattaaccaggtgatattttctaatcccctgatcttcctgccataaaaatcttcttctaaaaaaatccattttttctctaaccccaataggaactctaaaaaaagacagcatgtaaagtggggtgctactgaggcaggcattaatcagagtcaccctccccccaatcgattggaaattaccctgccaacatccaacttttttctcaattttcccttctgcctgtttccaatctttattcagaagtcttttttgatcaattgggaagcccaagtatctcatagggaagcttccaatattgcaagtaaaaatctgactatatacagcttggttttgtgctgcttctcccaaacagtaaacctcacttttgttaaaattaattttaagacctgaaagttgctcaaaaatgcagagcactttttttaaatttcttgcatattctgggttatcttggatcaaaaaaatcgtgtcatcagcatattggaggattgcaattctgctatcaacaccagtccccaacccctgaattaactgttctctctcagccctttgtatcataattgttaaagcttcaacagctaggttaaagagaagtggggacaaagggtctccttgccttacccctttgtgagtctgaaagtagggcccaatttgatcattgacttttactgcaactttacctccccttactgttttcataatccaatcacaccaaatctcagggaaaagttttgcttgaagaatatgaaaaatgaaatcccagtttattttatcgtaggctttctcaaaatctactttgaataagatccctttttgttttttcctgtgcattgtattcaaaatttcatgcattattagtactccttccataatattcctattttttatgaaggcagtctggttctgtgaaatcaagtactcaattacttttcttaatcttagcatgagaatttttgttataattttgaaactgacatttaatagacatattggtctaaatttttgtttttgcattgcatcctttgtttttggcaccaaagtgattactccataatttagtctttcaatgtcaatgttccctctttgaaaatcctcaattaccctcattaagtcaggagaaatcaggtgtcacgcccagaaattcccgaatagaattccaagcagaatgtgcattaaaatccccgtccaggaccggccggggtacacaaatgacaatattgacattcagatccacgtcttacaaacatc

SEQ ID NO: 61480 - DNA, 30849 bp, Oryza sativa
gtagtcattaatggactataacctttttcgttcataaaagcaaacctacatatatatctaactgtgctcttttagataaagagccttgctgccacatgtgcctaaccaaactagattatcaacaataagtatcatgtgcctaacaaaactggattatatcaaccaataagtgtcatgtatctaacagaatatatgcagaactcagatagcatctcatcgccacggacatgagaaactgagaatctctgcagaatgcgccttcgcatttgcatgagaacaacaacacaatcatcttccccagccccccaaaatcaccccccacgagcaaatgcatcaatcccctagcgcaactctgacatcatctgacgccgccgagagggggacagcatgagcggagaccggcaaaaccgagcgagcgcatagaatttgagcttacggccctggtacatgtccacaggattcgggtgaggggagctcaccggcgtcggggaaggaggagtcgacgtggatgtcgaaggggacgttgcacatgcggaggtagaggaggacggggaggcaggtcgggcaggcggtgggcagcccgaaggcggccttcctcgccaccagcaccttccgctcagcctcctcccactccgccgccgccgccgccgccgccgatgccatcgccgggagtggagaggattccttggagcttcgggaagaaaaaaaggccgagggtttatgggtttgctcgcctcgccgccccgctgcatctatgaagcccatcacgtacactgggaatccaattccggcccacatcacgtcggccctgggggaatctcgttcttgttggagtaggcccggcccaagtacagatgagcataagagaaaatgaataagtccattttaactctcatatataggtttagtcttattcatattcctaaactgcgatatgggatatgttgaccccaaaacttgttgaccccaaaactattaaaaccgatgtaatttaactttcttgtctgttttaagagcaattttcattgatttggctcgagctcgtgtggcggtgtggacgaagaacgctcctcctcgctagatgtcgtcgtgccgctgccaactgccattcttgagctcgtgtggtggtgtgggaaaggggagcataggagaaatactcggccacacgggtccctgacatgtgggctccacatatggacctagtcccattagaccaggtcaaagagccatattagcaaaaaccagcatctccctaaggccttccgccttgcctggttgggccagccatgctagagatggagatccattgccatatctaaaaaaccgatgtgcaagactagaagagtatttttgtcgatgagttcatcagctattggatttttgtgatgtttgtatttttatatctatctactgaatttattggtaaattctctgaatctttgggtctccgataattttggtcatggctgagaccgaaaccaaattatccgatactgaaatgggtcatctggctatatatgagctttaaacataaaaagtaaacaaaggagcaaccgtaatacccttagcccgtttaggctgcgttcgaaatgcgtattattgcatattattgcatattaattaagtattaattatttatttttaaaaaatagattaatataattttttaaaataattttcatatagaattttttaaaacagtttgaaaaaacgtgcgcgtgaaaaacaagagaggtgagttggaaaaactgagggaggaacacaggcttagtatatttcaagttttcaactaagcccaagtgttcatttggtaggagtagttctaggtgaagagtttagatgggtttgatctagtttatatactcgattcactctaacaatatcaacaccttcaacttaaccctttcaaatgaaacgttaacaatattatataagtaaaatactataaaaacgtgggtctgctcagcatatatataatggactaatacggatttgaaggctagtgtaacacaaatttacagcaattgcctctatcttcttgttcctctaacaaatcaataagccggcgtcatgatgttttaatgaatctcaccaaatttctggatcatcatgtttcaaattttcaataaacctcatcaattctttttccgttcgttattttttttttcgatgagagaaggccatgttcaattctcacgcaaaaactttttacactgtcacattgaatttttggcacatgtataaagtactaaatgtagaaaaaaaaccatttacacatattacgtgtaaattgcgaatcgaatctttttaagcttaattgtaccatgatttgacaatgtggtgctacagtaaatatttgttaataatggattaattagacttaataaatttgtctcgtggttttcaagtggaatctgtaatttgttttgttattagacaatgtttaatacttcaaatatgtgtccacatattcaatgtgacacgcaaggccaaaaatttttgccaactaaacaggcctaaactgctcctaatatatgtttggtataaggttttatcaatttttgatgtgttttttttttctaagggtgtgtttaattcacgccaaaaatgaaagtttggttgaaattggaacgatgtgataaaaaaagttagaagtttgtatgtgtaggaaaattttgatgtggtggaaaagttgaaagtttgaagaaaaagtttggaactaaactcggcctaaatataggccctgtttggagaactggccaagagttattttgagagctattttttagcacaacgaaataacccttcaaaaaatagccccaagttgtttggatccaagggttattttgagagctatttgaccttcatgtatcttcctatggagggagatagagagaaaagacactttttcagtggacaccacccgaaatagccccaattagcacaccttgggtgggttatttctaaatagctcttaaatagctcacccttttaatctttttggactgtttaatctatttgagggaggacttaaaaaaaatatcccttagatcaaagagaggcatagaatggacaggttcgtgcgaagtccacatcagtgggtcgggttcgtgaggaagtcgacgtcaggtgatctcttttcccgagtccactgtccaacagtaaaatggacagaaggccacatcgctgaccgatcctgatcttctgtgaggttcgagcgacacgcgcgaaatgccggtgattcccctggtcccatttaacctgctccgtataaatacaagggagagggagcagctcaacgcacaccgaacaacgaacactgtcaagctgcaacacacaagctgcctgcggctgcaatggcggatcgggtgatccattacctcctgcgcggcaaccagctgcagggccgccgccaaaccctcgccgtcggcgtcggccaccaccaccgccgccggctgctcctcctcgactccagccgcgtgttcatgttactcgccgtcgttatcctcgtgcacctgctcactgcaggcgcggccgccgtccagggcgccgagccgtgcgtcctcgtcgccgccttcctcctgtggctgctcggcgccgcgttcgccgtgctgtcgctcgccgccggccagttccccgttcttgctgccaccgctgccaccatcgcgaccacgctccgcagctacctgattggaggtctctagcccagctttgggtttggggacagtactagttctgaatgtactgtgcagtactttcattcatactctgaaatcgcacttaattttgtctctactagattattgcttaaatatagccgactagccatatatatactttctcatcaagtttcaactttcaagtcacctgttattgtactgtagctttcaagtgccatgtttatttaaatttatctattcagttctacctaaacaaacttaaattgctgtggccatattatatttatttatcctttggtgcgaagaaaacgggccaagcatagacaactaccttcttttctaaaatgtaaagattcctgcacattttaaaaaatatgtagaattttttatattttagaatggatagagtaattattatatatatacgacagtgttcctgaatcgtgacttcgtgaggagcacggagaaaacgtccacacgaattctacgtcatgcggcccatcgtaccttcgctttcgttctttcctgttaggattgtgcttgcccgtcttcttggggaggtctcatacccgcatcgctgcggcgtgcaagcgcaactacggtccagttgaaagaagagcaagttagcttatgtaaaacgagaaaatcattgatatatgattatttaacttttagttattataaaaataaaattaaatttatttgatattttaaaataacttttatatagaagatttttgcacgaaatatattgtttaattatttgaaaaggtattcacaggaatcaatggtagaatctacgtcttactccttttgttcaaaacacattctgttcagattcattgtactaagatgtgtttcggatgtgttccatcctagtactagtctagatttcttgggacggagggagtaataaagaaagaacgggcttacgtgcatcttccttgtgtttcatagattcttttgtttcatatgaacttaaacctaatgaataaaaactcagttggactcgaaaatagaccatgtataccataatagccatgttctgcctttttttttcttctcgtgtctttctcgccttacatattttttatccaggaaaaaaattataaatagaaactttgtacatgataattttataataaaaaaaattatacatacaagcttttgtgcgtataattttttcgataccaaaacttccctaaaaaacaaacttggaacaaattcgaaacaaaaaaaaagtaaacgaagaacaaaaatgtcatgtggggccgtgttgacgcgcggcggagtatcacttgtggccttctgggaggtggttgcgtcgattggttggcgcagctgcgttgcaacttccaagcgcgtttgaaaacgtcctcggagtagtgccatttgtgcttgcttctcgtaacgaaaccctggaggtttggagcaggagaggctgcaaattgccatcgcatcatggactagatggacaaatttctgattcataccgcaccgggcatgatcacaagtctgatgaagtgtttctcggctggattttgtaagggcatcctcaatatttgtggtgtagtgtaaccttaaggtgggccctatgaatagtgagccattgttaaagccatacccacaatgctatggttagaatttagccacaagataggcccacatagaatagaaaaataattgtttcatctcttgttcatgaagtgaatgagagagaaaaaatattttctttttcttgtggtagaccttaagcataaggtgcaccctaaactaatgctactttccacaatgtatatagctcactttacaagtgcaatcattaccttaaggtcacctttttcatacattgtggttgccctaaggtagtaactcaggatttgattttgagtttagggcatgtttgaggaagcttctgacagatgcagtttttcgtccaaaacagtcagtttttttttccagattttaagaagatgtagttgtagaatccaaaaaaatgaattaaaaaccccaatcagacccttagacatgccacaaatcaacataacagaaaacgccatggaatacaaccgacttcacagcttctaaccaaaggctccaaagctctttccatacacctgcattttcaggctaacgaaattcctgaacaaatgaaaccgaaaacttctcccagcacgccaaaagacaaagcgagtggagaacgagactgctctcatcatttgcccccgaggaacaaagcaaggttacatggaggaaaccataacatagaaggtgggttaactacaaatgcacaaattttaaaaagggaaaaagtataaaatgtgctgatcaaaaaccttaatagcaatcgatcatacagtcaaatttctacttcttggctgttaactggctacattaggacggcatgattcctatgttcaacagatcaagtttcaccaaattaatcaaataatagttgcacacaagcaggatatttgtatgccaaaattacaatctccaaaataaagttgcagtttggtgcatcactgcaattttattttggagattgtaattttattttggtgaccaaatcataagcagtgtagcagaacaagcatgcatggtacatgaaacatcagtcacaaccatggacaaaactgcaccttggtggtagtatctcaaagtacaaccagaataagtataaagcatcatcctatcaatcatgtcaagaaaaaaaaacacaactatatttacatcttagttgaaaaactattgttccgcagaaacacctttcaatgccacttcaaagaagtacaatgctcctcaggcagtttcaaaaagagaatcctagacatcttagtactagttcaagtatggtttcacaggattgagttgctcgcaaatttaatgaatcaatcatgaacacagttagggcttattcggaatggaggagaaacacaggaaatgaaggatttgggttcctatggattgctttactgtggcgtcattcagatcacaggaaaacgttcataggaaatacatagggaaatttcctgcactagccatatcactggaagatcacaggaagaaaaacgtccatgctgacctcttttttcgctcccttcgcgtgggaacgaggcaaatcatgccatcaagcaactaaagcacattattaggttgattaatgttgtttaattcactagtagtatgtgataattttgtaatagtgcacctattttcttctaaagattcctatgtttttcctttactccatccacacctattcacatgaaattcctatgttttcaaatcctctgttttacacttgcattcctatcctattcctatatttttcctattcctatgttttttcaatcctgcattccgaatgagcccttaaaacgccgatcttcctacgttaataatagcactaaagctaaagggggcttaaaacatagatatcccggaacagatagatctttaattctttgttagcgtagaacccatatcatactgggaaaaaattaaagtactgaacaccagatcagattcattgtttgaataagtctaacacagatttatcatagtcaaggatgcagcttactagagtatcacattttgttcccaaattattagaaagagcataaaaccaactaaaccaatgtgaaatcaagaaaattcaggcacaggtacaagataaagtaacaaaccatccatagtatcccctcaagttcatagttggcccaaaggttcgtctcttgctgttgggggtaagtctgtcttattactgtctaatacagcccccctttgtaataccaccatcttttgttgttggctaatgactgttgttattgttaagttgaattgcccatgagcaaagagacctatggtggccacagataaagattttaacctacagtcttaaaccatattccatacataattactgacattcccataggcaaggtacatggtgaatagaaatattaaaaacatctaagaagctgaactatgtagccataggaattctaggtctttcgaaacaacagaatcaccttacagtttgaattgattcactaaacacattcgatgacaatataatcacatgcatagatctcaaacgattttaccctttaccctacacccttgtttttcatagtacctatctcccttaccacaataacaatcaagcaaggcatacagaaatcgcaaaattgaacaaacttaagggaattcactgtcatagataaagcatcgaccgcccaagcatgtccaacataaaattaaaacacatgattatcagatagtttggtttagataacaagaagcataataatgataaaaccatctaagagcagcaggcatcacaaggcacagcaaaccagcacatcaagcctcaggcgccggctgcgagaggccggccttggcgagcagcttccccatcgcctcaggggagcacacctggtactgcacttccccggtgccgggctgcaggaacacctcggcgagctccagcttctcggcggtcaagctggtcgaatccatggtcttgctcaggaccttgagggcgagggctacggcctcctcccgggtcaggccgtcgcggtagtcctgcttgagcatggactgcgccgcctggctgttggccccgacggccgcggccttccagccgctgtagttgccggagggatcgctcatgtagagctggaagccatggtgcttgtcccagccggcgaagaggaaggagacgccgaaggggcggaggccgccgaactgggtgtacccctgcttggtgtcgcagagggattggacgagctgctcgacggggatgggctcctggtaggagagggcgtagcgctgggcgtggaggcgcgccgtgttgaggaggatgttggcgtcggacatgatcccggcgacggcgcaggcgaggtgggagtcgatcttgtacatcttctcggcggagcgcgaggtctggaggagcttggaggtgaccttcttctcgccgacgaggaccacgccgtcggccgccaggacgccgagggccgacccggcgttcccgatcgcctccatcgcgtactccacctggtagagacgcccctccggcgagaagatcgtcgtgcggctgtcgtaccggcgagacatcacggcggcggcggcgagagattggggttttctccggttagatttggggatttgaggggggagaagtgaggggagaggtgtgaatcgggtgaggttaaggagagagacctacttgtaagacaagaaaagaaaagagaaaaggccttatgggctggatttgatttgaatttgtcatggaaacgaatttgtacatccgagccccctatagattctaactttttcttcaaacttccaacttatccatcatatcaaaacttttctacacacataaatttttaaattttttctttaaacttccaattttagtcaaacttccaattttagcgtggaactaaacacacccgaattgaagtggggtgggggatgaggagatatttagaaggaaaaagtaaaccgaaggtccctgatcttgtcatcgaattaaaaaacgtcctcaaactgcaataccagatatacggcgttccttaactaatcaaaaccggtcacaataggtctttcggtggttttgactccagttttatccgacgtggcggctgagtcagcgtggaacccacgtgggccccacatgtcaggatgccacgtcatctctctcccttcctctctctctcagtcttctctgccgcgggagaggaggagggtagcaccgcgacggcggcgggcggtggcggcggctgcagcgggaaacacggcggctccgaggcctacggcagaggccagcgagcgagtgagacacgcggaggcgggatcggcggacatgcggggaggtcgacgagctcctcccaagtccaaatcctccattgtcggcgagctccactgcgtggaaagggaggaggtggggtggccgcgatcgtcggtgaggagctcgaaggcaggggcgcaaaggaggcggtggctcggtggctgccaccctctcccagctcctccccctggccacagaccgccgccgtgccgttccatcagccgccccatgctcgcccgcctaccgccaccgccctctgccacacactcacttgccgccgctctactccaccggccgtcgtgccctcacacgccgcctccgtcgggcgccgctcaaccctgctcgctgccgcccgttgctactcccccgcgtcaaagagaagaaaaaaaagaagaggaaaaagaaaggggaaagacaggatgctccgcatcgccaccgccgccgccgcgttgccagccatcggacctcctctcccgatacaccccgtcggtctcctccccacccgtcggccggcctacgagagaagagtgatagagagagaggaggaagggagagaagaggggaaacagagagatgacgtgacatcctgaaatgtggggctcacgtgggtcctacgctgactcagccgccatgtcggacaaaaccagggtcaaaaccacgaaagaaactattgtgaccggttttgattagttaagggacgccggatttgaggacattttttaactcgatgacaagttctgggaccttcggtgtactgaatccaattttatgttaggggtgaattcatcccaaattcaaaagttctgatattgtcatcgaagaaaaatagcattgtaaacaatacttcaagtgtcgtgtggttctgattatttgatctttacggctcataagccatagaaaataaactaagcaaaaaaaaattatgtgcaaaactttttataacgatttaaaaattcaatgcttaaaaacaaaactacaaggaaaaaacttaatattaaccatttaaattttagctgcaactgctaagacaaccaaatgatgaggcatgatgggtcatgtgaactaccgctttttctttttaaaaagcatctaatataaatgaaatttttataaagaacacttaagaaaatgcgaaaaattatataatatttgactctatttagaaaccgaactcaccactggaagtatgtagcaacaagcaaggagtagcaaaaacatgcgcacaaagttataaaaacttaaacatgggtattaacacgcaattttcgtaaacaaatgatcttcggtgtcaattgacacattgatatgggtgcaaaaaagctttacaaattgatacaagtaacatgtacaaaactttcaaaaaaaaattaacttgagattacaccctggctataaatgatggtagagcaacaaaactataggctaaaaatcatgaccacaaaccaaactgtacatcaatattgttgctttcctcttgacgttacacagtaccttttcctgtacagctcatgtaaacccagctcaatgcccatacaatacagacataggctcatgaacatgctaagaagacagaaggaacaaaattaaaacaaccagctttgtatatgcacatctgaacacctcatgcctttcgatgcttcacaagtgaaacccatttccaccagaggtagacagctgatgaagatatcactgtagcagctatggaaagagcagcaattcctgcaaccactcctcttcgcttttcatcgtgccttgatgtaagcgccacaggaggggggctggcttgcgtctccgcggaagggaatactgagaaagtagagcattttcttgtcagtcaatgtttacctgataaccagaaaaaaggtaatcaagaaaaatagaatatgtactgtgagtctgtaatttacctcttattgctgacaccagaggaccataagttccattgcgtggaatacagcaagtgcctcgcccattccagtagagatgtattttcaacactgaggtggtgacatccgctgtataatttctgttaatgggtctgttggaaccccctgcttccttggaaatgtcaaaatctgtcatgatattccgatcctgcaggtaaccacacatttttgttcatgttttgcccatatggtctggatgtgccatttgttttgctttaagattgttaaacttggagagagagagagagagagagagagagagtgatcagacctgaatgtcgatgttaaataaacgccttcctgatccactttctataactatctctgcaaagaagagttgaactgtatatttcccactaggcaagccaaccacatagtaccataaggaaccagttgatgttcttgccgttctgtagagctcaggtatgtttgttccattgccggtagttacaataccagaagagttactaaaaggatcagtgcccacatgactgactacccaattattattagtgtccacatgaaagtctgctgctccaaggttagcggagtcgtcattgaacatattcgacggatctgaaggaggagtatattgcttgcccccacagttcacagcaaaggatacaggatctgcatttatggtgtgatgatgaataagactcccaaatagactggaatgatctaaagtgaacctttagaagcattgacaaatctccaacagcactataaatatttacatcaaaacggttaattgcagcattatcagcatgtactagtactagtagtcttataggaaagtaaggtatgttcataagtcaatggtcaaagttttttaaacgtactagttaaacctgttgtgttgcatcctttcatgtcgacacaattgaggagacgaaggttttcactgcatgataatagagaaagtaaataatatgttgcatgctattttggctgttcgcatatgaaggttaccaacccaaatagtatgcacggaaaacagagcggtcaattagcatgtgattaattaagtatttgctaattttttttttcaaaaatgaatcaatatgatttttttaagcaactttcgtatagaaactttttgcaaaaaagcgcaccgttttcagtttgaaaagcgtgcgcacgaaaaacgaagcaagagagttgggaacttggagttccaaacacaccctaaagtaatcaagaaacaaaattagtaaattctaatgcatactagaaggaatgcttgtacgttctaaaattatcaagtctgcgttgctgacgctatcagcctacagtcaagtttccaattcacgcattctccttgttaagaattattttacctccccaaatcctctaacacgggttatgcagttctcttaacaaataatatgtcctcaatctcatgaaaaatataaaaaggaatttctaaatgtttgcctcaatctcatgaattgcatagcaaacttgagagcccttcagtcttaaactgtccttaaccagttaaacttatttgattgtttctttaaacaatagcaagaaagagagcaaatataggagcatagtgattaaattattacttgttcgatgatggaagtctatttcaatgagcttatatgagtatgacaacaatatcataaaccatttcaagtgttgcttacctgccaactgagcttcctgcaccaatcgaagttccaatataatttctatgcataaaagacatgttcacaaaataatgagtaaggccactgtaacaatcagttgagtctagtgcttaatacaagtaaatggcatacatccgcatctttctatcagcagaactgctaggaagccttcccctaagcaaaggattatatgtgacatccctgtagttttcaataaaaaggaaaggagaattgttagacaggtttaatatcagattgtactttgtactagggaagaaaatctatcctacttcaacatatgctctgtcgatttttatgatcggtaatataatttatagggtgcacgagaacaaggagagatggtgacacaaatttatactagttcaggccctcgaatgaggtaataccctagtccagttagcgtagattggatctacgaggtgtgtgcaaatcaacaatggagtggctgatggtgggtataatggtgtctaacctctctagggttcctaccgatgccttttatatagtgctagggcatccggcggcatgtatggcgcgatatccataataatccgggtatctaccatctatttacatgggattggatagactttcttatctcttatccctttctatacaaaaatgttgcatgggcctaaggcactcgacccaccctatgcagtacaacccaaaggcctcctctagggcacccgggtaccgtgtcccccacatgctccaccatcaaattaggcactatgagcatgctgaacttgaccacattgcatgaaatgtaaaatggcaaatagagttgcatctaattctgccttctcttttcctcttattagcttgggtgaaggaggattagctgacaaggaaaggatttctcttatcctcttatcagcttgggagaagaaggattagctgacaaggaaaggatttgtgctatattgccgttctttctcatttagtatttgaagacggttgtgtaacagtatgcaccttgacagagtacgaaatattttaagtagtagggattgcttgcaacagtagctgatgaaaatataacatataatagttgcccaggtggaaaaatcgtgccatttgttttccatccatgaagttcacattataaaatgctttttcctacacttcaatcagcaaatgcaaacagcagacttacagagcaactagtgattgaggcatttgatcaggcagagatccattgaaattgttttcacctacataactaacaaataaaaaatcatcagaaaggcagggtaaacaataacttggaaaaataaaaatggaaaagaataaataataatatatgcaccccaatgaccaatagtttattgatttaggcctagttcttttcttcaactccaaatttcaacttcctcattttccgttagcacgcttttcaaactgttaaatgatactttttttaaaaaaaatctatatagaagttgttttaaaaattcaaataaatccattttttaagtttataattatcaatacttaattaatcatgtgttaatgagctttctcgtttcgcgtgcgctaaaaatgtctctcaaacttgaggcaaagaacacagccttagccagattcaaactgataatttgaaataaacatgttagctctcaagatagttagataaaaccttcggtaaaaagaaaaggtaattagataaaactttaaaatgtataaggtttccaaattttgcgcacgaattagagcttagaagctgactctacaacatactgggaattcatattctgaaaagtatagcatggtcaattacaaattcctgaagtgctggtggaagactgaaaatattcgtaagtatagcatgatttcagctctcaattagaaacaatagcttccccagaacacaatcctacagttgaacaaaagtatggcactgcaagaatttcagaagtgacgtgttcagatgacggattaatcacagcattgtgaaacacatcatattctttgaggcaggttcatccctggtggcagtattgtcatcttctcgtgcccctgaaggcctcttactattgtttggacattaaaattacatagttagtgatgataaatcagatattgaagtagatattccaagccagacgagtagacaggcaaaccctggcacaaatgcaaccaagcaaggtctctagaaaacgaagactttcctttttggcaaggatagcaatgaggaaactcggacagcaaagatacattaatttcgccatccatccttaatagtttaaagacaacatgatagtttaaagatgtcgcttgtctatgtcattactgactgaaaggtcatatcccaagatacatgtaaagaaaagctgttgagcgacctggtcaacatgtacaatgggttttaacttgaacttgcaagcactaccaagttccctaacgcaagcatctcatccgaaattaattttcttatttaacaaatcatatttcacgaagaatccaacttacaggtactttaggctactatcgtactgctgaaggtcaattgatcctgacaagttgtttgatctcaaatctctgcaaacataaggcaaattgagagagtaagagagagaaacaggcagagaaggagagaatcatcgcaaataaaaacagtagttatttcaatgttcacattcattgtaatattgaagattaatatcagaatacatggtttattgtattgtaacgtttttttgaacaacaacaaaatcaaataggcataggcttctgcagccaaatttaaagttgttgcctgcaaggtgcattgacagcccacccccctcttttcccaaattgaagtgtttgagattccaattatgtttcggtttgattaacataagatttagtcgttctttgaaactctattagaagatggggtcacgatggttctgagatcaagcaccctcatgctactaagcaacatcacctcacttttttctagaacactcaacatcacctcactgacagcaaagagcacaaaagagggcccctgttcgacatagacaaggattgtggtccccagatggagagtgtgccattgagcataagcaaacaaaagattttctgaaacctacacgtatgttaatttgttcagattcttcagaatttggttaggaaacttccccgtgaatccacaattcctcagagatctgcttagcaaaaacaaagcatgtacttagaacttgtatcaaccaacaacaatcaaaacaaatagtccaatgaaaagaaataaggagtgcgacagttgcaaacgtacaacgttgaaagatttacccaatctcctgtgaaattaaaaggatagccctcggtatcaaggtcaccaatcatgctgcaacagaaggtggttaatgtgattaataatgaaatcagattggtgtgaatttcaacaaatgataatttggttgtcctgactatgggacagataagaagattctctagatgataaggcctaagattaaatacagtattacatcaatatcttccagaatacctttacttgtagtatgacaacacgaaaactaaaagatatttcattgtaacaattgaaattagttatatacaactgcagaagtaagcattttaaaaatttatcagtccaaaaatgaaatttctttttgtcaatgtaaccgtgattatgattacatctacataactctttatatgccactgcaatattaaaaatacaattattcttttgaaactggaggtaattagtcaagtttaggacaagaaatcagtgagctttagatttagagttaactaatgaaaattatgatagcagataattgattattgggtttaaacttgtaggtctcaatacaatcatttggtaattgtacttctggaacagttaagtagtcatttggccttgccaaactgttatagtggcacatacaaatattttccacttttggaataggatcagcatagtctgctatctttggagagcaacacgaacatatccaatttctaccctttataacggtgtacgactgattgtgctgttaataaaacaaacaattaaagtggcttacagattttctatattgatcaatttagagaaattttctggaataggtccttgaagtttcatcccatacattctcctagcaagacaatcatattagttctcaggttggaaagaaaggagttacagaaaaatataaggacaagtagttatgcatacaaatctgtaagattggcaaagttcgcaataaatcctggaaccattccttcgatgtcattatcaaacatccacctgcatagaatgccaataagttaattagtaccccctccgtcccaaaatataagtattttggaccttgatacaatcttcgagatgctactttgactaacaatatctataaaagtaagatgttttaaataaaaaagagttgcatattatgatagtttgtttaatgataaatctaataacatcaattttacatgattgatcatttttatttttttgcttttaatagttaaagtaaaaaatatttgacttacactatgctaaaatgcttatattttgggacggagggagtattacctttttctgaacaaaatacaatgtaatctaattatttttcaaacaggccttgtttgtgatgttgatagtgaaaacaaataaaatgattcttttgtgaaaatggaaatgaaacacacttacagggattgtatacttaaaagtgcagatgcattaggaaaggactcattgagccggttattgttgaagtgcctgtagatttggaggtaaggtcttggtgtctttgccaacaaataatattgaaatagacaacttgagcacaaagaaaaatatgaggcacggagattcttcacatacaatgtaatacttacaatgtaaatatgaagtggataaaccattggatagtttctataattacagacaggtcctaaagtaacacagctagaaaccaaagtagtattgtaccaaaaagggctttgctatcagagacaggcgatgatgctatctcaaacttcaaaggagtatgtctggatatgaaataccttggatttttttctaattttagaacttaatatatttttttataaaaagttaacatcttatttaaaaacaaaccccttggccatgagatgtgtactgctgtggcaaaacagtgctgctacagtgctacaccacccaccatggtggcagcattgtcttgactcttgccatcctatgacattcctcctgattagcagttctttttcatgtgccaactgaagtagtctggagaaaggctccagatttggaaataagttgtgaatgagtttattttaattctttaaaaaaaggttcaaatattaaaaagaaataccttaggtacatgcagatagtttctcgttaagggaataagtattatataaatatgaaagtgtccaaggcattaggcaatactgggaagtcccatggcattcaacaagttggatgtaccattacaagaatgtaacgcaattaagttcttataaaattgatgaatgctgctgcaaaggaacaaaaagttgtttcataatcaccatgtttccagcttggatagattgctgacttggggaggtatttgaccaatcaggttgttattacttaaatccctacagaaagaaaagaggactagttacaatcaaaagttcccttatgtcactctacaagcatctagcagttatatctcaccatactactgcaaaggagtgtcactaaagatgtttgctaccttctaaagccagttggataatatgtaaaagaatggtaaattagttttggatcttagcagtttggttaaaatgttgcataattggatagcacaagtttttaaaaactttcattatattcaaactcacaatgtgagtacatttgacatgcacactggacaaacatcaatcctgtctccaaatcgctattcagtaggttggcaggatatatgcagtatgaaaataaaaaccctctaaatatatgaaagcagcgtcgtgtacatccttttggatgcagaggccgggttttaatccattttctaaaaaaaatgacctatgtataccgaactaccaacatagcatctgaaatgcaagtaaagagcatttgcagtgcagaatagattctcattctcctcagaaaatcatcaatttccaatgcatgtgcacagaacattagattttattccaagtatagggacatcatgcacttcatggcagctaattacaacacagtaacaacttgtcgcttgctacacaaacttgtgtgttgagagctatttgattgtgattattaatctgtaccattaaattataacatggcattacacctataacgggttgttctagtatcaagtgaatatggtacagatgaaagaagtgtctgaagtaagaaactagtgtacgtgaatagtaaggagtaagaagaatgcgtaatagattcttctcatagcaccatttattttactacctctgtttcaatttacttgtcgttctactagtttctcatagaacagcaagtaaattgatacggagggagtataccatacatgtatcgacaggtccacattaggcatggaaacgtcagttatacatattattattttaccccagtaaatactaacaagtaacagccttctgagtaatgattataacaactacaaagcgcatctctatcgaagaaatcatgaacctatcacaagttcacaacagatcaattgtagcatttcctaagataagcagttttacgatatcggataccgatgacaggactcacagagagaccagctccgtcaaactgaagagctccgctgggataaaggtgatgttcctgtagccggtgacgttcctgcatcatccagggtgagaacacccatcatttcatttccttcccccacaaagtgaggcgtcagaaaccaatcgaggatttgaggtgtgcacgcttacaggtgcgtaatgcggcactcgttgctgctgcaagagcagttgatggacgcttccatttccgacgaattagaccagacgagcttcccgcacgggtggtacccctgcggcatggtgccatcctccagtccccacttctcgaacaccgtgtgcagggcggccgctgcggggacgacagagagactcggtcaccacacacacacgcacacatccgcgacgacttcgagctagccaactcatcgcgattagggcatcacatgagcgagtgagaaaaatccgtaccatcagagatgttggtgctgtttctcggcggcgacgacggctggccggactgagcggcggcgatggcgagcgagacgagcaggatgaggagggcgaggggggcggcgggagaagccatgggcggggcggcgtcgggtggagattgacttggtgagggggaggaggaggtggagagtggagacttgaggggtttgggaggttgaccgcgcgtgggttcggcgagacgaggtcgtggggcttggtcgtcggagacggagagagcgggggctccgcgcggcggcgggagacgcggcgcggtggacattttttccagaattgcctcccaacttgtcaacatgagtccccttcgaacacagcaattccaaatgggtattttttaagtatgcaataagggtatgcgtttccaaaaaataataaaaataaaaatagtatgcaattcaaaaaaaaatgtatagacaataagagtgtgatatactccctccgtactcataaagaaagtcgtttaggacagcaacgcagtctccaaaacacaactttgacttcttgtttttataaaaatatttattttatatatatatacttatacttttatgaaagtatttttcaagacaaatctattcatataatttttatattttcaaactcaaaaacttgagagttattcatgatttatattactaaggtttgacttaaatattgtcctaaacgacttcctttataagtatggagggagtatactatacttccttcgttccaaaaaaaaaacaaatcttggctgtgtatatggacaaacatacatgttgtccaaatacataatcaatgtgtgttcatatacatagttaggatttgatttttttttttggatggggagagtacatatttctaacttctactcatctgttttctgtgcgcatacttttcaaactgctaagcaaaatgtttttctaaaattaaatatataagaaaagaatcatattaatccctaacacagcaaagtcagcaattccatatggagtttttagaatgaaatatgctagttcaaaatctttcgaatcaatggagtacaaattcttttgattcagagatgagaagcacaaaagtttcccggataaaatgtgaacagtatttgtgccaatttgtttgattgagtaaagcatacactcaaaggtgtgaagaagcactaggtaatttacggatgctttaagctttataatgttctcagtttgtttgcatgcatactgtaacaagaaggatatggtagcacatctgcacagcgaacaaaattgcttcagggaaagtaaggcactttgcttagaccaaatgttattacatttcacacatttggaccaactcaagcatacacatgttcaagcatacaatggcatagctatcctttatatatttcatattccaggagataccacaggagaatacagattattgtgtaactacagatatcttgtatgatggtttctatctcctcccagggaggatgtgattacagctgcttcttagccagatttctgctttgctcaatagaagggtgaactctttggtactggagtatggcccagacaaggtgcttgaaagagaactccggccaaagagggtctggattctgcaaatgactgaacgtcgtctgccacagaaggaaattgctcaggcgagtctcacctgaggtccggatcacaatgtcaggatcggggcaaccagcgctgtacatatggcggtccagatctgccactgaaatgtctgaatacacaccattattcgcaacactgtcagcatcctccctctgcagtatatccctcctttctgcacagaccttattgaccgcattgacaatctcagaagtggagttgtatggcatgcaaacagagaagaccagtcccgtgttttcagcagtggtagccatcagtttctcagctgctaccctcactgatttgctcaacatgtccaagttcccccagaagttgatcttacagttaaccttgttgatgacatttctgttttctagcagttcattgatcttttcctccattaactccatcaaggatttcacctcagtcggatctcgcttaaaattatcgatgctaaatgcatacaccgtgatatacttcacgcccatttcatagcagtagagcaggctggcaatgagagcagagaagcccaccctgtgaccagagccttcctggatactcctgaatttagcatatctacggttaccatccataataaatgcaatatgcttaggcattgggccatacgagaggacagctacaatgcatttgcggatgaaattctgcagactagcaagaacaccagtcgcaattaactcatcagtgttctccgtctttgaatcctaaaccaaaaaagtaaaactcaagtataagaatatcagcgaatgacacagctaagcacaaaggaaaagtcgcagctctttgattatctttacatgactaataatacctccacctggatacttgttctacataagagatttaactatatatcactgcatatgaatctaaaacataccactgaaggtgagtaagacataagtgagccaagcattttgatggggaggaaccaacaagcagtatcagacctgcaaactggaaaagaaataaaattttcagatttgcttgctcgggtcaagaaaaagaaggggcacgtgtttgccataagaacaggatacattaaaaggctatagattactatctattttaagcatgttttcctgtagggaatactaatttcagaagaatggataccaaaaatgattgatatttaatataagttctctggaaaatacatcaaactctttatatttagcaaagttttagcagggagtatttgatagttaaactgaaaggtatagcctttggatttaccatactatattttgattgacttcacttaaatttcctaacaaagtgagacaaagatgatggctagctatgcagatgttggggctccaatccacgtgtgtatatcgggaagatttcccatcaactgaagttatgatgatgtaatactcatgggataaaggcaaaaatagcatacttttccagagtttggaacacaagacaacaaataaagcacctgcacttctctttcattaacaagataagcacactttttagctatcgaaatccctatgcccttgtaggctaaagaaagctttcacaaaaagggaggaatttctagccagaagcttctaacaacgactagtaataacaagcacaagtgagcaatcaatccagcacaaataacagctggattagcatcaaccaaaccacagccacaccctcggatccgccccacaaaaaaagaaccaacctgagcacatgcacctcctcacaggtattccatcgaacacgtggtgagcaagcaaacgcgagtagcaaatcaagaaccccgaggaggagcaagcggagcgcacagagaatgagagagagagagatccacacctgcgtggctcaggaggcggcggcggctggtgtggtgagtagcagcggtagaggtaggagatcggggtggcgctgtttctttcttccccctttatagccgccgctccgcactcacgcagccaaacaccccagtccacccccagcgagcgcgacggaagaggaggactcggaggaggggggaaagggaaagaccgcgacgcgccgcgccacgaccacgaggcgcctcgcctcgcatccccgtcgcgaagattctctttgtttgggtcttgacgtctcctttttttatgtcgacttgtgtgcctcctggtggctgctggtggtggtggtgctcgccccgcgggcgcgccaccgccactccctcgcctcgcgcccgcgcccgcgcgcgcgccagtgaaaagtactagtaaaaaatactagtggcgaaacgggcggtgtcgcggagagccccccgcgggtgtggagcaggttgggtgggtgcgtctccgcgacggcggcgccaagcttggttcgttcgaccacctcgagctggatttcctttcaggaggcggcgggttgtccgccggctcgtcgtcggggcttggccgatgggagattgcgggggaagaaaggggaattgggccacctaaaactcagcttttccaaggggtgtgtttagatgcgggtaaaactttctatttgctgtcacgtcggatgtttggacgctaatttagagtattaaatatagactaataaaaaaactaattttataaatgagagctaatccgcgagacgaattttttaaacctaattaatctataattataaaaagtttattgtagcatcacattgtcaaatcatgacgtaattaggctcaaaagattcgtctcacgaattagttcaaggttatggtattggttttgtaattagtctatatttaatacttcaaattagtgtcaaaaatccgatgtgacagggacttggaataagtccccgttttccaaacagggcaagtcttgtcatcgagttataaaatcgtcctctaaccgtaaaaccagatatcggacgtctctcaactaacaagatcgttcacttgaggtccttcattagttttgactccggttttgcctaacgtagcggctgagtcagaatatgacccacgtgggccccatatgtcaggatgccaaatcagcatcctctctcttttcctctcttctctccctttcaggatgggaatggttaggatatggatcgaacctaaaccgttttaagtgagttcattgatccattgtttaatagggttaatctatcatgagtccactatatcaatggggtatccatggatatctaaatggatcatctacgttactatagagaaaaaaattcttattacatgtatgtaaaacttgggctcaaaatttttaaactcgcgttcacattataaaaacttatcaaatttaattgaattttgcagagatgatttattatatggagaagcaactttgtacaaattttaagccatctagacatgcgggacccacgatgcattactaagatttaaaaattctagttacatgtgtgtaaaactcggatccaaaattctagttacatggagcaggttgggtgcgtctccgcgacgccaccaagctgggttcattcgaccacctcgagctggatttccttttagggctccggaggaggaggaggcgggcggtggcaggttgtccgccgcaccggctcgtcgtcgagccgaggccaatgatcgattgcggggaagaaaggggatcgggccacctaaaactcaactttttacacagggatttgcaggcaaggagtacctatgcatctttcgaaagatttttatgattatatcacacagatttttattctttggattaaaagccaatagacacagtaaaagataaaaagtaactaagaaacatcataatggacactaaattaccatatcttcaaagaaaaagaccaaatccaatataaatttcaaaacttacatacgaagattcaaaaattacactgtaacttacaaaagttacaatgtaagtttcataaattatattataacatacaagaaaatacactataaatttgagtgagaaaatcgagggacagataagaaaaaaatctttcgagtgagatatagcaaaatcgttgcaggctcatctcatcgcagcccatgcccatctcattgcaggctctcacggcccaactgactcctaactaaaacaaaattatttgacatgtttaagtatacttaattagtttaaatacagatcatgctaagcgcgaggcccactttcacttgcgttagcgaagatttacagttgtttggcaacttcgagttaaagatttacagggtcttggtctcaacagctaatgatgaattgatgatatactatccatcactgttaactgttcagcattcataccggaggatgatgccatgaaaattaaggattactagtacgagtgtcatcctttcagtgcaacaaccaacagaccttccctgactgcacttgacaaacgggggccaatcaaccggctccaaacaagacccatgaatttactacagtatctgctgtccttctttcgcagtgacagaaataattgagagacactaattgctcatctccctccttaattaggattgtcccctgccaccacattcgtatatgtcagatgttctataccctgtcgtatgtacgtccgcctaaacaagggtccgcctaaccttttaatttttcgttttcacttttgtttgtgcgccatgctctattgaaatttagcatatgttacggtcgtaaatatatggtgttcagattgtagctaaaataaaccttaccaaaataattttagcaggatttcttatgtatttatcaatttaacaacaagctaaacgtaactattcttttagcaactttaccatggttaaaaatgacaccgaagtaaacagcccctttatcatttgagacatcgatcagtgttttggagtttcttccttccaacattgcaatgtcttaacagatcagtggtgtactagtacaaaactccaagtcgcggtttacaacaaaagaaaaaaaatagacgtttaaccctttttctttaccacaaggaatactccatccatctcataataagtttattttgtaacggagtttataaaaatagagaataattgtatttggtgtagataaagtgctgaaacagttacattgggattttacaaagtagagatattctatttattttaattttgtattggtagatataaaacgagtgaaaaataaatttattttggaacgggtggtatcttgcaagcatcgggctgccggaaccaggccggcccgagctcagcgaggccgagaaagcaatcgaacacggccaatcctcccctttcccctcgcacaccacaccgcggcaccgcgcgcgtcaccggcctcgctcgcggcgcgtcacgctgctcgtgcgtgcggccaccactaccaccgccgcgatcgctttcgcgcgcacacacacgcaacgcaccaagagtccgagactgcgcgacagggcgagcgaggggggaaaatggcgtgatctgcagcaaaacgagaggggaaaacgcaggaaaacgagcgggcgacgcaggattctgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgacataacctaatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaatccatgtttcgacagttggcgcgccaggtaggggttgcgtcgagtttcctatcaacaagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcgtactgatttttaatcctagattaatctcttgctattttttgttgttgttcgcatataattacgcggcactattgaggcgattgatgctggtcatggactcgaggcgtctcagctttccggtcgatcggccgcaagtccactctgccggcttgtcttcgccaccgccattgctgataacaacaacgacttcaccgccggcctgcctccgtcgccgccgagtggtgcctccgcctacacggctggcctattatgccgccgctgttgggcgtctacgacttcaccaccggcctgcctccgtcgccgccgattggtgtttccgcctacacggctggcctattatgccgccgctgttgggcgtccacgtcttcaccgaccggcttgcctttaccgctgccgattggtgtttccgcctgcacggctggcctttatgccgccgttgttgggcgtctacgtcttcaccgaccggcttgccttcgccgctgccgactggtgtttccgcctgcacggctggcctttatgccgccgttattgggcgtctacgtcttcaccgaccggccgcctcgtccgccgccgactggtgcttccgtctgcacggctggcctttatgccgccgttgttgggcgtctacgtcttcaccgaccggcttgcctccgtcgccgccgactggtgcctccgcctgcacggctggccattatgccgccgctgttgggcgtctacgacttcaccgccggcctgcctccgtcgccgccgattggtgcctccgcctacacggctggcctattatgccgccgctgttgggcgtctacgacttcaccatcggcttgccttcgccgctgccgactggtgtttccgcctgcacggctggcctttatgccgccgttgttgggcgtctacgtcttcaccgactggcttgccttcgccgctgccgactggtgtttccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacgactttgttcccatattggccacttctgccatcaccaaggggaatattacaaagctaagtcatcatttattttattctttatatgatattttgccttttcctctgcctcactacaccaattggtcttccattgagtagtgagtcgggggctacagatgttatatcgtattttttaaacaattttcataatatttatcttgattgcttgcgacataatctgagtacaaaagtacctatcgagttatggagttctatcttcctatgctttctgttcggtttgccaatggatggttgcctttgggccgattcctagcacccgggggctcgttggatggaccgaataacgcaaggtgctaagtattattcagaataaatcaaaagcatagagataagataatttattttctgctcttaataattgcaaaagtacccgagtagtaaactccgatccgtgaaactttgttccattaatgacgaactcatgacactcatatgcatgtttgggaagtgcttaggccgactcccagtgcttggtggctatgactagtcgggcagagtgcttaaacgtaatgagtcatctgttcggggaaatcaaaattgacaagaggagaaatacatatttataaatattttaaactgcttgaatttttctcgagtattatatttatatcagatactactcatcctatatgtttgttctgcaggatccagatccagatatgcataaaagggattcatggctttaagcttatctcttacgctccaggaatggatcagtcagaacaccaccaccggctcgcctcgaccgccgccgactggtgttcccgcctgcacggctggcctattatgccgccgttgttgggcgtctacgtcttcaccgaccggcttgccttcgccgctgccgactggtgtttccgcctgcacggctggcctattatgccgccgttgttgggcgtctacgtcttcaccgaccggcttgcattcgccgccgccgactggtgtttccgcctgcacggctggcctattatgccgccgttgttgggcgtctacgtcttcaccgaccggcttgccttcgccgccgccgactggtgtttccgcctgcacggctagcctattatgccgccgttgttgggcgtctacgtcttcactgaccggcttgccttcgccgccgccgactggtgtttccgcctgcacggctggcctttatgccgctgttgttaggcgtctacgtcttcaccgaccggcttgcctttgccgctgccgactggtgtttccgcctgcacggctggcctttatgccgccgttgttgggcgtctacgtcttca

SEQ ID NO: 61481 - DNA, 883 bp, Oryza sativa
  unsure (1)..(883): unsure at all n locations
ccgttcccacaagtattcataataaatgccaggaaactgggtgtgccctcacacgtcttttttgaccccaaaaacagatacttggctttataccgactgtataagccggtagtttccctccccaagccaatgttccagtacaaccaaggccttaaaccagaatattgttccaacccttgtcaaaactgttggttggctgaaaagaatagtacttactttcaggagcccatcagcaaacaagcgctccttcaactttctatctgatcgaatcattccagcattatgaatcccaaaaccagattcaaaaaaattctgcaacttcacgacttttggttttgctaccatctttctgcagccaaaagactagttgaatcataactagtagattcaaattaacgctacagataaaggtaacaacataccttgattaatgcatattggggatggtcagcacatgaaaataactccaattctcctgcatttgcagctaggtcgatctgcatagcatgtgaaaagaattagaaaccagaatactcaaatgaataaattatataaacacagcatatttggtactacaaaaacatgagtccagaatcacttgctacaaacaatcttcaataaggaagaacttaagagcatgcattctaacacttgataaatagtaatatccatttggattcatggcttgtaatgtaacatgtaaattattcttttaattatnnttnnnatagggtgcatagcagaatgtncaatcaatcactgnggggggnggnaagnaaagatnnanatacaaataaaagatgncnnnttcgaaggaagatgggaagacgtgtgangagtaaananaacattagtattagaataatccataaacacagtctcg

SEQ ID NO: 61482 - DNA, 7819 bp, Oryza sativa
ggtacagtagttcatgagtggtagatatctaagctaatctaatctagcaacacgatttagcagataccggcagaaaccctaaagcgagaagcagccgatagagctaaattgatatgataagactagattaacagagacatatgataaataggtaggtaaatatatcatccaaaccgtagcaatccaagaggtcgaatatactgatgcagccttgaacgacgccgacgtagatgacaaattcaccggggcccgacggaacgtaggacttaccccttcgccagagatcgaactgaactgatgcagccccgcgtcaggtgcccaaattccgccggaagataagtaaaaacctcagggaagagggtggcgatgtgccgagagtagttgtattgatcgtgattgatagattacatagaccccgggtgtatatatttatacccatagggagatacaagtccttgtcggacaagaaagaaactaaaaaggaaaagataacgtccttatcggacactaaacacactttccaaaagataaaaagaaactaataaactatgtctaattaatagataaactgtcatgtcgcatccgtcttgaactcggactcttctagataagcttcctttgattgatccgactccaccatgaacacgacatcgtggcgacttgactcccatcggctgattctagaactttgaagccgatactgactctaagccgatggtaactttgggcttaccaaatttcactgttaacacatgccccccagttttggagtacgagaactcatgctttaaaatttcttgtcttgataactccaaaaccgatcttcctttgcttcgtgcaatcggctttcatgagccgatattgtttgcattagttgagctagactgtcaaactcgtggcaaaagaatctatctccgataggtgctgacaatccttggaatgcaagatctactagctattcattgcttaggttcaaactataacatcggctgcggacattacgaaatctctgaatatattccatagccgattctccttcttgctgctcaactgatattaagtctgaaagcttcaactcgctgactccagcaaagaagtagtcatgaaattacttctcaagatcggcccatcctctgatagaatttgatggtaatgatgaaaaccaagtgaaagccgatccagtcaaagacaatggaaaaaacctaactttcagagcctctttagtcgatgcttcaccacattgcagtaagaatcggctgatgtgttcaagtgtagatgtatcatcttgccctgaaaacatggagaaatctggaatcttgtatcggtgtggaagtggaactctatcgaaccattcaggatatggctgccgatacatatggatccgttccttaggtctaattccaaactgctcctctactaattttgcaattctatcggcccaatcttacttctggccgatactgttgatatagctcatcattgtgacattgatgtgtctgccccctgagccgatgctgttgttgttcttcaatctgctccccgagctggcttttctgaataactaacccatcaactgttactttgatcaaattttgtaatgtatccgccaaaactccagattgattaaacaatgtgcaatgaactgcttcatcaactgtatcttgaagtatttcaactatcggcttgggaaattgagtcttctgagttggcccttctggtgtcatgatgaaacattgaagacaacgcatttgaaaatcagctacaaactgcttcatctgttgcctttgttcctctgttaaattctacactgtgaccatgatcttggcattgacttctacttcagacatgtggatataaaattcgtggtcccactgggcgtgccaaaagcgtattgacgtaaaaatcgaacacgacggcctgggagatctgcttagctcctgtgcaggaccaaatatgatgagatgtgggcatgccagtcagtttgatcctgccactgacaagatatgcaaacagtagatcaaacagccgatcggctgacaagccgatggagtagttccagccgatagccgataatagccgatgccgataccagccgatagcgataggatttaagcgatcggctatatgtccaatgtagataatgatataaaggcagtcggctgatgataatataatatagcaatataatccagtagaaaaccaatcggctaataatatgatatagtagaacaagtattgatccaaaggttaaagcatacatcggctggggatccgatgtcaggaaatccacaagattagattaaacagtgaaacctttgttgtcatcggctaaatccaacttatatgtatatgcgatctttatgagccgatgcaacgtccagataactcactggctgaaaccccgatgaaacccttattggcaatcaagaagcaggctagagattatggttctaagcacgacttagtagatcaaacttaactgatgcagcactaagtatgaaaagaaacataatatctagacaatcaagccgttgactgattttcagggtggtagatatctaagctaatctaatctagtaacacgatttagccgataccggcagaaaccctaaagcgagaagcagccgatagagctaaattgatatggtaagactagattaacagagacatatgataaataggtaggtaaatatatcatccaaaccgtagcaatccaagaggtcgaatatactgatgcagccttgaacgacgccgacgtagatgacaaattcaccagggcccgacggaacgtaggacttaccccttcgccggagatcgaactgaaccgatgcagccccgcgtcaggtgcccaaattccgccggaagataagtaaaaacctcagggaagagggtggcgatgtgccgagagtagttgtattgatcgtgattgatagattacatagaccccgggtgtatatatttatacccatagggagatacaagtccttgtcggactagaaagaaattaaaaaggaaccagtccttgtcggacaagaaagaaactaaaaaggaaaagataaagtccttatcggacactaaacacactttcctaaagataaaaggaaactaacaaactatgtctaattaatagataaactgtcatgtcgcatccgtcttgaactcggactcttctagataagcttcctttgattgatccgactccaccatgaacacgacatcgtggcgacttgactcccatcggctgattctagaactttgaagctgatactgactttgggcttaccaaatttcactgttaacagctagtcagtaaaataaaaaataaaaataatatgtgggtgttaacgaccaaatttggttttctatcaacagtggggcccacatgtaagtgaagtgagaatgaaaaagtggggcatgcctatggggcccatcatcttagaggttttggctgcgtagacctagcgcatcgaggaggagccgtcgtcctcgccgtcagggaagcgggcctgggaggctgccggcggtagagggtggagtggtggcgggcgagcttggcaacaacagcagctcgccgctagcagcagcagtcggccgcctctcccactcccaccctctccacgtgccgcgccagcgggagggggagagaccggggacggtggaggaggaggaggagcgccgaggcgccaacagcagtagccagtcaccactcctctcccccctctccctcctaggcgccagcatgaggacggcaccaccaccgtcatcatcctcaccggatccctcctccgccgcacctagtccctcctctccgctggcgcccaccccaccacggccgctgacaccctccacctgcaagaatgaaccatcatcgattgacgacgacggagaggagggagtggagggaggcacataggagacgaggggagcgccgcaacggcggggatggaggggtcgcccaccacgtggtccaggcgcagccgtgcagggatgcgtcctccggcgtcagaggctgcatcgccgccttcccttccagcattgcgttgccgctgagttggtattggtttcacgcgcacgtggcggtgtgggagatttggggtgatttcacggggggagaggcgagggcgtggtggaggaggagacgaccggggagtgaagcaacgcgccgtgcatgagaaggatcgcatggcagccccgtgcactcgccacggagcccgtcgaatgcacctgcaagactgcaacctagctcactcgccagtagagcctcgtcgtgagcctgtgatgcccacctgtcaccgagaagaagaccaaagcggcggcgacgcatccccaaccctaggacatttaattatctggcacactttaagatgtgccaattaatgatttgccacttactatgggtgcagtgacaaatcttttataaccactcgtaaaagtggcaaatagttaattattcccccaaccccagtgtgggaatgtcgttgcacttcagtacaccccttaatcgttaacgaagtcaacaaacaagaagaataacatgtttgatgacgtgctgctatcgattttgtcatcctgttctgtttctgggtcccacaatttttaaaatttccttttggtaacaactccctccgtctcattatataagggatttagactttttgcatgcactgtttgaccattcgtcttattcaaaaaatttggaattattatttattttatttgtaacttcattatttaaagtattttaagcataattttttgttttttatatttgcacaatgtttttaataagtgtggagattatggataccccatacacacacggcatgtatatccgactgggtatggggtaccatgtataaatagaatatctttaaagggtttcgggttaaattcctaaacttgtatatcaaggaagcacccgagattttagtcggttacgattgtattttatctataactgcttattccgttaggaatataggctgtactttgtaatacggactccttcccctatataaggagtggtccgggtgcctcttggggcacgatttttctcccagatcatacgatcaataatacactcggcggatcaatccccagacaggagtagggtagtacttcttattaagaaggcttgaacctgtataaaattcattgtctctaaacccatctactttttcagcttgatagctacccccatttagtattgccgaaatcttgtttcgacaattggcgtgccaggtaggggtagcgtcaagttcttcgccgactagtgtgatgggtttcgtctctggcatcgacgccttcatcttccctcctgggcaggcgtttcggttcggcagcctcaacttcatcaccaacgacttcagcaagatttgtctccttgactcggatgcgaaccagtcaggaagaggccaagtatctgccccgttcggtatcccgaactcggccgagatctactccaagattttctcaaccgagtcggcttcaaaccactcggacgagatgcaatctactccgacacgacgtgatcaaggcgacggagcatatccctcaatcccgatgaagctccccgatgatttggccgttgttttcaccacaagggcgtcttctccccgtaggcctagacgagatccggcctcggccccgatccgatctagctctagggaagttggtgtcatactccagcctctcgaaacggtttcaacggaagaattggactgctatcttagctcccccggtgtcgattctcgaccgacggagatcctcgagtacgacgacttcggctaccattacgactacagcaacctcgacgacttcgacgaaggctacgaagacaactacacgcctctcttcttcggcattttcatggctgataatgagacggcagaacagcgtcaagctcgagaagcagaagaacagcatacacgacaagaagccgagggccgccgactggaggaggagcgactagcacaggagcaagactggctgcagtgtgagcaacaggagcgcgaatgggccgcaaaggaagctgaggactggcgacagcgcgccttggaagctgggcgacgagcacgagatcttatcggacaacaagacattgaagggacggcggtttttcgcaccccgcagcataacgtggtagccgcaatcacccttctagacactctacttcagcaagatgcgcccaaccacgtcgtcaacatcttaaaccagaccaagaccatgatcaccgcctcggtcccagtaaattcttcaagcgtccgtacgctgactggcagcagagttccacctctttgatctcaagactatcaccaaccaagccttagtattgccagtgcaggatctagtcgcaggagcagatcatgatgaacgatctgtttgttcacctgccgatcgacatagggagcgtcgggccgagcagccccgctctccgcgtcgcaggcgtctcgtcgatcttcacgatactatcaaccagcgtcgtgcgacaagaggccacatcccccaccattcaccagatcgttaagactaagggtatccgccatgaactcttagtcggcaagtttggacgcaagcctcccaagacagtcaaacagatgttcgaaaaagccaatgagtacgccaaagcagaagacgccgttactgcttccaagcagttgggcagcacctggaagccaaagaaagatgcgccgactatagggggaagtggaagtgccaatcacaaggatcgcaagcgtaagccagaggaacttgtggcaactactacgccatcctcccgacagcggtcacgcgtcaacaccttcgacaagatcatgaatgcacaatgcccacatcatccgaactcaaatcacgtagccaaagattgcttcgtctataaacagttcgcagaacaatatgccaagaacacacgcaagccgactgacggagatcaaagcacgtcgaagaagaaggatgatgaagatgataccccgactggttttcaagactctcgtaaggaacttaatcacattttttgtgggcccctggcttacgagtccaagcgaaagcaaaagctgactgaacgagagatcaacgccgcccagcccgacacgcctcaatatcttctgtggtcagagacggctatcaagtttgaccgctcggatcatcccgaccgagtggtccacccggggcggtacctcctggtactagacccagtggttcataacgtcacgctccgacgatccctcattgatggcggcagtgcactcaatatcctcttcgccaagactttggacgatatgcagatccctcggactgagttgaagccaagtagtgcgccctttcacggagtcatccccgggctatcttctactccactcggccagatcactttgccggttaccttcggcactcgagagaactttcgcacagagaacatttgcttcgaagttgcagatttcgagatagcgtaccacgctatactcttacgcccgacgttagccaagtttatggctgtcccacactataccttgtcacgcccagaaatttagcccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaacttaactggggtctgagccttggtcctctaactccatcttcagctcagaagcgctacacttctgaaaagggggaataatagcaag

SEQ ID NO: 61483 - DNA, 2780 bp, Oryza sativa
ttctattatgattcagtgttttttttcttaaatgaagtgtgatatactgtctaaagtctgaactaccaagtttgaaatttttttacaagacacatgttttataattttgtgtgcattgtacaaaatcttgacctatttttttgcttggtcacaggaaaagatggctggtggctttagggtattgcatcttgtcaggccttttctggctttcctgcctgaagtacagagtgctgataggaaaataccatttagagaaaaagtgatctacactgttatttccctattcattttcctggtatgcagccagctaccactgtatggcatccattcaactactggagctgatcctttctactggatgcgtgttatccttgcatcaaaccgtggtactgttatggagctgggtatcactccaattgtgacatctggcatggtaatgcaacttctagtgggatcaaagatcattgaagttgacaacagtgtgagagaggatcgtgctctgctgtaagtattatgagattaacactatgttctttactattacctgaaccttgaaacttagtgccttatttactatggtctgctgtttgtagcccaccatatttcagcgaatggctattgattaaatgctactacgtatctgattcatgtttaccatgtcttttgattatatttgttacgctaatgtacttttttacccaggaatggcgcacaaaagttacttggtatcctgattgcaattggggaagctgtggcatatgttttgtctggaatgtatggcagtgtaagccagcttggaactggaaatgccatcctcattatacttcagcttttctttgctggcatcattgtcatctgtctggatgaacttctccagaaaggttatggtttgggttctggcatttctctctttattgctaccaatatctggtgagcacattgaactttgttcttctctattgttgacattttctattcaacttgacttatggaaatctttctctgtagtgagaatatcatctggaaggcatttagccccacaactatcaacagtggccgtggtgctgagttcgagggggctgtcattgcattgttccatctgttgattactagaaccgacaaagtccgtgccttgcgcgaggctttctaccgccagaatcttccaaatgtgaccaacttgcttgctactgttttagtcttcctcatagttatctacttccaaggcttccgtgttgtgctaccagtgagatccaagaatgcccgcggtcaacaaggctcatacccaattaagctgttctacacttcaaacatgcccatcattctgcattctgcactgattaccaacctctatttcatatcccaggtctgaacttcaattccactgctttagcaagataaatctttaatgtttgtgtttagcattaacatgtttgtattgctttggcagcttctctacaggaggtacagtggaaatttcctagtcaaccttattgggaaatggaaggaatctgagtactctggccattctgttcctgttggtggtcttgcttactatgtaactgctccatcaaggtgaagaatcaatttcatcaatgaggccttcatctctttgtgctcgcaattttagtttctgttactgtttgataaaatttacttttaattatacttaccttggcatatgcactggaaatgttgcagtttagctgatgttctcgcaaatccattccatgcactgttctatgtggtcttcatgctgtcagcttgtgctctcttctcaaagacatggattgaagtatctggttcatcagcaaaggatgttgctaaacagctcaaggtaaaataaaacaaaactattttctatatctggtctggaatgcagaattatcatgcaagagctacctttaaaccaccaacctttgcaatttaacaggagcaacaaatggtgatgccaggccatcgtgagtcgaatttacagaaagaattgaacagatacatccctacagctgctgcatttggtggagtctgcattggtgcattgactgtcctagctgatttcatgggtgcaattggttcaggaactgggatactgctcgctgttacaatcatctaccagtattttgagacattcgagaaagaaagggctaccgagctaggtttctttgggttttgatcaccttagctgtataactcctagctggaacttcttgcgagtcgcagtgctgcttggccggctgtcatgtaatgggagacctcagaatcagcttaggttgccgacttacttacaatgagaatcttgtagcagtatgcgttttgttcatgccagcgtatggagttatttgtcctgctcctgcccccagtacagcaatggccatcgtagtaactggatgtgttgcgatcaatttttattatcttttaaactggataggatatttgattcctgatctcttttttgctgaaaccttcgtgactaatgtttctgatcactggaaactaatctggtgttatgtctccctgctgcttcttttattgcaagtgtttggccacatggataaaatgttaactttcaaaagacattctcattttttagcatgggttatcggtaaacttttgagactggtgactattccccttactaaaaaaaatcatattaatattataatttattccttacattcccaaatatttccccagatgtaagaacctaccaccctgatgaacttatcaggaattgcctggagtcttgaccaaattaaaatttatattgcttgggacaagttcca

SEQ ID NO: 61484 - DNA, 2056 bp, Oryza sativa
attaaggaggtgacaatccttcgttaagttctcaaagaaaaaacaatccttcattaagctagcatttgtgggctaatagcaaccataataaaattagtacataatctttcataggctgctagcaaccatcaagaaagggtgcatccaggagcagtgccagagtctgctttcattgctactaataggagagaaggggttcaaccaccactaaccacatcaacaaaagagggcagggccacattgaggaagagaagtgcagcacccaagaagaaaaactctcccaagaaaaagaaacagtagtttatactatgcactcagttatgcatttagttttcgttcaagttattcactgaattttattcaggatctcagtttctgttcaaaatatgcactcagaagtttcattgtgttcagattttgtcacaatgtgtacaattaagcattacattccttgctgcttcagtggatttaatgttcatgcggttaatctgacggcacaatggcttaattccttgctgcttcaatgtctgcactgaagcattggagctaggcttcaaagttgctatatgaattgtcagtctgagataaccgatgttggcctaaagcaaggcactcatatgcctaccgcagcatcaaaataaactaaaacttgattactgttgcagccaccaccgccagacttgacctacccgttgcagcaaccgtcggactcgactcccccaacggcgtagctgtcgggctcgacctccccgctgctactgccaccaaactcgacccccacatcgctgcagccaccacgcgtggattcgacctccccggctccccgccgctatgaacacctctcagattcttttcaccgagaaattatacatgatctaaataccaaataatagaaggggttttctgataaaaaagggccattgcatatgagcagcagagcatgcaagtttgtcctccttacgtgaatacgtgaatgcttagttggcggtctactcatcatccaactcagcaaaattagttttgctattctatttagtcatagttcgcacgcacctatacaagtttgtgcatcaaaataaaagttttacaagtttttacactaaattgcacacacattacaagtttgtgtaccgtgagcgcaatttactctatatttaatatctatgaattagaggtgcaaatagatatcagtttccaaatccgattcgaagaaataatatgggataggatacgggatgagtgatatattattcggcactacctgtacccaactccgaatttaaaggaaaatatgggttaggatatgagaatgccataatccgaccctagccacccgtttctctattttttacttaaaaagtctggtggcggtgaagccagcactgacagacacacataatatggaccatccgattgccagatccaacggttcggatcgataagcagacgcacgtttctctccgcatctgcgcatctaatctcctccgcatcgggcggcacctctcgtcacaacgtaacccaccgccggctctctcccttccgcgaatccctccgctctccaccgtgccccgccgcaatacgcttcgtccccatgtagccaatccctcgcgcaatcactcgtcgtcaggtcgccgtcatctcgctccggaggcgccgctgcgcccccacgccgccgatccctcgccactaggtcaccgttgtgccgcgtcaccagtggcaccctcaggcaccgctgtctgatctccatcgacgaccaccacatctcgcctccgtctgcgctcctccagccggccgatcttgcctccatatgtgccgtcgcaaaggtctcttctgctataaataattttcatatttgctttccagcatgtggaattgacaggagttatatgtatataggatctagctaacgcttgagaagggaggatatcaagatcttgctggcgtaagaaaccgatgttgatgaacaggtcatgcttcactgcccaattctgctctatcattgaggattttgacacttttttacccacctcgacaccatatcctttccaaactacat

SEQ ID NO: 61485 - DNA, 9474 bp, Oryza sativa
  unsure (1)..(9474): unsure at all n locations
ctgcgttgatgacctcctcttgctgcctgcacgncgactctagaggatccctgagccttttactaagattcctcagacagctacagcatgaagataaaggacttaatcagctagtttccacatcaaatcagctagcaagaaatatcattgcacttttaattaactagggagtaaaagagtgtttcggatgttggagcaaccaagcaagacaaaagttttgaccttggagaccataagtgacaaatgtttttccccactctgaaacaatcaatctacgagcagatttgtattctttcacatagaaaaggcaatacataacaatctaaaaatccttacagatccttatgtatgtcagcagaaaattttaagatcaagaaattgaagacgtgtttcttacagctcggtgacaactctgtaatctccttgctgagaacaggtcacaccagaccaggggggcagatcaccatgcccgcaagggtcatcaccaacccatgagtagacaactctccatcctaacgaagatttgatctcattcaatgctttcactgcagcataaaaaattgttttctttcagtcggttccaacattctacgaaccatgaaattactcaatggccgccaaacattgttaagtcagactaatatccatgtctctatgaagagataaacctctccacctgatgcagtgtcagtcagtgtggagcctaattagtatacagctaggaaatggcaaaactagatagtcacatgtatacaatcacagagtaatttagacatctaagacacaagccaacaacagatcccaatgctacacaccccaaatgaggcagctaaccgatcgagcaggtgcccaattcacagccatgagcataaaagaatgcaaggcaccagatggtcagatctccagcagggaacggccaaagaaaccaaatctttcccaaattccatgtcgcggaatcgcgcatcacgagaccagtatcactcgctcaattcacgggggggaaagaaaaaaaaaagaagtgcagagaaggatgagcggagcagccagctacgtaccgtccctcttgaccgtcttgccgcttgcgacgccggccaggacgaggaggaggaggaggagaaagagcgggcggacgggcaagaaccggggggcggcggcggcggcggccatggacgtgtggggaagctgcggctccgcgctaggatggacagtagcggggcgcgccgcgggagaccatatgagagagagagagagagaagaggagagggggaaggtggcgccgcggcgggggcggggttggggatggaagtgcgggagaggggagtggagtggagtggagtgggcggatgggcactcgcactccccccgcacagccgcacgcacactgactcgctgcctgccgcgtcggtgggttggccggttgggcgccgcgcaccgggactgcgacgactggaacgtggagtgtcgccgaaccggagcggaatacagtattttactccatccatcgaaaaaaaataaaccatgacttttcatgtaacgtttgactgtctgtattatatgaatttttttataattaatatttttattgttgttagaagataaagcatgattaattctttatgcgtgacttgtctttttaattttttcataatttttttcaaataagactgatggtcaaacgttgggcacggaaactcagggtttgtctttttttttagacggagggagtaggtatgtggtagagctctaacccctaaatttagctttataatgtgggtttagagtggagttgtggagcagtcgaaacctagctccacttctcagttcattttgtgagagtgctccacccagctccgctcccattttagctagagtttaaattgtttggctgggctccagagctgaaacggtgccaaacaaggctgaactatagaggtggagctggatttaagctgttccacaactctgctttagatctaactcctaaagctaaatttatgtgttggaattctactaaacagtctcatatacatttaacatgttaatctaatcatacaccaatttacttgtgtgcttcatttatacttttaaataaaaatttagagtggaaactattatcattttttttcaaatacaataaatctcaccacaatatgtggatattgtaaatcttgaggtaaatactatgtgctgtaagttacactagaaaataaaattgtgtttcctaaaaaaataaaatgaaaataaaattatctaaaaggaaaacgataacaaaagtattattaataagctctgttaaatacttcatctgtttcacattatacgacgttttagattgtcgatagattcatacacgaatccatgtacatattcatatgtatacagtatgggacgggctaactagctaacgtgccaaagaccgcaccaatttcttttttattagggccaattccctatatgcccatataatttcacccaatcccttctacgcccctgaaatttgtttgatatcttatatacccctgagtttttatttggatcccttacatacccattccgttagttgaccattagtttgaccgttagttattgtagaaattactttattgtccttgttatattgttaaaagctagaaatgttttatgtgtaaattttttgagttgtgaaaaccaataaggaataaattactaaatatttgttatgaatttttgaaaataaaacattatttcattaaaataaaaaaagatttattgtaaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctggtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaagggattgagtaaattttcaggggtatatagggaattttctctttttattagcacatggacgggcaactagcgactagcgagcacgtcaaatttgcacaggcaactcttggaagacggttgatctcgcaaggtaacaacgactaatgtgtacagcgtactacagataatcatgagtttgtattgaacattttgacattattgtaaagtatggtttgtcaacggtttgtttaacttttgacctagttaacgtgaaaacggttatctgtcgcgattgtcaggatttacgtgggccgcattgggggcgggctaacgagcaggccagcttcgctatctccggccggccgggccacccgaagccgactcgaggggcataggcccaccacaattcgcacctagcttttttttttttcgttgcagcaaaaggttttctgaatctactgaatttatctagtcacatatttcctcccttttttaatatgtaatgttgttgttgttttagatacgtataatcatttgtcatattaaaaagtttatgtaattattattcattttattgcgacttgatttatgctaaaatgttttttaagtgtggcatatttttttatatttacataaaaaatttaactaagacaaatggtcaaacatttgtcagaaagttaatggtatcaagtatttaaaaaactaaggtagtaactgaaatatagagagtgtgatctgtagcaaaagtgatcagtactacaactgtttggaaatgtaatcaaacagcgttgatgaaatactgaagctggctttgatcattgcaaacgctaacagaatgctatagcagaacgcaacccttctcatgttgttggtaagagccaagaaatgcgttaggcatgtcctgctgcttaacaacttaaattaattgattacataaaaacgttaactcatccaggtatagcaaagtattattgaaagggattaccaatgtaaatattaaaattgtaatataattatagtgtaacttacacataactataatataatttgtttaacacattatttccactaaaggagtacacgtgaccaaattgcatcacccgtggttgcgctatgattttttcctttcccgcttgcagagtcttaaagtaaatataccagattaaaaatacataaaaagttacatacatattatattataattacatacaagttataatattttttgaacgactcgcataagacggtgcgaagttctattgatagagcagaagaaaaattataagattacaaccctggaagttgtaactaggaaaaagggaaaaatataccaccacccacacaccgacaacgccaaaacactgaacaaggagaaggctagcaccggaccggccaccactaaccgtggccgacctccgctaggccaacaaagaaaacacggtcgggatcgcccaaaacccaactcttacaatcaacacaaagccccgctctatccaagtattcaggagttaaggagagagggtgagagagaagaatggaactcctctccccttaggccctccgacatggccagcttgtagagactagttaggatgccgccacaagaggatgtaatctagagtgagtttgtactaattggttgggtggttttagctaggggatgcctaaacgatggatcatagcaaaaccgttacttgaatactgaagctacctttgaatctttgatcatggcaaaagcttaacagaaggctagagcaggatacaaccctttcgtgctgttacctgtcggtacgagccaacttagccaagaaatgccataagcatgtcatgttgtttaacgaattcactagcttagtagtagcttaattaactgcctaaaagataaaaaggctaataaaacggttaactcattcggagacaaactcgtactgcaaagcctacgtgaaaatcgcgtttcccgcgctctcgtggcgcaccttctttgtctgtacaagaagtctattatataccccccatcctggccaagaccacaccttgccgtcgccaccaccttcctcgccgccggcagccgagcgggtcggtgccgccatgcaatcgccagagaatgcggcaccgcgcgtgtactttatcccgttcccgacgccggggcacgcgctgccgatgtgcgacctcgcgcgccttttcgcgtcccgcggggccgacgcgacgctcgtcctcacgcgcgccaacgccgccaggctcgggggtgccgtcgcccgcgccgccgccggggatcacggatccgcgttcacgcgctcgccctgcccgccgaggccgcggggctcacgggcggccacgagagcgccgacgacctccccagccgcgagctcgcggggcccttcgccgtcgccgtcgacctcctcgcgccgctcttcgccgacctcctgcggcgcagacccgccgacgccggggtgttcgacggcgtcctcccgtgggctgccaccgcgggggccgagctccgcgtcccgcggtacgcgttcacggggacggggtgcttcgcgctctcggtgcagcgagcactgctgctccacgccccgcaagacggcgtcgcgtcggacgacgagccgttcctcgtgccgggcctccccgacgcggtgcggctcaccaagtcgaggctcgccgaggcgacccttcccggcgcgcactcgcgggagttcttgaaccgaatgttcgacggcgagcgcgccacgacggggtgggtggtcaactccttcgccgacctagagcagaggtacatcgagcactacgagaaggagacggggaagcccgtgttcgccgtcgggccggtctgcctcgtcaacggcgacggcgacgacgtcatggagcgcgggcgcggcggggaaccgtgcgcccccacggacgccgcgcgcgcgctggcgtggctcgacgcgaagcccgcgcggtcggtggtgtacgtctgcttcggcagcctcacccggttcccggacgagcaggtcgcggagctcggcgcggggctcgcgggctccggcgtgaacttcgtgtgggtcgtcgggggcaagaacgcgtcggcggcgccgctgctcccggacgtcgtgcacgccgccgtgtcgtccggccgcggccacgtgatcgcggggtgggcgccgcaggtggcggtgctgaggcacgcggcggtgggcgcgttcgtgacgcactgcgggtggggcgcggtgacggaggcggcggcggccggggtgccggtgctggcgtggccggtgttcgcggagcagttctacaacgaggcgctggtggtcgggctcgccggcacgggcgccggcgtcggcgcggagagggggtacgtgtggggaggcgaggagtccggcggggtggtggtgtgcagggagaaggtggcggagagggtgcgcgccgccatggctgacgaggcgatgcggcggcgggcggaggaggtcggcgagcgcgcgcgccgcgccgtcgaggtgggcgggtcgtcgtacgacgccgtcggcgcgctgctggaggatgtgcggcgccgggagatggcggcggatccacggaacgtgaaggaagtatgaaaccatatgaatcacaaactgaaatgttaaaatgtttcataactaaaaatttggaccgattaccaaacgagtgtatatcgggcttaaattgatgactacttatttcgtttcatatttcaagatgtttgactttttttttctagatcaaactctccaatttataaaaaaaaagcataatagtagtattttcaacataaacaaatatattcaatgtgaggtttaatgaagagagaatatagtgtacaccactgagtttatcccagttcaacaatatgccactgacattatttcattctacaatataccggcgactttaccaattagtctacaatacgccattgggctggagatctttttcaaaaatacctaaaatacccttataatcatataatgttaacaattgatttatctcattagaagtttggaaaaaatatgaaattttttatttggcctccttacacgatatgaaagtttgtaatacaagttttaagatttttttcatttatattttttttgtaatataaattatcagttatatgctatataaaatacttttttgtgttgttatttttaatataaatcatctttgatatgctatataagttatttttatgctattatcttttgtgtaagtaatttctctctttaattctacacaaaaatatattgttttagaaaataaaaatatcaaaaaaaaaacatgaaacttatatacaaacctccatgttgtataaaaaggcaacacaaaaaatttcatatttttttgaaacttctaatgagataaaaacaattgttaacatagtatgtctttaagggtattttgggcattttataaaaaaatgtatagactagtggcatattgtagaacaattggtaaagtcaccagtatattatagaaatagacaatgttgatggcaaatcgttgaattgagacaaactcagtggcatatagtagattttctctttaatgaaactaatttggtattccctctgtcttaaaatataacaacatttaaccatcaggatttcttctaaaatataacaacttctccatcgatattctcttcccaaccaatcataacccttcaccattcaattttcccacataccttcattacccatccaatcacaacgctccaccattcacttctatacattttcttaataaccgcgtacaactataaaacttcttatattctgggacggagggagtatactttagatgatgttattttttttataaaattgattaaacttaataaagtttaattaaggaaaaatcaaacgatttataatataaaatggagggaacaatttcttttcaaatagcgcacacacactctctctctttcttcgtaataaatatttgatgtttggagtaagatttaatcaaacctttttttgactgaatcaccgggaggaggggggcgagtttccccacctgaatatattaagtcaaacgaaattacacagggcaggctcggcctacacaagcgcaggtgccctggaggatagtagcagaggatacacagggaaacacaaagaagagaaaaacaacagagagaaaaggtggccctccgaggaaaccaaagacggttttcctgcaaaatcacccagccacaaaccataaccgcctaaaagctaacttcctagatcaacaacaaacaaatcctcaagcagccttggaatccagaacgccgcgccaaagggcagagtgccacgagcatgccggcaggggaaagtggtgaccaaaaggctatggaagtactagaccacccgcatgaagccttcaagaatccaaacattttcttgttgcagctagaacagtgcccgccaacgccctttgggggaaggaagccccagagggggagaggcactgaaggttgcggcctagagccgcctacatggagtcgtctttgatcaggctaaaacgaattgcttgttggcttcacgccttccaacatccattaagggaaggaagcctcaaaagagggaaggcagcgaagcaatgtgatagaggacatcccaaggaatggatggagatgaacagggagttggacataaagggggatggctgaggacaggaattccacaaggaagaaggacatcaatgggagacaacgggaattggcacaagattagaagcttggagagcaaaagggcgaagcaggagggggcacgcttgcgtcgatgcctttagcaaggaaagtgacatccacggacgccaccatcgacgaaaagagcatcgggcaaatggttgcaggtttggttggggagactaaaatcaacgcctccagggaggtatacggcaccaaaaggcgtcgccgtcgatcgcacaaccgggggtgtgcacggctttcgccctctctccccaagcccaaactgcaggcttgcatatgccaaggtagctggctagcctgccgagcaggtcaccgaagccaggtgcggctgctcctagaccttctcgcccgcaccggcaaggaagtggtaacggagggaaatgagggcaaggagggcgttgaggggccggcgaggacagcggctgcggagggcgaggatagcagctgcggagcacaaacataaatcagaagcacagaggggcagctggggatcctctagagtcgncgtgcaggcagacatgagtatagtataatcaacgcgt

SEQ ID NO: 61486 - DNA, 4364 bp, Oryza sativa
ctgcgccggtgaactccacctggtacccggcgccgcgcgcccctgccttcaccgtcgccctccccgccgccattgccgtcgccctccccaccgccagtcgccatctcgacagcgtccgtgcgcagctaggggagccagcgccggcaacgacccgtcgccagctacgccaggtcgccgccgccccggacccgtcgccaaaccctgccgccgagcactccaggtcgtcgccgcccccgacccaccttccaaccccgccgccgagcagatcccgccatggaggaccggattcggcctccacggcgccggatctggccgccgccgggcgcttctcctcgtcgccggcaccaagcctgagctcctgtcttgccggcgtcccgtacggtttgaccacgagcgagggagagggagccccgccgccgccgtccttgcagccgcctggcttcgccgacggtggctcgggcgacggcgatgctggggagaggaggagaagggcgggggccccgcgtcgcccccgggacagcgccctcgtcaaaccttaaaattttaactattaataatttctcaaaccgtttggttttgaaaatctctatccgtagatttccttttttagaaaagtactatcataagatcgtaaactcgttagaatttatgaacatgtctgatgtaaaattgtgggacaaagttataaaaattattaaaaccaatcttatcctttaaacgtcgaacatttggccgatttctcccgtggtcgtccaactgtccaactgtacagcctgcttttacgcaacagaaaacggccgccaccgtccggtgaggcggtgagtagagacagacagctgggccccaccgagcagtgagaggacgagtagtacagatcccaccaaagtcgacgagacgaccaagctcttcttcctccctgcgaacaaaaaaaaaaatctcctccccgcgtcgaattcgaaggggagagagcgccgcgagcgagcgagtttggcggcgagatgggctgctgcagcagccggagcgcggactcgccggccagccgcgtcacgcgctggcgctccaccgggatcgtcgccctccgcgacgccagattgaaggttcctgttgattgatttttcctgtaaatttagtaccattggggattctgtctagtctgctagttggggcgtggaggaatttcggtgctcccgagttcttatcatctgatgcttagtgattcgggtacacgatgacacgacaaatatgatgatgcatcctaggatttctgttaatcagccgaaggggtctactgccacataggcgttaggttaagcaaaggtgtgatttttggattgcttgcgggtgttttaatcctatgggattgctaggtggaggtctgaaggaaaggcacaatcttgccgttacaagtatgtaatcatatgtggtgattggtgaatggtgatggcctgatgggttaacttggccaattctttttcactgtagtttcagggaatgctgatggttaaaaactttttgcccatggcacttccacactttatacttaccctttattctctctctctaaaacaactgctgtactttctcctctatttgcataatggagctactgcctatcaataattaaattcttaattagcatgggaagtactttttgcgactaaatatttaataaacactcaccagattgtaagattttagtgctttgttccatgtccagaagatagaggtgcattttaatattggcgttagttctcattcatttgtttgtcctcatatcagtatgtgatatgttctactatctcatctaaaatatatatttatcctgcaagtcaatgccaatttatatttaattttcttcgaagaacgaagacacaaggttcttttactgtgaaattgaacttttcttccaaaattgttaaatgtcaatgttaccatgcaggtagtaccaaatgaagttctacaagtagggaattccctgaggattctggatttgactaacaataagataggtatttggactttagaccatgacccctggatacttagaagttctgcaatgctagtatcaatattttctctctttttttttctcatatattgtcaggaagaaactagtttggagtcgttcattgcttctttctttcttttattatgcacatcagtatcagatgggaggaaaaaaattatgcacaccccttttttttcacttggcatcactaacaaatgcatatacttgaagcaagtcagcaacaattcgacaagttattttttttaccttgcagggtttctttgacagtttgggtagaaaaaaaatccaattgaactgcacacactgtatttagatgtttctatatcttgagaaatatcaattaaatatatattttatgttgcagctgagattccccaggaagttggcacactcgtgaatatgcaaagacttgtaagagttaatgttaatagaaatcatgatttggttcatcttaccaagttactagagacatgtatttttaagagtggttcttctttgcttgacatttaagtttactatttcttttctgttcctgtaggttttggctggtaatttggttgaaagcatcccagctaacattggatatctgcggaatcttaaaatcctcacacttgacagaaataagatctctgtcttacctgaagaatgttagttcataaaaacctaatgctatctttatttatatgtttagataatatttatcatttgtccacgtgtatattcttaatcctagcaacaagttagtagagatttattgacttttgcaatattacacttcacaatttcccacgtctaagtcctaacttgtttcttccattctatccagtgggttctctatcaaatcttcaacaactctctatttctcagaattctttatcacgcctgcctaagagtgtaggagatttgcgcaatgtaagtttcttattcgattcaagatgttaaattttatatatctttgaaaagcaacttttctaggcacaaaatatttttttgtcttctcaaaacttttttttggtatagcatgaatgccttcagagttacaagctgttccttctttttattttcctcttcagaatcaaataaactcttgattctatatttcctcatatgaaatttacgcagcttgttacattccgtaaagtttcttctttactagtaagtattttaaacttgttttaataatggagactatgctgtgctcatcactgttttttcaaccttttttttttcctgatgcagatgttgctactcaatgtatctgacaacaaactaattgcacttcctgaatcaattggaggttgcagttccctggaagaattgcaggcaaatggtaagtccatcagttttttgcaatggtagcatttatatcatttcaattttctctgcaccctgttcacatgcatccatgttaatgctatactgctgccacacacacacacacacacacacacacaaacatgagtgctctgtgccgtcgtactttcctatctcgtatgctataccacctgatattccattgggaaaggcatgccagaaccatttttagataccttttgtcatctaactcaaatatgatccaaccattcatatgctgtttaaaaaaaaaatgcaaagcacatcgtggttttcgttttcgatgcatcatcttagataaccttcacgaaaacattttcaggaaattcaattgaagacgtgccttcatcaatctgtaaccttgtttgcctcaaatccctatcattgaacgggaataagattcgtcaggtacgaacttatgaatatgcttttccctcgtcgattacttctgtgtttgaacctggaggctctagggtcaaagtcagtgaataatgactattcatttagatttgaaatatcctggttacattgttgccaacttgtaacgtacaaaataataagcaaagattctccgaactttgactctccctgacagcttccccaaaacctactgaaagactgcaaggctcttcagaacatatcgttgcatgacaatccaatctcgatggaccagtttcaacaagttagtggcatgaaagcttaatacagattcttgtaatttgattaatcttgattcaattataatttgttttctttgtctgttgaagatggatggctttacggaatttgaggcacgccgaaggaaaaaatttgacaaacagattgattcaaatgtcatgatgagttccacagcacttgatgaaggcattgatttgaactagtttttcagaaattttatttagtttataattaccccattagtcaaaagaccaactgtaaatctagtgtacatattagtttttccgatactctgatttggtaa

SEQ ID NO: 61487 - DNA, 1744 bp, Oryza sativa
gggttggggaaaatagagcaagactgagtactacccactgtactcagcaagtcataccggaataggggtatgatgcagggaattatcaaaggagagctagagtggttcatttgcataaagcgagcatttataaacagaagttgaaagaattaaacagttgtaataattaatcatattattcatccactgtccaacgctataccacgttgcgacaagcccaaccatccacctatactatccaatttcattagactaaactagggtgagactaatcacggtgaatctggttgactgcccataaccgcgggcacggctattcgaatagttttactctgatcagaggtgtacaactgtacccacaagacacagccccacgacacgtttccgtgcgccgacatgccaccacgacatactggaaagaggccgtgacaggacccttcgcataaccccctctaaccaagcacaccacacctcaggtttcacccccactcttcgcaaggcagcgggcagtcccctctagtgcctaggtgaattcggaagccgcataggccgtcgcaaggcccatccaaactccatcacgcccacccttgcctggatgcgtcggctagagaaaagctacactacaagcccagccgttgcccatgttggcttgtggtaagtacgataagttctttcagggcatcccgcgaaccggtccttaactgccatgggtgcgaccaacaaaaccatgcacccacagcccaccatgtgatttattttaattaagcaacaccgaagcggtgtcactaatccaacattaccattagaacctacagtctaaacattaataggatttttccccaatgtgtgctagttgaactaagcatggctaagcaattcctattccaaagtctattcatgttataacccaagctaacaaaggagcatggtatcaaaatagcatggctgtaacaataggtaaacatcccatagtaacattataaaacaatgcagtatttgaagaaaaacaatagagcatttgcaatataggatcaacatgttcaagtgacaggcatgacttgccttgctctgcaactggaggaacctcgacgactatctcgaagtacaccggagcgtcggaagaaccggaatctaagcgacatacaaagcaaacaatacaaacaggctataagactactgaaacagagaacaaaaccatttttaatggattctacacatttttcttgatttactgagacttgaatgggcttaaacggagcacggatgaattagatatgaattttagaagattcactgtgtttattactataacaaaaagtccttaaataatttattgcgcaattaattcccagggctgacgtcatcaagggggcggtcggcgccgacaggcggggcccgcatgtcagcggctcaaggggagagaggggcgccggcaagtggggcccccgggtcagcagcccaaggctgccggcccaccgtggaccgggaccacgcgggtggtccaccgccggtccacgggaccgacggcccagatcgccccggggccgatcggacgggcggcggtacccggctcagctcggctcaaggccggccgaccggccacggcgatggcgacggcgtgcgcgcgcacgcgttgccggcgtcggcaaccggcggcggaggcgccggcgcaaagtcggcggcgcacgaccggggcgacggctcgacctggcgcggctaggaggcagaggggggctgcaggaat

SEQ ID NO: 61488 - DNA, 2588 bp, Oryza sativa
  unsure (1)..(2588): unsure at all n locations
agggagggagacgaaccacggcgcccggcatccatggcagaaggcggcggtaggggtagacctccccggagtgcgaggggatgcgggttccgccgacgaatctcgacggaggaagggcggacggggtggatctcggccacgcgaacccgacggcggcgacgaagcggcgcggcgacgagtctagcggcggctagagacgaccggagtggcgggaaaggcggcggcgggtggatgcacggtgcgggagcgatggagagctcgggagagttcggccgaatgggaaaaagagagagggggtggcggcggagcttaaatagggagagagggggccggacgtggccgggagaggcgggaatcgccggccgacgtgggggagtgggagaggagagagaggcgggattcgaaaatcgaatcccggccatttcaggcacgggcccgggcccgatcggaagagagggggaagcgggtgcggganacgcggcggcacgaccggggcggccgacgtggcccggagggggcgggacgcgaggcgcggcggcggttgcggcggtggtggcgacgtgaagacgggcggccggaggaaggggacgaccccaacaggtgggggcccacctgtcggcgtcccggggagagaggggaggcgggcggctggcccgcgcggcttagctgggcctcggccttcggccggcccagcgggaggagggggagaaaaaggaggaatgggctggcggcccattcaaaggaaaaaaaaaagaaaagaaaagaaagaaaaagaaaaaagaaggaaaaaggatttttcctgggattaaaattgcatgtgctcaattttaattggttaaaattatttctagagctctgaaaatttcactaaaaatcctgttagcgaatttcgacatgtagaactcaagaaaaattccacatgccaattccgattattatttgcattaatttattaaggtttactcttgcttgacacaggtattttcttgagaccatttaaaactccaatttaggctcgggaaagaacttcggggtgtgacatcaggtcccaaaagtgttcataaaattctatagggaaaccatcaggacctggagccctatttttcttcatatctaccacaacagctttcacttcttcttttgaaattactttaatcaattcatttctatcttcttcccttagtttagagaaatcctccatgttcattgaaatacttgcagattggccaccactcccaaacaaggttttataaaaattggtaataaaagacatgagctgatgttgaccttcaatcacaccttcctcctgaatcaatttatgtatttgtcctttccttctccttccattagcttttgcatggtagtatctagagttattatccccctctaaaatttcctggtctttacacctctgaaaccactttactctctcttctctaatggtatactttaattttagctcccaaacccttctttcctctctatcaagacaagtcatcccattcatctcgatttttttgtctaacaagtcaatttgagttaaaatttcagccttttctcttctatatttgccttcccaatttatgttccagcccttaagcctcttcctaacagccctcagtttcccctgctagacatctaaactggacccattatcattataagaagaccaaacttcactgacaatcttatccaaatcctccctcatgaaccaactaatttcaaatttgaaaggagtattcttgctgcaattattcttcaggaccaccaacagagggttatgatctgagaaaactctttctaggcattggactgtcagcaaaggatatttttgttcaatctcactcgttatcatgattctatctaatttttcaaaagtaggattttcatgacaactgcccaagtaaatgtgcttggtcccatgtcaatctctcttaggttagcttgttcaataatggcattgaaaacaaaactccatctgttgcaaccccctggtttgtttttttcactctcccttctaataatattaaagtcaccccccaaaattagaggttttttctgtaaattcaattcctgtgcaagttttcttaggaattcttctttatgttctttttgtgcagcaccatatacaaccattaaatcccactcctgtttatcttccaaattctccacggtagctttcaagaaaaagtgaccttttctcacagccagcattttaaatttttctccatctagacccaaaagaatccctccagacctcccagaagctgggatccaatcccaaataaactccctcccttgccctaaagtttttagaaaatagacagagaaatcttgtttcattgtttcttgtaatccaataaaaccaaccttgtgttctttcataatatctctcagatgtttcagtttttctagatccttcattcctctaatattccaaataatacctttcattttttcttttttggttttctcccaggtttctgtttagttgtcataggagtgaccttgacaatagcaaggtttcctctatcagctcttctctttcctttatgtgattgagataaaaaggtttcagtgaaatcaaa

SEQ ID NO: 61489 - DNA, 1845 bp, Oryza sativa
tccatacggacgtccccaccatccttaacaatgataagcatgtcatcatgcttttcaatctgagcttcaggctcaatggtgaagtgggactcatgtggctctttttctcattcatgcttttttggtagagctcaaccaggtgcttggggacacggtagttacgggaccaatgccctctgcctccacatctatcgcagttatcctgctttaccccaaatgattcacctgtaaccttcttgagttcgccttttcctctgggtttacccttactcttgcccttgaatatgatacttcccttacctttccctttcttctcaccatggcctcttttacggccacgcgagtttccaacaacattggcgtgtgcttcaggcactgccatagacccagtgggtcgagcagaatgattctttagaagaacctcattctgcctttctgcaactaacaggactgagataagatcaaagtacttcgggtactttgagttcctgtattgttgttgcagcactatgttgttgggatgaaaggtagataaggttttctcgatcatctcagtgtcagtgatcttcaggccacataaacgcaactgagaaatgatcctatgtagagcagagttatatgccgccacagacttgtagtcttggaagcgtagggtgatccagtcatgttgttcctgtgggagcacaattgacccttgctggtcaaagcgatccttcagggattgccacaataccagtggatctttctcaaacatatactcagacttcaggtctgggtggagatggtggcgcaaaaaatgcaatgcctttgctttctcggccttcgtagactccacagtgccaacttcgggcagcacaatagtatgatcgagacccatggagtcgagtttaatctcaacatccaatgcccaagtgaggtagttactatcatccaaggcaagctcggcgaattccttctttgctatgtctgacatgttctgcaacatcatttggtatttacaacaggtaaatacgatgtgcagggtcgacatgaattggtcatgcgtaatcttcaggattactagtgtgtgtaatcttcaggattatcacacagtttcccatataatctttcctagcaaattaacttaagtaatcttcaggattacagattgcttgattaaatattatcaatcatgctaggaaatcaatttcataacaataaaataaatgttatgaaagtcatgcaaacagcaaagtaagcatgtaaaacaaaacgaagagcatacatgggcacaacttcatgtgtattgtgcagtctgtaaaaagtaagataaaccatgtagtacttccccactatgagcccacgcttcatggcggcagacttagtggcatcaagggcccatatgggtgatgtccataaaacaaaggacatccataacgacacttcagggtcgtgcagaaggttcgtttgcctccgatatttggcggcaacggcggcagagccgttcattaagttgctatgctggtgcttcaggcacctacatcacctctagcatttgggcgataacggcggcagagccgctattgcgttatcgaatagtgctaatgggatgtaccatctcaagcctttggacggtaatggcggcagagccgccatcatgttaccgggcgttgctgagaggatgtatcaactctagcaattgaacgataacggcggcagagccgccatcatattatcgtgtattgctgagaggatatcagaggatggtacttcaggtaccatgttcttctgcttatttcaactatagcagaagaatgatttgcatatcaagagcaagatgatcagtagaaattgatttcttacctg

SEQ ID NO: 61490 - DNA, 34683 bp, Oryza sativa
  unsure (1)..(34683): unsure at all n locations
gggcggggcgccgatctccttctggcgaccagagcagggaaggcaaggggatcctggtgagcatccacatcctctttccgattcatctctctctcccagcgcgactacttttgtctggaatttgcttgcgttcgttaaccctagcttctcttctagatctggaagaatatcttctcttaatttcagagccttaatcttaatacaagtaacagtttgtttgttcccccaaaagtttgggggttcaactgaacccccatgtcccaaagttggatccgcacatggtgttttggttctgattccagaacgaaacttgatgccatgggaagaggggaagagtagggggagagggaaaacgaacatagaactcgtatgcaacccaagtgttaacatttgcttgcttacataaatgttgttttctatttgattttgggcagcttgatagtagtcgcaacatgtagaagtagccggagatccatcacaaaaatatagagcataacacttgtctatgaacaaaaaaagaaaaatgcatcatgaaacaaagcattcttcttcctgaacaataggataataggtgatacatttattctgctccctttaataccttgcggaagaggatggacctactaggtgaataaaactattagagtattttgtttctagatctctcaggttactcttattacaaaaaaaaaaacccaaatattttttttctagttctctcaggttgctattattacaaataactttttccaatacatttagtaatcacgtaatgtattaagcataagcccaccaatcatattaggaatgtaaacatagactaatggtgtcttatcagaaaaaggttgtgccattggagatcaatagttattactcgcttgaagcctagaagcttctcacctaaattgctgcaagcagtccctatataggaattccttgcaaataattcatcagtttatagacttatccaaataacaatgaaacaagcaatatttttttgaggaaattgctggcacactgattnatatagaaattactgtaaaataattgctcctgagcttgtgtttgtcataaatgttagttgttactgtagatgtttctttccttaaaagtttccctaaacattcttgcttgtttacaggaattcctatatgaacactgttgccagcaatttgctttttaaatattcttgcttgtttcattgtgacattgttatttggacctgtctataaatgaatgtaattattttacaggaattcctatatagggactgcctgtggcaatttaagtcactacaacaaaacatgtgtttagagacatcttatttatagtctagagacgttttgaacccgtctttaggcatacatagagtcgcttcttcaaagcgtcccagaagcgtctccgttaggaccgtctcaaaattataaagacgctccatatagcatctctacaagatctgagacatgaaatagcgtccctacgttagttgagacgcttttgtaaatgggatccaataacgtgtctcatggtgcgtccttatgagtaactgagacgtgtacatacgattcattgtaggatgccatgcttggcatatttacagcattcacatctgagcagtatatatcgccatcaacatatataccaaaatgacagtaaacagtaaaacactccaatagatgaaaggtaattatattaaggacaattgtgattcacaagtcagctaaacagccatacagaaaaaagagatttgcgtcatctcttagaaaaataaatttataactgttcctaagataattcttgctttatctcctcccttcttcacagcatgataaaatatatctataactgttcttaagataattcttgctttatctcctcctccttcacagcatgatgtagcaatcctttacaatcttcagtatcttctaaaatgaattgtgtaaaccaaatcagtgtacatgataagatttctaaaaaatgtaagaaagctagctaagtttactaggccataaacagagaattagacaatccatacatgtattgattcatagaagatacacccatcacatatttcatatttgtcaggagcttattcctagcattctttactagcttcagtaaagatttattgaaatcgacccttaataaagtaaaacaaaataaagcacttcaatttgtatatttctgaacaaagagactatagccatactacagtattaacatgagaatattctcctacagatatccaacaatttaccttaatagctacttgttctatactttttatgtggctagaatttctcatcatcactataagtaacaggtaaaaacttatgatggccatacctttgacactttagcagttgctctccctcctgcatgtaaatactttggaaacttcagcatatagaaagcaaatctcccattttggaccagcatctctattcctttactcatatgccaccgaaggacagtatgaagaaccatcgcatcattcagaactagtgtccgagatccaagttaaacaagcattaataccaatatttgtttcaaagtgaatcgattagaagattgagttgagtcaaagtaatgcctctctgtgttttaatgtgattttgttgctaaaactacttaattaatgctgaactaaagcaggggaaagaacacagcgttatgcaatccaatactccaaataatttttttgcaagcgataccaaattaccaagtgattatctttctgaacaaagtatacaacaatcccaaagtatcatcatcagaattttttcctaaaaatctgcaaaaaaaaaagttaccttcaacaatactcatctgtatttttgtgccttcttgaagctaaaattccaaatgtagtcatcagatggaatggaatcagtagcaaaaaagaatttataatgagcccttaatgatcgacatattggtattgattgatccacagaggttcacaaatcatcaaattgattatcagatctgcatcatgcaagtattggtattagcattttgtcaaacaactagtacgatggttcattcctgaagcagaaagaacgaaaggtacagatcaatatttactcttttatacttctgcaggattacgaaataatccgatggggtagaactcaacataaagtctggacaaattgaatcacacaaacaaatcaaagcacctttgtagttccttaagccttacagattaggggatgagagagcatacctaccaagctaccaccgtggagttgttgctgggctggtgaaggcaactgagggagggacgcgttggcgatggggagtcgctgattaggcggcaaactgccagcggtggctcccatggcgaggatcagagcaggcagtggtgggcggcggcctgaggaggaggaggcagatgtggcattgactcgccgaggatgaggcgccgctggcccccggtcgaggacgagccggcggcaggcatcgagatggcgactggtggaagataggcggcggcaccaagcaggcagttcgatctagatgggagtttgttgcagcacgcagagaggatgaggacgtgggtggtttccaggagaaaaaaaaattcaatccaaatcttaatttttgagaaatcaatgtaaaactagggcgttatttaaaacgtctcataaaccgtctttattggtggggtagcctagaaaatagagacgatttaagtctcgtctccagccaaaggtcttcatttgtttgttttgttgtagtgagtgagaagctttctggctcttagtgagtaataactactgatctccaatggcacaaccttcttctgagaagacgccgtcagtctatctttacatccctaatatcattggtgagtttctgtacgatttcttgtttattacagtacgctattaccaaatgtactgtaaaaagttattttgtaatattaacaacccgagagaactagaaacataatatttgggaataacatattagaacacatatgattgaatagaagcaatggccatttttttttcttactaattgttattggcatcttgttttcatgcaggatattttaggatcatcataaacttcattgcttttgctgtatgttattccaacagggtgctctttgctatcttatacttcttcaggcgagtgttttaactttatccacacactacttgccttgtgcaatttgtatatctatgaatttaacatcatcaagatctatcagctttttctgcgatggattggatggttggtttgcatgaaagtttaaccaaggtaatagaagcatttcttatgtgttcaaagtcttcatgtagtttgtcattctgcagagaatattatttctaattttttcccttgtgccttgagactttatagcactagatattttatgaagagtaaattatatgaacttctaaaaaactattgtctgctcaacagttaaatcttggtttatctttactcattatctgatcagttaatgttattctatgtatcagcatcaacatttggagctgtgctggacatggtaacagataggtactcctcgaataaatcattgaactctgtatatgcaaggtgaatacattctgcagcctgaaataatttcactgttcaaattgctcctcctcagggttagcactgcctgtttattggcacttctctcccaactttacaggtataaatgaaagcagaaaatacttcaattgttgtaccttcgatctagatacctgatgcaaactgtatttgcaagtttctttgcagacctggcttagtttttttgatgctgcttgggttggatattacaagccattggtttcaaatgtataggttagttttctataccagtttttcagttagtgccactttgtagttttcttcacctcgtaggtgcatcctcttctgtaaggtattaaatggagtagaaatgcagaataaatgtatcacttattgtcttattgttcaggaagacaaaatgctttttttcatgatgcatttttttcccatagacaagacaaagtgttatgctctatagatttatgatgaatctctagttactgctacatgttgctaactacttggtggtgtttttttactagtatgttcctatcaggtaaaactagccacaaggatgtgaaggacactggcaattggcttctaaaattatattatggacatcgaccattcatggcattctgttgtgttgcttccgaggtacatgattaatctatatttggcagtatctacatggatgtttggctgcttacatgctggactatgtgcaacatgagtgctatgctggatgatttttttactagttcagctgaagtatgggcatgaattgaataggatgtgttgatgtgcccaaaaaactgaatggcccaacgagcctatcttacatctgcacatatagcaccaaatagtcatttgatatagttgaggagtcaccatctctgtatgtctagcacccttatacactcttgactaaactgcacttaaatgtttcaccttctaacataggaagtttataaaattacaggttctgtacataattctttttctgtttgctgatgagaaatcgacaagcttgcttaatgtaagaagacgatcatctctactgttgcttaatacaatcaagtcttgttgcagtagttaacatctggtatttctatatgcaacaggtgtgcagatgctttctaaagggaagtcctctcactttcttcgtttttatttcaactctagttggttgggcattaaaacaagtgatcaatatcatccaggtatccagaaaccaacattaaaatttcttgcagttgcaggtgcttgatatttgtacatctgcaagtatttaagttctaattatgacactaataataggtttgttataaagctgaagaaaaagtgttgatgcactggttagctcatatgctttacattagggtttagctagccctggttaataggagatacattatgcccaaattataggttcacatatgttgctaaaagcctagagcaggtgcttattgtaacattctattctttatttagagtgtctatttatatgattctagcagtactaatagcgacacattaataagaagtgtggatcgagatgtcgactaccactagagttgggcacttgtaggatcgagatgtcgactagaggggaggggggggggaggggtgaataggcaatttaaaactaaatgacacctaatataaaactaagggtgtgtttggttcccggtcaaggttggatgggatatggcggtccagttttttgtttggtggagtgaatatggcgatccagttttttgtttggttgtagggatgaaagttgatatggtgatccatttttttgtttggttgggggagtgggatggatgagtggttgcaatcaccctttcattagaggtggtgagtctacccctccaaattctcacccaaaaattatcaatctactaaaaaaaatctaaatagaaataaaaaagcagaaagaaataaaaggggaaggagaaaaacaaaaaaaagaaaaaaaatgccatctcgaaatcgtcggccgccgctcgccttctcgaaatcgccggccgccgttcgccttctcgaaatcgccggtcgccgccgcctcgtaccctctctcctcggccgccgccactcgccctctctccttggacgccgccgctcgccctctctcgccggcgccccccagatccggttgtcgccggctcgcctcatctctcgccgccgagctcgcctcctctcttgccgccgagctcgcctcctctctcgtcgccggctcgccctagccgccgccgacctcgcctcctctctcgtcgccggctcgccctagccgccgctgccgagctcgcctccacggtcgtcgccttgcctggttgccgagctcgcctcgtggtgagaggggtgacgcgacccacatgtcgctcgtccctgctcgcccgagcgctcgggcggctgcatccggccgaatcggccggatccccccatccggcatctggggggaatatcctccccgtgccgccccatcccacccctgcccaggaaccaaacacccacaaaaaatgggccgccatgtccaatccacccatatccctccatccaaacacaccctaacctaagttgctaggctcggtgagggtcaagtctaactaagcaactaaacctagggtgatagtggctcaagtatgtctataggaaagcaaatcacactcctaagtcaagtttagcaatcctagggtaatatgagctcatgtctctaggaatgtaaattgcacaaatgtaaatgcgataaataaaagagacaatgagacaaggaattttttaccgaggttcagaaactcaccggtttcctactccccgttgaggcgagcccaactccacccctcaaccacgaagccactgcacgcccccttcgtcaaggggtgggcaaggcgggaaccggcccacggagaggactactcaagcctcgatcactcgggttagttcttccttcactccgaaggtggtgaactccaaaccactcacaaccggcgtcgggccttctccacaatcttctcggagaggtcacagggcaactccttcacaagccgtctaggagactgcaacctccaagagtaataagcgatgacccggcttggagatgatcaagcgccgcactagctctacaaatggaagcaatgcacttgactcttggctaaatcaaccctcaaacacactagatggatgaacacaaagctcaagtgggtgtgtgagagatggaaggggtgtatgcaattgaagtgggtgccaagagagtccccttgctgctggtgggggagtatttatactcccacccaccaaaactagctgttgggggcgaaatcccccaattttgtgtactgccggtctgaccggaggtgtgtggccggtcagaccgttctactctacaacggctagttttctagccggcctgacattgggctccaactgcctggccggtcagaccgacatagggtggccgatcagaccggcctcggctcggtcagaccgcccccagctcggtctgaccgaatacagctccggtggctctagatcggccactccagagcacgcctctcgactaccagggggccggtcagatcggcctatagccggcggtcagaccagcctctaaccgccggtcagaccggcatacaagccttggtctgaccggtcctggtcagtccacacagagacaacaagcattaaggtgatgtgaaatttgagtctaaatgcgaacacaagtctaaatgcatagtgacctaatgtggcaatttaaatcatctctttgctaggtcattaacccccttaatagtacggcaaagctataaataaactagcacaattttgatcacccaaactcctcgatcgaattaaaattcaactactagtttactgtcatctatcctttgctttgcccccatcaatttttagtccaccatcgataatcatccatgcgcacatatgatgtaaacctaactcaaaacatataactcgatataacggttagtccataattagcgtttgtcattaattaccaaaactaacaacgggggcctagatgcttcaatcccccctttttggtaattgatggcaaacacctaaaacatatataatcaaatttaaagcacatggatatattgcattgaaaagcaaatgcttcccctaaacatgtgcatatcaatcacaataaacaaattaggaacaaatgcacatttcagcatagctcaacacaaaaacaccatataatgtgaacttcacatatagatcattcaattgcataggatggtcacgaatatatcaaaatcacatccaccgtccatcatagcacaaattcacatccataaccttccaaattatagaagttcatccatatatcatccaagtcacaaattgtccaaagagggctcacaaataataacctaggctattacatgaccacgaagggtccaaataacatagagttcaaaacgaaaaaaacacaagatatagcccaatacacatacataatatagcccatccaccttaacctactaaatatgtaactaacctcactaccactactctcatcccacaaaacagtacaccattcaccttaacctactaaatatgaggtgactaacctcactaccactactcccatcccactaaagaaaatgcaagctagattcttctcccccttttggcatcaagggaaaaaaaagcttcactcttgaggaggaggacgagccgaagaggaagggcgaggagcatcgcggcgacggtgatacacaaaggcatgggtgctttccaacatttgaaccctttgatccaacactcccacccttgtgctcaatctccccacggactcattcaggccaccaacattcgaatgcaaaccacgcacatcctcgtacatggcttcatgtccggtggtgagcctttggatgttttcacttagggtattgatggccctaagcaccgggttgaaatattcatttggttgtatcctaaaatatgcatattgaggatggaagaaggtattgggatcatatccatgaggaggaggtgccgcacttgtgcttgcgccttgatcaaagataggttggtgcacttggggagctctaggaatggaaagttggcggcgaggcttatcctccttgtgttctttcaaattatctccagcatgccccaactttctttgaatcaagcgcatgatatagagagcatagtagatgccttgtccaaatgtcccctttgaaatggcaatgtcttgcatcattagattaatgacgtcaaagcgacgaccctccatgatggcatcaatgacatgccatgcgacaacgcgaatgttgtcattgttgccacaccttgggagactagtggctctcacgatgcggttgaccatattagggatggtcctcaaacccgccaccttcccataggtgtgccttccccatctttatagaaccgggcatagtggtcataggggaaaggattgtgggtgtgctcgtcttggagatcatcgccgttgttgaaacggatttgcaacaagtccttgaactcacgccgggtgatggagcactgtagggtccccgacatccatttcatagcatcatactcgccggacacccacacagtggcatagaactgtcggatcaagtcttcatcatagggttgcttcaaggtaacaatcctatcaatgcccactgcctggaacatcccttgtagatccacaaattccgatgtctcactgatatgtctccaagatatctacttgtggttagcaaaagctttgcttgcttatgcttgctcatacacggacttctgtaagcgtgtatggaaccttggatcgttgcaatcatttggcctccggaattgattgtgatgacggaggatagtgtactgttggggatttctcaagttaagcacaaactggatgggctatattatgtgggatgggagtagtggtagtgaggttagttacatatttagtaggttaaggtggatgggctatattatgtatgtgtattgggctatatcttgtgtttttttcgttttgttgaactctatgttatttggacccttcgtggtcatgtaatagcctaggttattatttgtgagccatctttgaacaatttgttacttggatgatctatggatgaacttctataatttggattgttattgatgtgaatttgtgctatgctggatggtggatgtgattttgatatatttgtgaccaacctatgcaattgaatgatctatatgtgaagttcacattatatggtgtatttgtgttgagctatgctgaaatgtgtatttgttcctaatttgtttactgtgattgatatgcacatgtttagggggagcatttgctttttaatgcaatatatccatgtgctttaaatttgatcatatatgttttaggtatttgccatcaattaccaaaaagggggcgattgaagcatcttggctcccgttgatagttttggtaattaatgacgaatgctaattatgtactaaccgttctatcgagtcatatgttttgagttaggttcacatcataggtgcacatggatgattatcgatggactaaaaattaatgaggcaacgctaattgtggattaacctttttttagagtgtctatttaactttcatgtttcttccctgagcgcagatgaaaacagccgcagatatgtgcgttatgttcgatttgaagcacggtaagtgagcagaaacggacaaagattcgtttagtttggcgtttgacatgtggaagaaaaattcatgaggcttgatgcaccgagggcatataaacctaatgtaagattttgacatttctttgacctggttgagggcatgcagacattaacggcgtgaaagaaaaaagatctggtgtatcgagaaaaacagggttgccatgtttttcctacagtgatgaatttgcgtgatctttgtttctttatcaggttgatgtttgttagcagtacttttagctggctgtgtgaatacatttctcacctctgaaaatttggagggcatgaatccggagccatcatttagcattttactccgttgtaaatttgtttacactaatctccaatgaaatgtatttacattgtctcctctattgcgtactgctgtatcacatttataaacagctgtcgcgcccagggattcgacaacccgaatcaccggctagctgtgcatttaacctctatccaggcatcaatcagagtacacagatgataatttgatacagctccacaacttacaaaaataacaaaataaaactcatacacagcggaaaaactaaagaactagacttgatcttcacagcaacgcgaagctttctcgataactccacaggcaaactcttgatggccggcacaaacctaatcttcatagaactcaccatctgaaccaacttctgcttcttggggattgggaaaaagaagcaagactgagtacaaccaccgtactcaaggataacgtaaggataacgtaagggtaatcaaaggattggctcaataggatattttgtagtaaaagcagcatttgtaaatcataagatgaaagccgtaaacaatatataattgagcagtattaacatcatcactgtccaacgctaaaccacgttgtgacaggcccaacccaaaaccacatgaactacaccagttcattaaggcaaattattaaggtgagactaatcacggtgagctagttgaccgcccaataaccgcgggcacggctattcgaatagttttactctgatcagaggtgtacaactttacccacaagacacgattccacatatgaaaccatgccccgaagtaccgccacgatactgcaaaggggaaaatcatgataaaaccctccatataaccacccctaaccaacacatccacctcccgtccccactccaaaatccaggagccattgccaatatcctacgttacctggatatgcgtctcaagtcacgtatctgtatcggatacgtcgctggatacggatacgtatcggatacgcctcgatacgtatccggcatgtatccccaccatccacgattttcaaataaataaaaataatcccgatacatctccgatacgtatgaaccctaaatcagtcgaacaaaacccatagccagcattgagcgagccaaatcccccacacccagtgctgcctgccctaggccccaacccaagctctcgctctatccggcgtggctgcgtcgtccccggcttgctgcgttggcgccgccgccgtccaccgtcgccgggttgcgcctccgccgtccgcagccgtagcgccgcgcctccaccatctgtcgtcgtcctgctggcatagcttcgtcgtctccgagggcgcaacaccgccgccactggtaaatctcctatttccctcttcaggaccccatgttcgatctacattctgcaaagcaacaagacgataatggggcttcaaccacttcagttacattgcatgaaagcaacaattgtttttgggaagatgacgtatcggcgtatccgtatccgtatcgccgtatctgggtaacatagggagcaggcagcccccgctcgtgcctaggtaaatccggcagcagcatagatcgcctccagtccatccatactccatcacgcttacccttgccaatggtgcgctagctagaaaagattatacttaagattcagcctggagcccatctggcttgtggttagtacaagtatatcttctagggattcccgagaaccggtcattatttgtcatgggcacgaccatcaagtgaaacatcatgcatgtgcccacgacccaccaagtaaagcatattttaattaattaaccatatgccaagaaggcatagcatcatcataaaattaaggactatattatagtgaatcctaaagtgagctagttgatctaagcatggctaagcaattctagaccaatcatctagttaaattattaacctaggctatcaatgaatcagggtaaacaaaggctgagtatgggtagaaaccatcccacatgacattataaaagtaatgcaattttgagagaaaagcaggggttttgcaaataggctcagtatgattagtgatatctgtataacttgccttgctcttcagctgacgggacctcggcgaccacttcaaaataaactggagcgtcggaactgctggagtataaacgacaaacaaggcacacaataaatacaagctaaaaggctactgaaatagccaaaagaaaccaattttaatggattcttgacattttaacgaatttactacaatttgaatagattaaaacggagcacagattacttagttatgaattttacaaggtgctctgtgttatttactattgacagaaaaaccttaatcagttgacagggattagagcccaaaaggaacataggattaaaggatagattgactggcaagcgagccttacgagataccgactcaacgagtcaattcgacgtgacacgagatcactcaaataatcaaccgaaaccggcgaacggaactggcggctttgaacggctctagactaaaagacgactcaggacggatgaacgaaccataggggaacaccttgctaggtttcaacgacgcacggctgcgacacggcgacgctagggcggctcagctcggcggctacgtggcggcacacggcggcagcggcggctcggcagggcggcacgcggcggcggttcggctagatggcggcagcggcgtctcggcggcacggctctagggctagggcaacgacacatgacacaaacgctaggaacagaaagacttaaccctaaaaggacggagaacctcatcggaaaacaacggcgagcagagggaggacgacggtagcggcggtggttccggcggcgagctcgggatagacgacgatgacgctagaaaagattgaacggaaggaattagatagatgaattgatgaacgctgcatcaaatacatccaaagtaaggagaacggagtaccggcgacgcaacggcagcggctcgtggctcggcggcgtcttgcggctaggactcgggtgggggtgaaaacggtacggaatttttccggattccggtcatgttttcggaaacggaatcggtctgtcataattttttcagaatttctcggaatcagaatcgaaaacggaaatattttctcggaaatagaattgaatatgataatagcagtttccgtcggaacccggaaacgatcggaaacattctggaaaaattgtcggaatttccgaagttcaaaaagcccatagattcaatagtccataattcatccctaacttcctagcccaacccaaatcgcagtggcatctaccctaactagctaaccctagaggagagagacagtgagacgcgacttgcgagttggaggcggagcaccggagtggcggctgcggcgtccagatcgcggcatcgcggcgcgcccccgtgcccaccgcccgcgccaccgcccaccggtggtcacctggcccctgctgtcctcgcccccaccatctcgcgccgccctcgctcttcgccgtttcgccaccggccgccgccaccatctcgcacctccgccggctggctcggtccccgccatctcatagcgccgtcccgccgcgtctcgccgtttcaccgctgccaccaccaccgacgacgacccgacgacacctcaagccccactgcagtctcttcctcaccgccaccaacgccgacgactcctcgcctcgtagcagccagcagcccagcggcaacatctgcgcaaccagcagcagcaggtgttattcctcattccttaacctccacctctgtcactctgtgttagtgttactgtgtaggctctatttatttgagtgaatgttgaatgattgatgtctttttattttctttgtactaaggagcttggtaatattacgttctatgtagggagcttggatactgtgtaggctttattttctttatatgtttatgccttcttgcttctggattttattttgctctgtaatttagtagaagttattaatatgctctattgccatcagccaagcactccaattatagaaatactgctttgtttgtggggaataatacaagtgcagctgaaaaattttacttgctactatgtccagctaaggacagactgtggtcttgagcctaaaccattgatttgatttcttttatgctgcagatttgtgatggaatcatcacatgcaagtagcagcagtgcaagtgtatgcaatgcgggcattgtagctttgcgagcatcacaaccaactcttgcaaatgtaggagatcctaccacaaatgtggttgcagcagcaagagtagaagttgatttgacacaggaaactaccgaggatgcaaatgtccctccagcaaagaaagcaaagaagtgtagttcagaggtttggagccactttgacaagtatgagaaaaaggtagtaggagatgatggaacagagattgtagagctttgggcaaagtgtaagaagtgcagctatacaactcgtcgtgagagcaacaggggcacaacaatattttggagtcacttagacaagaagcaccaaataaaaagtggccagcagcttctaaatctaaaaaagagtgaaagcggcactgctgttgagacttacaagtatgatgaggctgttagcttgaagaaattttacttggcaatcattatgcatgaatatccctttagtattgttgagcatgagtactttgtggattttattaagtcattgcaccctacctttccaatcaaaagtcgcataactgttaggaaacatatattggatatgtttttggatgagaagaagaaaatgtatgagtactttaaaactcttgcatgccgctttagtacaaccatggacatgtggacctcaaatcaaaataaaggttatatgtgcatcactgtgcattggatagatgatacgtggtgcatgcaaaagagaattataaagtttatgcatgtagagggtcatcactcagggaaaaacttgtgcaaagagttctatgatagtgtactggattggaaccttgataggaaattgcttgcacttactttggacaatgcatctgccaatgatgtatgtgctaggggtttagtagaaaaactgaatgatatacaacccttggtttgtgaggggatctttttccatgtgagatgtttgaatcatattttcaatcttgttgctcaagatgggttgaagcaaatttcatctagtgtttcaaatattagaaacccaattcaatttgaactccccactgcagtggtcagaattcatgaagtgtgcttctgagtgtgatggttagacactacttgtgggctgtctttggatgttccaacaaggtggaattccacatatatcatgttaaagcaagctattcactatagaaatgcttttaataggctctttctttgtcatagaagcaaatatcataaatgtgccccaaaagatgatgattagattatggcaaagtcattgtgcatatgcttgaagagattttatgattctactttgatcttctctggcattagttatccaactgcaaatctgtttttttagaaaattctgtcaaattaagatggcagtagaagaatggtgccgtagttctaatacaatcatagcaactatgggcaagtcaatgaaacctaagtatgataaatattgggagaagtccaatatggctctttctgaagcttgcttgcttgatcctaggttcaagagaacacttcttgagtattatgcagataaggtttatggtgtggtagccccaaaacacatggcggatttcatggttgttattaataagctatttgatacttatgcatctagtcaagcaagttcaaagagtccagcagctacaaatgtgcagaataatcttttagtgagtaaagactatgatggggagagcgatgatgagcttgatgcagatgttcaacaatacttgcgtgctagtactgcccctggaataggcactaagagtgagttagaagtttacttggaacagccactattggaatggtacacatcagacaaaaccacatttaatattttgcattggtggtcactcaagcaacatgagtttcctattctcagtttctcactagacttgctcgtgatgttctggctattcaagtatcaactatagcttcagaatctgcattcagtgtcggtggccgtgttattgatccattccgtagcagtctagaccctgaaattgtgcaagctctgatttgcaccaaagattggactgcagcatcaagaaaaggtaatattcagctgtttgtacacattttttaatgcttttactggtccatattcaaatttttgagttaatatgtgattatgaacatttaggtggaaatgtggttgggtctatcttactgagaaggacatggagaacctggagcagaacttctgtgccatgttgtccttggtttgtgcttgtatcactaacatgtctatatagtgactaactttgtacttttactaatgctctatcattttttttgaaggctaatggaacagagcaagagacagagacagtggaatgttctaatgaggatggcattgcgccaatggatgtttgaagaaaatgttggtcaatttaattttcaagttacatctaatttcaagtttccatttcaaattagtgtactcctgctgcacaagtggatgagatatgttttgtgatgaaccatgtactgatgtgttttgtgattgaactatgttttgtgatgaactatgtatttatagtgtgatgtgttttgtgattgaactaagtactgaaatactgatggactgacgtgtcatgtgtgttgctgttctgtgatgattaatgaactattgctgttctgtgatgattgatgaactaagtattgatgggctgatgttcatttcctggagtgataggctgatagcagtatagcacctgaattgtgtataccttataggcttataccattctgttttgctttattcttttagaatatttgttatgcaaattatatgaagttatagaagaatatatttttgctgttgagactaaacaattagacttgatatatttgtgttttatgatgaattgttgactgttgagacttgcgaattggacttgacaaaagtttgaagctcagtttaaggggtttttgtattccgataaatttttgttaccgtatccacgccggttcattttcgctctgttttcggtttcgatactattcgtttccgttttcgtttccggtgtttccgattccgatttcgaaaaaaaatatgaaaagactatattaggaaaaggaggagtcctagagggagtaggactaggagggagggagtccgactcaaaagggggagaacggaggcgcgcgcggcaaggggaaggggcgtggccggctagggagagggggagggaaaaaaggaaaagtaggggactaggactttcccaaaaaggaaaaacaatacggtgccattttaggaaaggaaagaaaacgaccccgcgaactgacacggatacggttcgtcatgcaaaacgaaactgcgaactgagaggggagtgaattgggcacaattcacgatcaaaggcaaaggaagaagtttaacttgacacttttaactttgcaacattgccttcggtgatctagtatttactctttacgtcctattagtgattttcagagcaaagagaattcgaaaaaaaaatctccctgacaattctgattgttaaatgcattgttaactggggttttctcctggttaaccaaattaaattcttgaagccatttattagtgatttgaaacctaatggaggggaaaactttaggtgtgacaacaacttccattcagaaactaatttttgaaaaacttcacatcaatttatacttgcccaaatttctcttgatttggaatggatttatcttttagatacctagaggttttatctgcaaattttcacacaatctataatttgattaactttcactaaatttgaactcatttggatgggacgaacgatgttgttgctcccctgctgcttgccaatgtcttgtcgtgcatgtacgagcgtcaagaccatcatgcagtggagaatagacaagcattgccctcgtcatggtgtgggataaccatgaaaagatagggggacgttccagacaactaaggaacacgttccaactaacgttccatgttttaggaagaggtatacccatatcattccatgtatttagaaaatggcgtcccacattcctcgttcctgttcctcgatccatcgctccgggaacttttgtgacttagctattaaccgtcaacctctattattatttaaacctactttcaccctatccaccccatcgctaattcatcgacattagttccaatgcctttgtgcatttcacctatcttcagaacctagctacataatctcttctaatatattatagttcttattttaccactgatctatataatgtatctttacctttagatacaatctataaagaataacacaaccacttttacaggtgcagccacttagcatgctcattttctataatatgggtcactgatttctttgatagacattgaaaatatttatagaatacttttctgcagagaacaacaaacacaaatttgcagatctttgcttttgcgccaagaatgtcgacttatcaactcacataaagaagcacatcaaaaaccttgcacatttttttaaaggaatactaccaagggtcacccattagtttttgttatattaatatgtacaaaataatacaaaatgtcaaatattacaaagtttataaccaattaaaaactgaagataaaagaggttccttcatcctacacccatgcaggcccggctctggggcagggtaaagagggtgacggcctagggcccgtcgtggctaggggcccatgtctaaatatgtatgaatactgtatgagccaaagtggtatttaagattagtgaataattccatactagtatctactactcttggttatcaacataatactgattagtgaattaataaagattctagattcaacaatcaaaattgtatgtatagatagattcttgttgataacctttataattttaggtgctgaaaagttgtaattttagtcgagaagcatttttatggtgctaagtaaatgggaaaaataaacaagatcagtttaagtgttgatatttttctatttctaagaacatatatatgaattgttatcaatggtcatttctctctatgattagatttgaaaacacactttgaaaatgaaggggttgtttagattgtagctaaaataaatcttactaaattttggcaatgccaaaattttgacaatttagcaatattgtcaagttttggtaggatttggtaaaaaaactaaataaatgtatatttttgacaactttaccaaaaattgatatggtttaaaatgatatcaatctgaacaacccaaaaaattgtgaatatacatataacaagtctcactgtaggggagagagggttaagggtcatcttgtcaagtttgcgctagggccctcaaaacttaaagccggccctgcacccatgcaggagaactaatccgaaggatggggattcacattttgaaagattaaagcatttctctgcttccaaatatgccaacattcaatagaaaaaaattccaagaagctttttcctctaaagcgcaaccttgccaaaaccaccatctgaaaaaaaaaattccatgttaagattccaagtaaaaccaatcttcctccaacaagtatcactgaatgggcaagaaaagaatagatgttctatagtttccctcacactcagagaacagagagcacaagttagatctgcatcctcatgagcacaatttctcctgtccaacatgtccctagtgttaagacggtcacaaaagagaagccacataaagactttgatcttgttcacacagttcgttttccaattccaaacaaatggtctaggtggagagcgaccaatgaaattcaggccataaaacctttgcgaagaatatgtactgttatcccaaatgaaagacatgcatctcctgaagcattagacagaagcagcctttgcaataattcctgtaaaaccgaaaactcttcatatgactgcgatgagaggggcagttggaaacaatcttcaaactccctttgagcaaagcttttcacagagtcagttttataaaggcactgattgtaaaggctctcaaaatactgacatctgactattccattccacatgtcctcccaaagagtgactgaattaccattaacaactgtacattgtgcccctgctctgtaaatatcaatcaagcttatgatatctttccaccagaaagaacccctattaagtgccacattgcctgcaccatccaagtaaattctatgttgtcactatgaatgagaccttcatgaagcaagacagagtggttagctcttttatctacttctcatccttttataccttaaattaacaactaacactcaatttccattacagtacttttcaaaagagttctctgtgaatcacttaaaaccactcatggacgacgcaacagtgcagattcaggtccaggcattagaaggcccttcaaccaacatgattcttcacagatcaacagaccattgttgcaacttaaagaaaggatgggcagattttgcagtgaacaataacatcaagttgcaaacagtatgcattttgcacttctacaaaacaagccatctgggagcaaccatagatatcttctgaagtccatatcaatgttgtatgatatgatcctttcggtgccagcaaacttccctgtatccattgaacgtgccgtttatgtcctatagtaccagtattatagtacttagccttgcgccttatgggtgtgtttggttgctcatatggatctagcccggctcatctcccttatccaggctaagcttagctaggctagagacataaagatgcagttgtttggttgcctgtattgaatgagccaggatgtggttagatgtgcatccatgatccatccaaacaaagaaatcaaagaaagagtggacaagaaattgaaggtgggaaagggaagaggaataccatccttgcacttaccttagatcttgacggagagagccgaagatgagagggtgtgaggaagacgagcagccacgacagagggagacgagcagccgccggcagagggagatgagcagccgcggtggagggagacgggctggtggcgacggagggagacgagctggtggcgacggagggagacgagcagccgcggtagagggagatgagctggtggcggctgagggagccggcgctcacgcccagcgacggagggagccggccctcatgcctggcgacggagagagcgctcgaggcgggagatgcgctccaaaccctagcttgtctttcggttggaagaaatgaggaggggaaaagtgcttgaggcaagctgcggtgaccccatcgcctgctggttgtacgcgcggatgcagtgcgtgcatgcgtgggtgcagccttgtggttgcacgccacgagccaggccgccctgcgaagcttgaatcggccgtttcccctcagcctggctcgacggacctttttgcatctcctaggcctagctgagacccccatccaaccaaccaaacatgcggtaggctgcacgccaaatgcgggccaagtgcagtccatgcaaccaaacacgtcctataaggtcgctgtggacactgcacttatgaatctattaggtcacttacatatgtatgcactgttggagagaccaaacaaccaccatgctcatctatgagcagttcaggtgcttacctataaacacctgctattctatatttaattcattttcttctgttggatgattaagcacggttgtatagctgcacgttactactgttcccatcactttcgggcaggcggcgcgccaatggcgtgccccaccctctagtatagttttactctaaacattatgtccaatctaccacctcggccggtgtggttcaatccacaacacgaatagacagttattatgcttctatctgaattaatattgtacctccgtggttcttaagaaggaagaacggtccaagaactgatagcagtgatgctgcaaattcattgacaggaaatgtgttgcgatgttgttcgttaattacgtagataggtggcgttgatgtgagcccaccaaagttcaaatccaacctatatgaaatgatcagtatactacagcccccatgttaactaacaagttttaattcaacccaccaaaagaaacgacaaaacctaaagttatgattctctagaatgaattgttcaaattgccctcgatccgcactctttcatacatgtgttctctaagaaaacatttaaaactcttactaaaccaattactttttgatgatcaattgccaacagggacaataccactcaatgtagatacatactatcatgtaggagtagtgtggtaggctggtacccctgcaactgtaatttagccactttctgagccattgaagcagaacagaccacagtcaagcaaaagatgacaactgtcaactcgggcattgttagtcatgcgttcaggctcaaactccatcagtagtgtagctttcagtccagatgccttccatctctatctgaatacatgacggaatgcctctcaacatgcacatagccatcactctcctagtttttttgcctttgtgtccccaatttatatgtgctactatgcgcaaagaagaatataatagtactaattaaaaacttagcttttatttgacaagtgatttctccgccattgtacatcacggtttcagcagtgcccagttgcctattatattgcacaccaatgatactatgcattcaatggcattagcgtgcaatacactgtggggcactacgtttattgccaatgtaaaaaatataaatgttactacgataactattacttactatatgacaatgtgaaaaaggtctaattaaactaatttttattatatgacattgcagttgaaattcttttattatttgaatatataaaattgtattactaccggtattttaacttagatttaaaatattgtcatatttgcttgtatatagatttttcatgaagaaattgtgcacattataattcaaatttacaaagatgtagcatgcacccatttataaactatctaaatgttgttatgaatagcacttgtcactactagaaaaacgatttttcatagcggcaacgagaaaaaaccgccatcgtagaaaatcgggcgggggtggagggtcacggaccaccagcgaaaactgattttcactagcggccacattaagaggtccgccataaaaaatactatatttttcaaagcggagctcttaaatgttcgccagcgaaaattagcgttttcactagcagctactaaagagattcgcttcgccaacaaaaaaaaaaacagatccggcagcgaaaagcaaagcctcgctaaaaaattttggcggcattttaaaccatgcgtgcaagattccttcacccacccacgcatttaaaactgattttcacctacccacccactgccagaggccaccacccacccacccatgcattcatctctcctctatctctttctcctctccacccaccgcatccctctcctcctcccccacctctctcccctcctcctcctcctgtcagcgacgtcgacaatggcgtccacggcaggtgtgggcggcgaggccctcacctctctcccctccctctccctctcccagatctagccagagggagggggtggccgccaccgtggcagcgacggcaggcgggttgtggcggagctaacgctgacgacgacgtgtcggacctgtcaggcacgggccaccagcgaaaaaaaaaattcgctggcagccgtcttaagccaaccaccagcgaaaatggatctttgctggcagctagcttaagacgacagccagcgaagatgaattatcgctggcggttgataaccgctagcgaagatcttgatcttcactggcctttactttgtggctgctctaaattccactagcgaaaacccaaaatagccgccacgaaaaatgggtttcgtaggagtggatatttatttgagggcactacacgaaaaataatttttacccttgtggacaaaaataccctcttataaccgtttgcaaaaaattttatgggtggaagctaaagaggcctgcctgtgaaaataaagcgaatttcccaggcggacatcttaaggctccgcctagaaaaataagattttcgcaagtgagacgttaagtggtccgcccacaaaaatatggaggccctattaaagttggttcagtcccccatctcctcctccagatcctcttgtcccccacctccatccctattcccccaccaactcctctagcctaacccccctcctctccctcaggccacaatgacggcgcctagatccgcgctggctgcaacgacgccagtgcgccgcctgcgagatgatgatgaggacgacaatgatggccgtgactggaactgccaccggttgcgacgacgccttgatccgccatcgggtggcctcaggcatgcggatccgtcgccgtgcggcatcgagcgcatggatctgccgccgatcgtcctcgggtgcttggatctgccgtgggtttgctcacaagcggtgacggctttgatcgataggtgcgttggtaggtcatggtgggggctctcaggttgtggcggtggcttcgactgacgatgaatttttcgctttgtgttgatatgtgatgcatttcttgaatagatttcatgattcgataaatttattaaatggattgggggcttttgaatgtgctcctatgcggggaatcttgagttctctaggtttttttgcgctatgtaaatattttcgaaggcggacctctttaggagtccgcctgttaaaatcggttttcgcaggtggccgtctacacatctatgaaatacactattttaataggtctttgcctgcaggcagttggactggttgccagaaaaaaaaactgatttgtctaactgtaaaaatgatttttttagtagtgatacacagattaaaaaaaacttttacaaataaggaaatacatatccatctaaacagatgtcacatggcatataaatagggggttttctaatccgtgcgtacgcgccggcgagggaacttgcgtgcgcgcgcacggtttccgatttgacctagacacacatggctccttttcttttctggtagcgtcgctggaatacctaatagaatttgttttggataattaccgtaattaacataatttgttttgaataattatcatgtttaaggtcagcttttctctttttcggaaggttgttttgttttttactaaaagtttgaaaatatctatacataaaaatgaaactttccaattaaatttaaaactttctataaaaaatttgaaagccttatcccatattttcaaactttctacttgaaagtttcaaactttgtactaaaaaaatttaaactctaatctcaaattttgaaaattttgaactctaaattttaacttttcagttaaatttcaaaaactttcaacttgaaatttgaaatctttcaactcaattttaaaaaagtttcaactcaaaatttaaacttttaggtcaaaatttgaaaactttcaattcaatatttgaaaactttgaacttagatttgaaaacatgtgtagtgaagattaatgaaaatatgaaaaaaaaacgcataaaaagaaaaaggaaaatgtgacaagggaaggggcgccaaatcggaaagaaaatcagaaaaaaaaagaaagcgcgctaggaggcgagcgccagctgacgcgcacgcgcaaaatagcaatgttgtataaatagtgacgcttttacaagtataatctttattccattgacctcaaatgaataaggtaacaacaacaccaaatattaggtgaaaaaacaacggccatgaaaattccgtggaattcttaatttattcggtatggcattcattaatttaaacccatatatatacctaaattcattaacactatatgaatgtgggcaatgctagaaagtcttacattgtgaaacggatgaagtacaacgtttaaattaatccaatcaccggaattaatactagaactgagacggcaatctctagtcccgctccagcattttcatgttaacctaatcattgaattaacatttttagttagtaaaatgtcaccatcacaggggtaagtgatccaggttgttgaacatcaagcagtagacgatgtatttaacagcagtaggatccctccaaatttcaccacgagagcaacgaatcaacccgggagaggatcctgatatgcaggaacaagaaaagtgttgacgccttccatgcctaagttcatagatacaaatcgcattagcactactactaactgctggattgcggaacgagatcctctgacctatagcaatctacgtcagagggacgtccgatgctgctacgccgctcgatcggcatcaaacggatcagaggtgaacaagcacggcagataaactggcttcttttatgcccacgctgacaaaatcaacccatgagttctacgccgatagtgccgcagcgcagcatcccgcggcggcgccatccgtgttgggtgccgctttgagtgccttcgccgaccccttgccgccggggccagcacttctggccgggatttatttcgcatccccgaggcatccacgcagtactccagatggcgcaggcggtggcggtgcgctccagggcggcgtacagccgtacacactggtgttccggccacacgcacctgcgtgcgacgacgacctgcacgtcgctgtgacgccatcgttctccgcgtcggccgacgtctctgtgagcgagtaaactgttcgattttgtcagcgtgagcagtaaaagaagccagtaagtctatcgtgcttgttcccctccgtctgatgccgatcgagcgggtgtagcagcattggacgtctgtctgacgtagattgctctacgtcggaggatcccattccatttatgagtaatttcaccatttaatattttgtacctcgaggtaccataaaattttaatacctcagatactttctattgtaaaatttggtacctcaagatatctaatatctcgaggtaccaaaatttaatatgcaaaatatggtaccttgacttaccaaatgttggatggtaaaattacacaaatattttttaatatatttttaaagaattgttactaaataatttttatcagcttgtatgatcatttaatatctgaaactaaaacgtaacatgacacatatattgatctattcagttgtagtttgaagtgaactgcatacatcttttgcttttatcgtttgaattaaaatattctatcagctggattctaacgtagatttgaaatatttttcaaaatttctgatgaaaatatattaaatgaacgaattccacatgttatattccaatttcgtaaagatataatccaatttttctggttgcgaaaagcatcactactaattatggtgcttgtgtcacctttctcatcaagagcctggtattcatttcacttgacaattacttctagcttagcaattccttctcctataacatgcgataggagaaagaatagagaaacaatctgcagagttactccatgaatgccaattggggaatagaggaacatgacatcaccggggcattgcccagtcacgagcttgtgtcgtccagacctcatcagcgctactgcagcatgcagtcttgatgccttccatgtctactggatatatgatgaaatgcctctcaatatgctccatcatatagtagctatgcaagtgttagtgtgttgtgttggaaatttggtcataattcggcatattttaatccaaaataacaagataataaacatgatatttacaataggatttgatccagtgatagtggtaaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataattgatactaggcaatcattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccaatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccagagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcaatatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacatatttgtcagcttcgttcacaacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcttcttccagctctccgtttaagaaagctgtcttaatgtccatctgatggacgagaagaccatgagaggctgccagagcaagtagtactcgaatcgtgggcaagcgaaccactggtgaatatggggccaaaaagtctcccttctttgggttacccttggccaccagccttgccttggacttttcgattggaccatcaagcctaagctttttcttgaaaacccatttgcattctaccggcttgtacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatatagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcggctttatagattttaaagaaatgcaatgcctcatcctttgttttcaatagatacacatagcaaaatctagtgcaatcatctatcagtgtcatgaaatatttctttccccctttagtcaacacgccggtcatttcgcacaaatcggaatgaacaagttctagaggtgccaaattcctcgcctcaaatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgtgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcgtcagaaactccgaacttggcctcaagtgcatcccacatttccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaacatagaagcactcatcgctgtcaaccacaatagtgcacgcgctttccatctcttatagtttgaaccatcaaaggcatgt

SEQ ID NO: 61491 - DNA, 1727 bp, Oryza sativa
cagcgtctaacctggataccacgagttaatgttggcactgacagctcgtgcagcgtcggcctattagagacatacgtaagcatgttagtaccaatcggacaaaagaaaaagaaagaattgagcaggagttcgacttaccccgaggaagtagtttcggtcacagtgcgtggggtactcatctgtgacagcggcaacatgcggctatggcacggtaggagtaaaggtctattaatagtgaaatttggtaagccacaaaatcatcatcgaactggagtcagtatcggcttcagaatcctgaatcggctggtgggaattatcaagtcaccaatagattatgctcaaaggaaaaagggtgttcctgttcaaattcggaccgttctttctaaaagagattgcatattttcccagggagaatttaacagattgcagagattgttaatcattaatcatcatggttatgtgcgggatataaaccatttccattatctaaaagaatcattgtggttaggtacagtcagtgagtcgtttcaaacaatattacagtcagtgagccaataggagtgtttgtttgttgaaatttgctccggtccaataaaaagtacctcgaggaactagtacctcacggtactaaatcattttcgatcactggacctaattggacaagatgggtattgctagatccaacgatcggaaacgatttggtatcgtgaggtatcgatactttgaggtactttttttttttggactggagcaaatctcctgtcagtaaaaactctgttcttatttggttttctaacaaagctggatcaatagatataatttccaaaaaaaaaaagaagttgcgtatgtcatgcaaaatattttttttgaaataactaaagctaatttcagatggatcaggtggaacatacttttgcttatgtatatgctcattgtatttttcatttcatctcctaacgttgagtttatgccttgctgtgtcaggtggaggatcttggtaatctgatcaagctatacacagactggcattcttcgcttgattccttattactcctttgatcagtttgtgtgaaaagtcgagaaagtgggtgctagtataaacagatagaagagcaggacgatgcctttcgctcaaatgcaggagaagaaaaccgcgaagaaaagccggatgttacgagaacatacgcattagggcaaccacaatgtgcatgaaaactaaccttaagaaataaagtagtaatttttgttgtacctttgtacattgggagatgagctagggagagaatagtgctatgtgcaaccttaagcttaaggctagccataagaattaaaaaaatatatcatggctttgcaacatgcatgcacactttcaatcttgagtaaatatgtgtctttttactcaatgggtcccaccttaaggtcgagaagctaccatatacattgtagcatgtactatagataaaacaatataagaatgtgggtcccatcttatggctcaattgatctaaaacattgaggatgcccttattgcacgcgacctttatttaggcccttaaagccctgtgtttatttgtgtccaagatttccaccgacttgagctttacttccatataggctgtgtttagttggatccaaagtttggattttggttgaaattagagatgatgtgactgaaaaattatgtgtgtatgacaggttgatgtgatgcaaaagggggctgcaggaat

SEQ ID NO: 61492 - DNA, 8277 bp, Oryza sativa
catccaccccaccccaccccacccaccgttttcccctctcctcccatccccccgcacccatctcgccgtcctcctcctcctcacctcacctcgccccggatcccccatccacctcgcgacctctcctctcccctccccggcgcttcacccacggtagcaatcactcccccccaaaaccctagcccctccgatccgcccgccgctcgctggcccttccgagtcccggatcggcgcggcggccagatctgctttccccgttcgatctgactcggtttctctcttttccatccgcgtgtgtggtgtggtgttgggtttggttggtgggtgtgggtgtgtgtgtctccaggcgatggcgtcgaggctggcgcagctacggtccaaggcggcgcaggcgtcggagctcgtgtcgaagcacgggtgcgcctactacaaggaggtgatggagaagaacaagcagcacgtggtgcagccacccaccgtggagaagtgccaggagctctccaagcagctcttctacacccgcctcgccaggtgatccccggatttcacccccgctgtgcctgttcatgcggctccatttggtcgctgtttcgtagttggcggtgtgttgcgatctgttggcaattgcgcgccgggggggggggggtgttcaggcttgggtgttccgacgaatgtagcttggcacgatcgaaaattcgccaataattggtgggtatccaaattatcgtgcctccgattactctagtttaacctgaatttggtatggcttgctctgctcatggtctgcaatttgggtagtcagggtgagcctacatagtggttagtagatttcgctagacgatgggttttttttttgttgtctggtagtctggttgtgcacttgtgcttttgttgttgtcatgacctattaggggtttgagagctcccttccatacttgcactttataaatcttaatcatttgagttgaccatttgttcacacgctcctccctttatgaattgtgcttgtgtaacttgttgcatgtataaacttcggagagctcgtaaccatgtgttatgaggctgtttgaatgttttggcctgtgggatgcgtgatgttctccttgaaatacgctacctgctagtacattgttttggtcagacttgctatgctcaataatttggtgaaagaggataggcacagtattaattatggaactacttattaagagtgcatttcatctggtcatgcaggcactgagttctgtaagacccataatctgtcagttttgaaagtttgtaacaaaagaaacctatgcaataagtatgatatacctgaggctcttactgtatattccttgttacctttgtatttttgcttggatccatggttcatgaagacatagaacgatgcattactgttaggcgaaagtgtgagaagtcaaatacaccgagtgaaatgtgaaatctattgtggatgatacataatgacaaaatggaatggtatgtattttgtatgatttaagaaatgaacttatatcaatattgctgtggtaattacattagcagtttgttcagtatgtttgaaattatttcttgtttgtttgtttctgcagaaaaggcattgcagtaaaatctattaccaatttactttatgggatttacctaattactatgaactataatacaaaatctacattagtccattgtctgttctgagaatgttatagaggtacagctctgtcataaatctgtaggataagatgaatgcttttctgggcctcagtcttctattctttttcacttggcaaccagctgtgtttagaataaaaaaagtgacaacaattcaagtgtggatgcaatattaggctttatcacggaaaagttatttcttgaatcccaatccagtggccgcactttagcctgctttattattgtgacgaacattgttttttctgattgctgtataatgatgctaatccttgtttgtgtacatggtttgatgagtggtgttgttcagtgtgggagctgatgacagaacaaactggctaggtcagtgatcactgatcagtctggtttacagaactttgttgtatacatgatgtgcaaccaataacatgcgatttagttagtatcttgtctgcaatgtttcaagtcatgattgataattctggctagcaatcacgtctgttaaattaaggctgagcaatttcttcacgtgttataaattgatgttgaaatgttttgaggttggtcaggagcagctattatttttatttttacacgtttttgcattagaattttgtatgttgtttccattttttttcattagggctcttaatcaaggcactatctccaatactgtagcagatggtgtaccttttgaccatcttctgctgtgatgttagaattagggctcaccaggttgaaactatactggtcaattcaggctggtccaaagagcatgcatgagacaatgagatggacgggacacatcttctgtgatttgccggtgcccatgtctacctatcatgagggaaatgaacggattgacgaactttgggtaaactggatttgtttactcttaactttgaatgattaattaagatgtcatgttagcccttagatgcatatgcatagggaccagtcacgtgcttgttgtggattgttggatggagaagttgcaaggtctgcacttgataggcaaagcaattgtgcatgtatttatgaatgtgtatcaacttgggtggagcattgtgcttttaacctttttttctttttctttttttttggggggtggggtggggggggggtgtctgccatattttcttgaacaagtcaagtcatcgattctgcattgtgaatatgccttcgttactatgcttgtttactttggagctctgatctcaatgacttatatggctgttgttttcttcagtttgccaggccgctatgaggcattttggaaggaatttgatggtgtcaagcaggtatggaagaatagaaaggagctcaaggtagaggaccttggaattgtgacattatttggagttgagctttatgcgtggttctgcgtaggcgagattgttggcagaggattcaccataaccggctataaggtctagaagagttctgattaagacctggtttataaaatacactgttagctgatgcttgtcgaaatgacaaagatacctcctgccttttcacaattttgtttatggaaagtctttctagtgctggatgtcagccaagacgagcacatcgttgcaacactgcttcaataatttgctcgatctctcgattgccattttggtgtcctgtaatgtgaaatactgaaattccatcttgccccacccgtcaaattgtcatttatttgttctcttgaatccatctcaaactgcaagactcaagtttgtcgctcgttcaaaatgcctttctgttgatgttggcatatacatcatgttgtgcagctagaaacgatgaaagcgtcagtactgttctattgctcgttagagtttgctttaaacaatgaatatctaattatcttacttatagaaccggggtcttcctgaataccggcacttttatttccaaatcactagtacttcctcggtaacagccaggctaacaacaacctaacgtagatcaaccgggacaagctctacaggagaacgtggcgacaaagctagcagaaaaatggtaaaaaagaaaagaaaagctgttcctaaggtgagttgggtgggcttcagttgtatagcagcactaggaaagtagtgaagctgctgcttgccagtacgaggatccagcccttgctcgccccgcacatcctctccgccgccgccgcccccttcctggtgaagaggaacagcaccctgtcgcacgccagcttgaacagcgccaggcacgcgaagaagaggctgatggacagcacggccagctccttgttctgcatcgtctcctggatgctcctcatctcctcgacattcgacctgcacccaacacaacaattctcatcaagaatccgtagcgccttctgcgaacaaatggagaatcgcagctggagagacagagagcttgcctcatcgcctcgttgtctctgatgagatcgtccagcttgccggacacggctgacctccactccttgagctcgccgagatccttggcctgatcaacaacaacaaatggcaaagcgaatttggtggattaattttatgatgacaagtttcagctgtcgtcaacaagctacaggaatcaatcaatggtgatggttttgtaccacgttgcccttccactcaacgaggtcgcggacgtcggccttcatcctgtcgagcgccatggtcgtctgggagaggccggtgtggaggtcgggcagcttggcgccgtaccggtggttgagcgccttggtgtagtcctccagcgttgagaggcccagctccagggaccgcatcttctgcatcatgatcttgagcacggcgtcgccgtggaaccgccccgccgcggccggcttcccgtcgccggccaccgtcatcctcgagccgttgttcttggcgcccgcgccgtcgccggcgctgtcgttccggccggcggcgcttcctcctcctcctcccacgccgtccagccttgcgttgacctgcgcggtgtcgttgcggagggtgccgccgtcgccgccctcttcggccttggcggcggcggaggcgtcggtgtcggcgccggagccggagatgatctcctgcagcatctgctcgacggcgtcgatgccgtacacctcgaggtagctgaggatgcagtagaagccggagccgtagtgggtggcgaggcggaggcggaggtagcgcgtccaccgggggtccggcagcacgaagcgctgcgcgtgcttggcgttgtcggcggtgaagcggccgagcagctcccactcctccgccggcgccgggtagctcgggctgccgtacagctcgaagtccttgaagttggaggagtagtgctccaggttggcgaggccgatggtgcgcaccagcgtctcctccgacagctcgacgtcgacgaacttgtcgtcggcggagcacgggttgcgcaggtaccggtccttgtcgccgccgaggatgttggcggcgcccttggcctccctgttgtgggcgagcaccttggcacccttggacgccgccgcgtagttgtactccgcgccgctcggctccagccggtgggccgccggcgtcgcgccgtcggggacgcggccgttctcggccttgccctgcaggatccggctccggaactcgtcgagctcatcgagcgccgccgcctccgctgacgatttgccgccggttgtgttgttgaacggctccaggctccggtggtcagtttcctgctgcggctgatccggcgggtgcaacgatggctggcacgtgggcgcggccgcggaggcgttatactcggtcgggaaaatgtaggcctccagcggcattaccttgcagtagttttcgcgcattccgtcctccacgtcgtcgtagaaatctacaatcaatcaaacgccatgggtgacatgacgacattgatcgatcgatccatgagcatgagaggaggtggatcgtggtgggtacgtacctgaagggtcggtctggctgtggaggaactgggagcgaaggaggaagaggaggcaccagacggaaaagacgacagagagggacacctcgcggaggccgccgtccatggacagcgcatcggtcacggccggcgggtcgcagccgccgtttcctccgccgcctccttctctcctcttcttgctcatgcatacacctgcgcgcgccttcctcctgcttgctgtgccaaagcgctaaccacgtacgccgctgcacgctctcagtacaaaccttgcctctgcctgcctacccgaacgacgtacgcgcggcgcggtggatcgatcggtctcgcggacatgcactacgagtggattcgggagatgagcgaggggtgcgcgagggagattgggacggggagcaggagccagcggtggagcggcaacgtcggagcggagctaggggcgcgtgcggaccgagcacgcgctgcgccgaggcgacttggccggtgcccggtgatgcccacggctgtctcggcgcgtgtgaactgttcaaattatcatggtaagtgccacgtcaatatcacgtgggacgaagacttagtcaaagaaaccacgtaggcgtcacgtcagctaaaacagaacacaatactgtcgagagacatcgtttgcacggttttatcggttgaagaatgcgttgtacctcgttttgcactcaagagactcgcgacaaattgaggaacctaaagtatacttattcctttgggcgaggtggtggcccagtgaaacgtgggccgaggcctaggcccttcttctggtgaaaacgatgagaatatgaaccgtgggctggtagcccagtatatgcctgtatgtgacaggattaagtccactgttactccctcaattcgtatccctcaaccataatacaagtatcttaaccctcaaactattgaaactagtttaaaactttaaattgactcactcgacaatttttgagactaatatagctcgttgacctggactaactagcttagtaagcacgcgtgacccacatatcagtgtcacatatttcttctcctctcctcctcttctctttgttccctcttctttccctcataggcatacagcgatgacactgactagctcgactaggggggacggccatcggcagcttcagcgggccaagagcagagcagaggagaaggcatggtagaaggaaggaaagcggcccttggcatggccttctggccacgtcggggtgccgtcgtcgtcgtcgccctgccgccgccctcctcacgagccgttgcgccacctccttctccggcattggtagcgccgccctccacgatgacgatgcagccccgtgctcgcattctccaattgatctggcgatcgagctctcggagggcctccacatctccgcgcagccccgccgctttgcctccgctttgaactccaccaagctcccttgctcgatctgcctccgacttgagggccttgtcatgcaccgcaacagtgagcggaagagcatgaagaaagatatgtgggcgactttggggaggaggtccttgggctacgggctggtggcggcggcggagatccacgcgaaagggcgatcgatctgcctcagtccccatcaggattggaaatttcggaccgaaatttcggtcatttcgaccccctccgatacgatattatttcgaccaaaatttttaaattttttcatgaattttggtaatatttgttcaaattcaactaaaatttgtccaaaatttcggaagtttcggaccgaaattctgaaatttcgatatttcggtggtggccgatcaaatcggttaaaccttttcggtttaacctggtccccatcacggcggagcgaaacctcgcggagcggcttgtcggtggtgaggcgccagaggcagacggcaacgcgctggggcacagggatggaggcgtgcaccgtgcagtgtggtgtactccttggtgacgacggtggccaggtggtcgcaaagcttgtcaaacactgcgcacggcatgcggaaggctcgccggaagtccgtcgggctcctgcagcatcgccagccaagcgcccgagcaacctctattcgtacatgctctttgccacgtcctctgtcttgctgcatcccgttgtcgccctgaactcaactgctatattatgcacgatgccacctactcacacctaggggtgaaatgggcgggtatttcccgcccgcccacccgacccgaggctcacgggaggaatatgggagaaataatgggatatccgatattatccgagttcgaaacctattttgttagaaaatatggtttaggatacgggaaaacatgtatcgcctgtatgtcccatattataaaatatatatgaaaatgtattataaatgcacctataaacatgataaaagtttgattaatcgctattttacgagctcacatgcaatattatataatttttctcttgatgtatctcttttaatttgttaattaccttattatatttaagagtacattacattgacattgacggtacgcgaacttatgcagtgggtgcaatagtacaaaacttgaaaaactctcgtttcggtacacaaatttgtgtagtgcgtgcgaagcaaggccaatacatacatgacttcattgccaatcttattgagttggcttgtgattaggatgccacatcaacgctacacacgttatgtggggcgtga

SEQ ID NO: 61493 - DNA, 1305 bp, Oryza sativa
ccctactcctgtttggggatttgaatccgctgggtgtgtattgatctgacgatcaggttgtctcatgccccctagaggcctcctgcccaccttatataggatggggggcaggattacaaaatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacaggcctactatttttttaaatttattgatgattggattgtcatgtagacaccacgtcaccaaaaccactctcgaaacagcctaggaagtcgttttgaatggttttaatacttgggacattatacatgattttacggttgagggatatgaattagatccaacctatatttaaggaagtcatcttggacttaacatgcgtacaaaattgcaaaaatgatgatagatatcgttctgagtttaagattttcccctaaaaagggtttgctgcaaataccacttctctctcctaactcacctttgcttttgaaatccccccacccccaaaatgttgttgcttgcccattcttgtaatcgcaaaccccatatacacccatatacgctcatatgaatactattagatgaggagctatggttgtcactcataagtcatgccctatatgatatgattgtggcattcccagtgatggcgcccaacacttcattggacagtggttgtcatgagtcttcactcttggacatcttagtcactaatgaactgttgcgcttgcctcttggggttcggtgagatatgtttagggacatgtacatcaatatatgcactaaattgtataacacatgcggaaagacaaaaaagaaacacacaagcaaaggcaattggggagaggtatcaaactggtgaattaagaggggttatttgcaataaaccatcttatatagggaatcataaaacttaagagaaatttgcatatatgctactcgaaaaaactagcttcgctagaatggcactctcaaaatgggattcaaccaaatgccactatcaatctgggggcattcgctgaaatgccaccttcgggcctttttctatttcaaaaatatttttcatcaattttagtttttctcggacgtttatgcccctaagtcaactgctgaatcgtacgttgaatcgattgacagtttcttctctgtttctctgggctgcaggaa

SEQ ID NO: 61494 - DNA, 60255 bp, Oryza sativa
gtggagtctggtgaggcgctgggaggtccatgatggccagcgaggagcggcgtggtgcatcaaggcggcggtcgacgaggagcagtgggcacatgaaggtggccatcggcgaggcggcacggctagatccggcgtttcctcgcttggatggcgcctcctggcctcgtttcgccatctggtcggagtggaaccgtcatcgagaaggcagggtggagctcgccggcgcatacggagcggaggtggctagccaggtagttggggagcggccggcgaggaggctggttggagctcggcggtgcagatggagggttagctgcagcgacaagactccgtggtaacgagaaaattgcatatctaccatcgcataagtttggattcgctgaaataccatcccttgatcaggcttcgctagaataccatcctcaaccaggacatctttgctaaaataccatcttagacaaaaatgttagaacaattgggctaggcccgatttattctattaaatctcaaaggcccataataagtgttaaggataataataccacctcaggaattaagcgagaagtacctcaacttaaatagggagttatcggaggctccctgttgaccggttgaggtgggaatcggaaagccacacgcgcgcgccgagccgagctggggcatggcgggcgtcacgtcagtctctatccttttgctaccacgatcccacattcccacgactgcctccgttacggtgcgtgcacgatcgcacgataccacgatcccacgacgcgcgtgcggcaactgggggatatctctcctgctatataaggaggccgctagtccgatcaaaacgattcgcttgctttctctcgctggtgttcttcctcctccgtgtgcctgtgctgcctctgtttcgcttcctcgcttctgatcgcttgcgcgcacgagagatcggatcggaaggagcagggcctccggaaccacaccttccgactgcctccgtaacggcgcgtgcacgatcgcacgataccacgatcccacgacgcgcgtgcggcaactggcggatatctctcctgctatataaggaggccgctagtccgatcaaaacgattcgcttgctttctctcactggtgttcttcctcctccgctcgcctgtgctgcctctgtttcgcttcctcgcttctgatcgcttgcgcgcacgagagatcggatcggaaggagcagggcctccggaaccacaatttcgcccgctagtccgatcagaacgattcgcttgctttctctcgctggtgttcttcctcctccgcgcgcctgtgctgcctctgtttcgcttcctcgcttctgatcgcttgcgcgcacgagagatcggaaggagcagggcctccggaaccacaccttcgcctgagatctgcaccgggtaggcgggtgatcaggtttttggggagtgctttgtcacgcccagaaatttaacccaaatttccagactattttgcgtagtaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccacaggcaaaactcaactggggtgtgagccttggtcctctaactccatcttcagctcagaagcactacacttctgaaaagggagaataaaagcaaggctgagtacaaccaccgtactcagcaagccacaccaacgacgcagacgtgcaaagggatacaaggatggtttgtggctatttgcataaaggcggttgtaaaacattttattgagcaaaatagtaaaactgttgagtaattaaagtaacattaaatctccactgatcaacgctacaccacgttgaacaggcccaaccaacccacctaaactacagtgtattgggttgatttattaagtgtgagactaatcacggtgaatctggtcgaccgcccataaccgcgggcacggctattcgaatagttttactctgatcagaggtgtacaactgtacccacaagacacagccccacaacacgtttccgtgcgccgacatgccaccacgacataccggaaagaggccgtgacaggacccttcgcataaccccctctaaccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgtagctcactctgatactaaaaaggtctaatactgcaattatcccatcaactgagctagtggtaattaagcatggctaagcatatagttctagctaggtcacataagtaacatgagctagtcgattcattacccaaagttgacaaagaacagatatcaagtaaacatggcacaagcgagcagataggtaataccctgaccccatgtaattagcaaaatatgcatatttatttgcaaatagtaaaacatttgtaaattgggatcaacatgctcaaggggaatgtgtgacttgcctcgcttcttcactttgatcttccgaactcttttcctcgcgaccgcggacttccgaaacgacggaaactacacgctggcacgcaaaacgaggaaaaactctaataaaaaccaaggaaacagtacataaaaagtaaacaaacatgtagagctcaattttagatgcattttgcaagttgaatggctcaattcggagttcgaatgaattagatatgaattttagaagttttgagccatttatatgaatttctagaattaaactcgatttattgcgcaattattatttatttttacaaaggaaaagacggttgctgacgtcatcaaaggggaggggcggcgccggcaagcgggccccaccggtcagcggcacaagggcgccggtccaccgtggaccgggaccaccgaggcggtccaccgccggtccacgggaaccgacggcccggatcggcccaaagccgatcggacggccacgaggcggcgcggctggggcacgggcacggcatgaaaccggctcggccgagccatggcgcggcggcggcatgcggccaccggcggcagcagccggcgacgtggaacggcggcgggcggccgtaggacagcggcgcgcactgggacggcgacgcaccccaagaggcggaggtcggcaagaaaggggaacgggaaaaaaaggaagggagaagaggtcctcaccggaagcggcggccggcgcggaggaagatgacggcgacgacgattgcccgatggcggcttgcgaggacggagggcggatggggtcgcccttgaccttcagaaggagaagagggagttagggaggggaggaccgatgcggggtgaccggtaacgacggccgaccgcgacaatgtgagaaggatctcaccgacgaccgaggaaggaggagctccggcggatttccggcgaagaggggcggcggccgaggtcctcctcgtcccagcggagctgagggaggcaacggtgcgggtcggcgtcgaccgaagcggcggcgcgacgcggctggagtcggtggcggcgacggagagaggtggttcgcgtggctacggcgctacggaggtggagaggggaaatggagcggtggccgagcttgcctgtccggcggcaaagctggcggtggcggcggagcggtgcggcggcgaccctagcgacgggaaacggcggccggagttcgccgaagtgtggcggcgcgcgggagcggcgtagggagagcgagggagagagtgccgggctcgggaaacaaggggaaatggacgaggggagcacgggggtgctttttatgggctcgggaaggcgggatcgggaccggacgtggcggaatcggccggcgaagtggggcgccgacgtggggtggtggaggggttaaccggcgccgattttcgcggggagagtgggggaaagggcgcagacgtgggcggcgaggtcccacggacaagcgcgcgcgcgcggggtggaggaggtgggcggaaacggcggcgtcgtggggcggctcgggcggccatggcggcagttggggatggagctggaggtaggagatgacatgtggggtccacggatcccacctgtcggagagagagggagggagagttggaagggggacgtaaaacagacttcgcgagggagaggggaaacgggccgacggcccaagagaggggagggaggccggccgggagagggagagagagggaacgggccgcgggagggaaagggaattgggccggggcggcccaaagagagaaaggaggattttatttgttttctttttattttaattgattaaatgaactttgtgctattaaaactatttctcgagctccgaaaattcacggaaaattccggagagtacattagggcacaaagaatattacaaaatattcccggccaataatttttaaaggaaatttttaatttcctctataatttcacttgattaaattgatttaacttttaatataatttcttgaaatgcattattaattgatttttaatctcaaacgaaaatcggggcgttacatgcttcccgcacgactgctctgttcatcgttgtctcgtcgtccaccatgtctgcacctggaaccgatggcgtgcctggagccggagccgccgctgccgccgtctctggagatggcgctccgggagccggagccgttgcgaacgtcaacatcgacggaggcagttctgcctcacaatccagcggagggccattctcggggtatgtctctctcctactgtcgttcatacctctgtttgttctgttagtcgcattgcgttcttggtatgttcatgatgcttatgatactgtaagcatacttctggttatgctaaatgttgtcacttgatcaccccacattgttcatgccatgattattgtcttaaaattttggattaaaatatgccgatatatgaccatatttccaacaaaaaatagccctgattcttcttcttcctcactccaaccagaagagctcaccggcatccaccgccgtgccattggtgccaccttgccggcggtgatgctggcacggccctccccatcgtcctcgccttccatcctgcccaccgcgctggtgtgaggagaccgcagctgacgtcgacagagccggggagtcaaccggggagtgggtcgacggagacgaactcaccggcgacaagggcggcgcgtcgaggcgggcggacgaactcgccgacggtgggggcggcacgtcgacggtggccagccgaggcgacgccagcgaggcagcgacaggccgagacgacgcacgcggcggcgaccgaccgacacgacacgggcggcgagtcgggacggggcggcggcgcgacggaggccggccgagacgacgcgggcgacggcggccggcgagtcgggacggggcggcaacgcgacggaggccggtcgagtggcggggcggcggcgcgacggcgcgcggccgagacgacgcgagctggcgcgtcctcgtctcacctgccgctgccgtgtcgaaggtggaagatgaagaagcggggcattttcctctgtgatggtattttgacaaacacacctagttaagaggggtattctagcgaaacactttttagtgatgatattccagcgaatccaaacttatgcgatggtagatatgcaattttctccgtggtaacgtgagtggctgctggaactgaagcttcccggcggcggcaatgtggagatctctcgatggtggtggcacttggtggcactagtggctgttgaatcggagctacacgaggttggcggagacaatggagttggtggtggcgaagggcagcgatggtaccgtgtctctgatggcgagggctggcaacggacagcgatggtggctagccctcccccgtgacggcgagccagttcatcccgtgaccgtggtggatgattggttcgatgacggcagatgaagttggcggtggtggaggctctcgttggcaacgtcctagttgtggcggcaactaggcgagctccagcaccagatctgactgtagccaagccagatagtagaacggtggtcgtcggtgacatagatggttgatggtgtcgtcaactttgaagacaacggctgcggaagctattagcagcgatgccctagtggtgacggctagcaagtgacgtcggcaccaagatctgactgcggataggtgtggtcggcggtggaacatcttcgacgagctcatggcagtaaaatgcgaagtggcattgcagcttcacggcgcactaggggcgttcggaatgcggcggtggcgtaaggggatttggatgacgacaacggatagaaggcacgacaaatggcagcagatgttggttgtgatatgcggaggcggagatggtgtagtgtaacatcctgaaaattcccaacaataaaaaaaaatcactaaaattttgaactttttaaaacttttgcatcatgctggttgttatgattgctattgcttgccaaaccgtaaataattacaaagaaagcaaacccaaacaaagggaaggttaattactaatttaatttatagttcaaatattaaatattcggaccatgttgatagcttgatgccatgattagctaaaagaaacagtaaaatcaaatccaattcatttgaatccaatcccacatgaaatataggaacacatgaaatgatgatcaccactataatgatcgtgtttataaataagtaattcaccggaatatatagattgatacttacaacatttcaccgaattcctcgtgacatgaaaatcactcatataaaataatggtcatataaataaattaagctttatatataaataagaatatgtgagtgtttaattagacaattagattaatattgtaccgagtctcaatttatatttatcgaattactagatccacgtaaaatacattattatacaaataagttcattcaatgtgctattgtaatagtaatggccacattaggatattttaattaattttggaaccctcaaagcctccaaaatttttctaggttaattttagaattagacctcatttaaataatataatagaaaaatatatataaaaataaaatatgagtaatattaatctagggtgaattcattagttaagataacacaaatattgagtaaaatgcatatatgcaaaattaggaattgtggaatcaaatttatatggaaaatacactaaaatcggactaattagaaaacggcactgttcattagccccctaggtgttcgatttggttcctagccatccgccctcttcctccccactgctgcgccgccctagccggccttgagccccgagccgccatcgccgtctcgtcgtgccatcgccattccatcaccctcacccgtcgccatcgtgccgcgccgcgcgccgtctcgtcgacgatgccgcgccgcgtgccgtcgccatcgcgtcccgtccctgctgccgccgtgccgctggcgcctgccgcgccgcgcgccgctcggccgtcgccgtcgcgcctcgcgcctcgtaccaccgcgcgccatcgccgttgctgccgcgtcgtcgtcgccgttgttgtcgcgtcatcgcaccccgcgccgcgccgcccgctgtcgcgtcgccgctgccgcccgtcgcgtcgccttgcgccccgtgccgccgctgccgcgctgtcgccgtcaccgtcgcgtcccgcctcgtgccgcgcgccaccgctgccgccccgtcatcgcccgctcgtcgcgcgcgccgccgccgctgccgcgccgtcaccgtcgcgtcgccgtcggcctcgcgccttgagccgccgcgcgcccgtcccctcgccgtcgccctgcgccactgccgcgccgcccgttccatcgcgccgagccccgtgccgccgcgcgcgtcgcgtcgcctcgtctgtcaggacgctcgcttgccacccgccgcgtcgccgtcccatcgccgcgcgccgtcaccatcgccgcgtcgagccccacgccacccgtcacatcgcccgtctcgagccccgcaccgccgcccgtcgcatcgccgctccgagccccgcgccgccatcgcgtcgccgcccgcgcgtcgccgtcgtcccgagccccgtgcgccgctgtcgcgtcgccattaagccgccgccctttcccctctccttctccccctcttccctataaataccccaccccctctccactttcccccactccatttccctcctcctcccctcttccctctccaccgcgccgccgctctcgtgccactgcgccgccgccctcgtgccgcctcgctgccgccctcgaagccgccacaccgcgccgtgtgccgtgccgagcgtcgcctcgccttgcgccgccgtcgccgccgccgtcgtcggtaagccgccgccccttccctcgttccgccgccgtcgccgccccgggtagcctgagccgagagagagagagagaggaagggagaaagaagccgggagggaggaaagaaagagaagaaagggaaaaagaaagagaggaagagagaaaaaagaaagagagaggaaggggagaaaagaaagaaaagaaaagaaaagaggaaaagaaaagaaaggagaggaaaaaggaaagaaaagaaaagagaagaaaagaaaagagagagagagggaaaagaaaagggaaaaatttagggggaaatttaaaatatttacaaatattagaatttaattataggattaatgaaaatataattagatgaaatcttactaattaaatacctaaaatactagcatttaaatataggattaatgaaaatataattggatgaattcctatagattatagatataatgctcgggtagattaaattaaaaacttatactaacaaaatatttatacccgcaaaatagtttaggatgtataaatcgaaaatggatattgtacagtggcataattatctttaacatgtcttgtcactgtagcaactaaataaattagttataatcaatccttccaatttatgggtgtataggaaaatattagtgccatttactagtctatgtccaaatataactaaatccatgacttataaattgtttacataaagtttagcctcatattttgtaactaaaatataaacacacatagatgaatctttaacttgtttaggagagtaatcacagagctagttgtatttggaccacttaaaaatttgtcgatacaatgtcatgtgaagtagaacatatgtatataatcgattgatatccattagttaaccaaacagagccatcttaaaatcaacatgtattgtatagcttacagtaaaaatcaactactcaaatatatgatccaataataagatattgttgcttacgcatatactatacatcccattatagtagtacggtatagtattaatttgcgtgttgcatatattaaattaagagggagtgtatgacaaaaatgtatattggataaatactagttataaatcttgaccccatataattataattatagttcaactgtaaattaggattattcattgtaaaattatgtgatgggataatctgtaaccataatatgattaacctaaacaactctaacatagaaagcatggatgattattaaccttttgtaatttattgcgacaagtgaaatatgttcataattaaagtaaagcctccatcaattaaataataatacaaatgattcattatttgattgatcctaaatccatccgacaacagaacctctagtatacgaccattttatttaggtagatgcatgtgtagccataatccttccatagccattagctagactacaccacatattagccagatacgtatctcatttatactacattgattagctcctgaatagaccaccaagacaacagaaagattaagtagcccttagcatgttggaatccattagcaaacgcgaataatatgagcaaccttaggttcgacctcaacaaatatattttgtttgtacatatttgattgttatttgaatattggtttttctcgcgtattatagaatttgtatatcggttagtcgtgaggcaacgtatgcagcttccaggaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcctacttgtgattatgccatgccttgattattgtttaccccttattccttcgtaaccatgtttacgtatgagtccctagtcaattatgacaactgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgttcccggtcaattaaggaccgagccatggagttaagcgtgaaacgacccccgtacaaccgtacttctcgaatgggtatagacctagcggattagatagccgagcggaggcagtatccctgcatagatggttcacccctgagtgaggcaggtgcgctacaatgggacagccgttgaggtagggccgagaggcgtgccctacatcggtgtcaccattggtaggactgccatgagtgtgtgagagagagaacttaacttgaaccataatttaatatgcgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattgcacttggctagactccaaattcttaacttgtgggggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatgctaggtcttaggcttatgaaaagaattgaaaaattagctttatgcaaaagaacctgaagcctttccttgaaataccttctatcatacgcattgttgttgtggtggcttgctgagtacggttggtactcacccttgctatttatatatcttttaggagagtgttgaagagaagcccttgtcggtacgcttgcgtatcccacaagatgattggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacagataaacacagaagatttccgatttccaaaatcgggggtcgacatgtagcgacgggctatggggtctagttccagttctccctttcctcttgtgctataacaaaaagagtatgtcatgtttgaagtttgaagctaagtcttctagtagcttttctttcttgtgttttatgttttcctctatagggggtttagagtctaagaacccatgtatgttttagctatgtatatccttcatggatatagaggccggattaatgaaaatccattatctaaaaaaatatggggcatttgcaaatttgctaccggttttttcaatattgcaaggatgccattcgaatgacagttctagtggtatttttgcaattttctagtggcagttttgcaataacgattcaaagtagtggtaaatttgcaattgccccaaaaaatatagctttgacattgtcctactagagctacttactggtaagatggccttcaaccttgaagggcctgaaaatgagaggagcctttccttgagcttcttgtgtgccatggaggagggaagactcatggacattataggtcatcacattcaaactgatgagaatgctggggtgctcgaggaggttgccaaccttgcaagccggtgcctggagatgatcggcaataaccgcccgtcgatgagagatgtcgctgacaaatttggccggctgaggaaggtcatgcagcacccatgggcgcagcatgacccggaggagatggtgcaacattcaaaatagagaaattgcaacatccaaaattcattgtctgcaacatataataagacatggtttgcaacatcttcactagctcttcaccagcctcactttcatcagtgccggctccaacctctccacctcctcaaacagtggtgagcaacactgagatggagacggtgactgcaggaatccccaacctaaagcaatctcccaatatcccttcccctctctagtctccatggcagccctcccgcagatccaatgctctaaagttgtgggtggctagatctgcccagaggagatcccgtgaagattaaggaggagaagaagttaggagaggagagggagcgggtagagaggagaacaatgggggaaacgtcctagatgacggtgacgaggatagagtagagagaaatgagcgagaggggagaagcgggcaagatgggtggggtctacgagcgtccgttgtccgagggattctctcgcatcggatggtcaatcaaaagcatttcccccctttcagtgatgtctctacaaagaaatcttcttttacacatattttaccgcatttgtggctttgtgtgtgtggttttcccttatgttgttgatgatatccgtggatttgacacaagggttcacccacaataagatccaaccatagtgtttcctgtacgtcgaagcaacttattgtactagcaactcagcttctcaaaatttaggtacattaaaaataggcttgcgcacatttaagcacaatacatcacagaagtcttttattcatatataatcatatataaaccacgtacgtatatagcgaatgtaatacaacacaaataaatgtatacgacactgacagaggtataacggggcactagtgtggtaaacccttggacctagtccaagcacatacacatgcacactatatatgtatagttatatagtgattgaaagaaatatcacccttaggtcttgttcggttcattcccaagagagagattagagagaattgaggggattaattccacacctcaataaatgtgaaattattctcctacaaatctcacttaacttcttgttgagggattaaacgaatagacctaggggtgaatttatcatgagcactgatccaaccatatatccaaggatatattcatatgtagataatatatatcatatgtggacataaactccgatagagtccacaagtgctcccgcgcgtccgaagaaaccaaccacactgccgctctgcagcgggaggctaaaagcagttccaccaccttgtccaaaattataagtggtgacattggtgacaattttaaggtttgtcacgacgttggtaaaagttccggagattcccttcacgaattcctgagatccaagtgtaatctgtatgcaaggacgtgcggaaatatcatcattaattgatttccaccagtgaatgaacttgaataacactcccttattttctttatatatgatgcttattagttttaacactaagcaatgtcatatatataagaaaaaaaaaagagagaaaggaacatgtattaacgggcagcaatcattatattcaggaagaatattaatgggcagcaatcataatattcaattttaactgtgctaactagctaactactggcactacgtgttgtttaaggtcaatacatatgacatgcatctacacatatactttctccagttttataattcttaatattttgaacaaagttcaatccaacttttataacttttattatcaataactttaaaaatatttaaaaatatttagtttaatttgaagtcgcttaaccaacatatatagaaactagtcctaaaaattactataaacaaaagtaaatatttatttattatgtataatataacagaaaattatagttaaaaacatttttttagaccatatcgttgttcaaaacgtcaaaaattatataactgaaagagtagcgctatagggtttacaaattaactgctaccttcgtccctgaaagattatttttaactataaatccagattcatggttgaaaacagagccttttatgaaactaaaaacataatatattattatattatatgtaccgtagttggatttccaccgccaccaccccaaggacctgcaagatgttccttcccatctgtgccaatgtatgtaaaggcaatagcatcaatggctgcaccactacggattgtcacgcttttcaagctccttgggagtacagataggtctacacgacctcctccatttccaccccatgtcccgatcttaacaagttgtgtggtctgcaaataaaacacatcaatgattatgacacatatgcaatagtgtgcatgttcagaggcaaatcttaacgatgcaattaaaacacgcagcatttcagaaaataaaaaaaaatattaaagaaaaaaggtataagagtgctacttaataattagctaaccattttaatttgtagcctctgtcctactatgtatctgtgactagttgtactgctatggttgcaaccagtgagcgcctcctatttatagtgctggatatataagcatgcagacataacaaatcttatccaaaacaacaaagcaaaattttgttttatcaacttgcgaattgtgaaggtttactagcttcttccttagaagcaacatttttctcacctcattccacaaaccttttttactgttgtgatacatagttgaccttaatatcttcctttgtggctagcttaatctgttcataaaaacggcatcacgtccatttagacagattatctgctatattttggactaatgtctgatcttaacgatatatatctgacgatggacttcatcgatgcaagcatctgccgtttgcgtgaggtttaacctggtcaaatcccaaccctgcaatcaatccattacctgctcccctaccaaacctttactctaatcgtaaactgaggctaattaatccactctgcgttaaattcgtattctgtgatcaaaactaatgatcagctaggtgcctatactgtataataggactgtagtgtcagcacaagagatgcacactttgggaagggcatgtttaatatgtctacatgtataatctcaatcacagtgtgaacacatgcataatccatgctggagtacaagctagccaattcctttgggagaaaaatatgaagattacaattaatgtgagtgccacattgcatgggaacgggttttcaatcaatatgctacaaacgtggtcatctctgaagccatataacggcaaaattggttacgtagcatggaaagttcccatttttattttttagcaccgtcctatttttatattttagcaccgaacattcacggtttactttaatagcatcaaaagatagctcatatttaacgctccgttcacatttccgttagaatcgctctccacttatacatacatacatacatacatacatacatacatacatacatatatatacatatatatacatatatatacatatatatatacacacacacacatatatacacatatatatacacatatatacacatatatagatatgtatacatatatatatatgtatacatatatatatatataggacactcatatggggcaccatggtgcccgggcaccatggtatgaaatacacaaattcgcctaaatttttcaaaattttcaaattgtgagtatatacctagttataagtattcgattcatacctatacctagcaacaaaacaactcaaatttaactttatttcacaatccattattacgtacctaactaattatatgtttggatgctatatacctagaatcaaaatctaacaaaagcaagtttgaattcagttcaaacttgctttgaactagttagtaaagtagttaacgttaatacctaaatatttgaaaaagtttcatactcatttgaattgggtatatagtaaatttcaatcatggtgcccgggcaccatggagcaccaaacaaatttactatatatatatgtatacatatatatgtatacatacatatatgtgtacatatatatatatatatatatatatatatatatatatatatatatatatatatatatatatatatgtatatatatatatatatatatatatatatatatatatatatatatatatatatgtatatatatatatatatgtatatatatatatatgtgtgtatgtatatatatatatatatatatatatatatatatatatatatatatatatatatatatagtaaaattaactggggcaccatggagcccgggctccaagattcaaattgagtatatacctaatttaaatgagtatgaattttttttaaatgtttaggtatgaacattaacttgtttactaacaagcacccaatcacaattagccatcataccagcacagggtacttcaacaccaacaaaatacactcctcctgctgcaacagatgagacaccaactagcaaatcaagctccttagtatttaccaaaaaaaaaagcattattgtctcaagctaactctatgccatctcacactgcaaagacctctaccgatagtaaggtatccttctcaatgcctactcttgcacttcctctgctataacctaattttcctaaatatctggagatacactctgacctattgactaactgtgcaaggcaaaaattggcacacatcatgaagagaagatctcacaaagtgcatctttaattgcaattgttccccatgatacttcggataaggtattcctgctctttcttttcataacctaatccatcaatttctgaaaaaaaatacttcttctacaaggcaaaggtcaccactgaatctccagatgagtctccacaggcagatccttcactggcgccaaagagcacacccaaaaaaaggtctgtaaaactttcagttcaaagttacaataataaacatttcttgcacacattgtatttgacatatccttataatgaacagagctagacctgcagaaaccaccacaattgccaaaaaaaattgttcaaggatagtacccagaagaaacccactgacaggttaattctgaataactcagctcacctctccacacatacacatcaattctttagtaaacttcactaaatttctaaactcatcattcattcctgcagtgaatgatatggatatatgcagtccatcagcaagccttttgtgtatatgtacagaacgaaccacccaagctagaagtgtagaagcaacaagttagctgcaagcccagaggaggctaagaagcaagcctttttgttcatgacccctaggtcatgattatcattgtaaataagtaatgttatatttaccttgccaccttctatgctgtgaaatgctgttcaaacagctactacttatatggaacccaatatagttatggctgcgtactacctaaacatgtctccttcatatcaaatgcaccattatacgcaaacattttttatctactacagctatatcgaaccatacaatatactacttccttcgtttcacaatgtaagtcattctagcatttcccacattcatattgatgttaatgaatctagacatatatatctatctagattcattaacatcaacatgaatatggaaaatactagaatgatttacattgtgaaacggagggattacatgataaatagcacaaattattgaaacaagtaaactccattgcctcaatcctatgggatggaaagatttttgaaatacactacactatctatattcctatacatataaacgatgaaaaaacttccaactccacaagtgcagcgcgctttgcgcgctcctgcccctagtatcaatggctgcaccactacggattgtcacacttttcaagctccttgggagtacagataggtctacacgacctcctccatttccaccccatgtcccgatcttaacaagttgtgtgctctgcaaatgaacacatcaatgataatgacagataaaaattaattaaaaatcctatataaaatagtgtacacgtccagaggcaaatcttaacaatgcaattaaaacatgcatccatgcatgcatttcagaaaataacaaatatatattgaagcaaatgagaggaataattagcccaccattttgatttgtatatcctatgtgccctatgtatgtgtgactacttgtagtactgctctgctatggttctgtgcgggtaggcaaccatgcagagccacctatttatagtgctggataagcatgcattcatataacaaatattatccaaaacaacaaagcaaaaatctgtttatcaacttgcgaattgtgaagatttaattcttccttagaagcaacatttttctcacctctcccacaacttcttaactgctgtgatacatagttgaccttaatatcttcctttgtggctagcttaatctgttcataaaaacagcatcacgtccatttagacagattatctgctatattttggactaatgtctgatcttaacgatatatatctgacgatggacttcatcgatgcaagcatctgccgtttgcgtgaggtttatcctggtcaaatcccaaccctgcaatcaatccattacctgctcccctaccaaacctttactctaatcgtaaactgaggctaattaatccactctgcgttaaattcgtattctgtgatcaaaactaatgatcagctaggtgcctatactgtataataggactgtagtgtcagcacaagagatgcacactttgggaagggcatgtttaatatgtctacatgtaagtgaatttaatttatttcgattggagaagttgttagagattgttaacagtaactgttaaagaactccctgaaaaaaaaggggcctgaaagaaaaactatatggagagggcatatgtcagtgcatttaatttatttcgattgtcaaactcaattgttaattaaagaagggaaaaagtctaatttgactctcttaaatatacgtccaatctgactcgtatccctaaatcacaaaaccagatatgatgatttctcgaattattaaaatcgtctaaaataactctctcggttattttaagggtggttttcgctgacgtggcgtacatatggcagcctagtcatcctctccctctaacatctctctcctcctttcttcttctcggtgctagcgacggcggcgttcggcggcaagggcgcggcggcgagggcccgatgacgagggcgttgcttgcagctgctgggcccgacgacgacagcgttggctcccggacccgcctcctcagtcgtcgtcctcctcgtcgaccaccccgccatcgccgccaacatctcggccccaccgcgcgccgtccgctcggccccgtcgtgcgccgtctgctcgcgtctgcgccggaggatttcgcccccgccgccgatggtgctgggctggtagcacgctccggactgcatgatctgggtgcagtcggcgctgcgccaacacgcgtagtcaattgccttctgcatcgccgccggactctggtcgggcttgaacacgcagaacgccccatctgcccgccgctgccaaatgggaacacaggttagctcaaatcagtagctcaaaagttcagaactgaatgcatgtctcaatctgattcaaatctagcactagcatagcctcgaagtgaatctttcctctttgatgtttctagtgtgcacaaaaacaaaaagggaaagaggctatgcaactaagcaagaaatcgcaagataacattgagccattgctctaggcaaagattcctacaagcaactacatggtggtaataataaaaaggggcaggaaactcaagaaaaactgaacaaacacgagttttatttgcttttcttttttttctcgcagaggatgcaggtctgggttggggcctcacctgagccagtggacatggccaacaagagcagcagcgcagcagcagcggaatcaccatggtggcagcagcagcaagagctcgagccctctcccaacgccggaccccgtcgcctcctccaccaccggggggacgtgccgcgcagtgctccccctcgccgtccatggccgccgggagagagagggggccgacaagcctcttccaacgtgctgctcacgtcgtcgctgcgcgccaaggtgggcgatttcgggttcgcgagatgggcgtcgggaagagtgacgccatcgtcgtcgtcgacggcgtcaagacgaagcgtcagctacgatacgctcgtggggttgtttcgtccgccggcgagcggaggcgatgaggcggcgtccacggcggccggcggcgggagcctgcggtcctgtactgccgaagcgccgccgccgtccgagaagggagaggagagaggcggcgtagcgaaagggggggaaggggacacagacgacgacgatgacatggagatggcgcggagctggaggtggtcgcctgcacgccgccgctgccgatccggtggggaagagaaaagggggagagaagagagagaagggagagagagggaggaggaataaaggatgacatgtgggctcacaattattttgtgtgtgtgaatgacagatgggttctacatatattttttttaattttaatgccatataagcgtcatattggataaagaccgggtcaacaccgccatgtcagcgccacgtcagcaaaaccgccctccaaaaccgttagaggagtcaaattgcactggtttcaatagttcggggaatcgtcctacccagttttccagttaagggtcataaattagattcgatgaataattaagggagtcaaaatggactttttccattaagtcacccatccagtatggttgcttcttctggcccacccactttaaccgcgttggaaatctgggccacatataaagcccataatttatgcggagccgtaagattaggcccacccacagtgacggcctcgtggcaggtaattgggccgaattcttctcgcgggcccaccaccaacgcggccacgccaccgtcgccgccttctccatcggccgccgacctccgtgctccggccaatgccgtcgcccaggacggacacgccggggaagaaggagcgccgagagagggaggcggcgccgccgccgcttgcgcccgggcacatcgacgctggcgccgtcgcagaatccgccgccgttttctctccaatgcgtcgtgagtggggttcggagatttcaactccgaacaccattagtagccgggttttttttttttttttgcatcgccatgccgatgatgatcaacttggagcaccggtgaccttatttttatctccatcaacccgtctgctcttgatctgttcagtgtctcagctataagtttatgaatctaggaaaatctttttttataactgtaatcagctcgaatatggattcagtaatcgtgttaatagttaatgcatcagcaagcacatggtaattaggcttcagattaagcagtgagcacatatttggactggcaggtttcttggtgtgaaaagaagagagaaatctggtcagatccaacatatataatgcagatgatccagcaggtaagacaagtacgactgcattttcagcacatgctaaacacagtttgagcttgtttaatttctacacgcaactgcattttccactggagaagttgttgggaattgtcagcttaactgtcaaataacttcaactaaaaagaactgaaaaccatgtgaagggaccctataggaaaggtagccaaaattgtttaccacttcgcactttgcactttgcagtagttaacaagtatactaacaattggttagaactgctctgtctgttcagataaaaagccgcccttttggcccctccttttgaattagtcttttcttttccttccaatctcatatatatctgtcatctcaacttttcttcagataaacagtgacatctgaatactttggtgggagagagaagtgagaacatctgtttttgctgttccgtttttctacccattcgaaggatgtggactgaagaggatggcaggatgccgatgctcgtggggtcgatgatgttcaggttcagcaatgtgcaatggttgctgtgattagagcaaatggaccaccttttaactactagtactcctgaagcttcggcttaaagcacaagctcctccaaaaacaaggtgcatctgtcacagatcttgtcaatttcatattgatgaatctttcaccacacttgctaccaatctctaatctccagtttgcatagttgaatactgtatcactagcaggttaacactgtatctatttgtactatgcaaatacaagaacagtgtgaagtttaacattttttatgattatttcaccacacttagttactaccaatctccaatctccaattccttagcattgtgtttatctgcacaatgcaaatacaagagactctgaacaatgtgaggtctgaacactctgaaccactgaaagcaatatactactatgctctcttatgcctctcttaatctatctttttagtcttaaagaaaactcgcttttactaccaatctctaatatccaattccataattgatcccccaaattaacactgtatttataatatgcaaatgctctctcgaagaatacgcatcaccgaacagtctgaagcctgaaccactagcatataacctcctgttatctgaaaaagacaccatttttaccatattctcttacaagaaaagcaaaaaagaaaacatctttttttttaaaaaaaaagacatttttcttttaccacatttatagcgacgtggatctgatcaccgtaaaaaaagatattttcttttaccacatttacagcgacgtggatccgatcgtcgtgtaggctcccacttctatccggccaataggttttacaaaatcgtacggttatcacacgcttatcgtggttatcacatacggtaaccttatccgtttttgaaatcacaatatatctcataataatcacacggttttcacggtaaccctgtgattcgcggagaagcgaataataatccggcgatccaccgggagaaaaagcagctcagcctcagcaccgcacatattctcttctcccatcccgcagccgcagctgcagccgcaacggttgcccgttggttggttggttggctcgcctccactccaatccgcgcaggcagcgacaactcgctgggggtgacggcgaccactcctccacacctgcgcgcgcgcagaaaagctactactactactaccgcctttccaccaccaccgacgccgtcatcatgacggcggcgacgacgacgatccacaccggcagccgcactggtggtggccgcggtggtggtgacgccccactgccactcactgatccacccggccgcgcgcgagctaagctaagctagtagctagctgcctagctcggctccactcgctttctgatcttgcttcgcctacttgtctactcccacgcacgcacgcacgcaccagcgctgtccctcctaattctcttctcctccctttcgctttcgcttttttgggcgcacttatctattggggtttggacggcgacggggcaaagaagaagaagcccaagaaccggtcatctcgagctctcgatggattcagcgccggtaggactcgaggctagttagctagcagcagcaagaagcggttctttgtttgtttttagctccgattttgggcctgcaagaagagatgccttcccggcggagggaggagcgcgggtgcgggtgctgggcggcggtggcgcgggggctacgtggggcatgcttccggccggcgggggtggcggcggcggcgtcgggggccgacgagaagggcgcggcggggggctccgccaaggggagccacgtccacgacgcaggttggcttcttctttgctctccctttttttttccttcttcttgatttttgtttgtagctggttggtgagtttgggatcttcttttgtttttgtttggttctgtggggggtgattttgcttgtttgttctctagtggttggatatttttgcttggctattgttgcggcgatgtgattgatgttcatcgaaaggggaaacttttctgtttctgggaaattctggtcgtgttcactggggactgatctgttgtgtatttgatcggatgattagtgcttagtactgtcagtgatgtaatatacgtgggaattttggatgttataatgagaaattggaacttgggatacagattcagagtaaacggaaattggatactgttttgctgttttatctgagatggaacggatcatgcctatagtagtgctgtaagggctattcatggtggtacaggcatacagcaatgatttcttacaggcttgagtgtcataatcttaaaaagcttgtgctagggaacattgcatctatatgagcttgatcagaattatcttagcaccgtgtgttcttcagatttcaatgagagtgttcgcatgttgttagctgttgccatgttcgtaacaaaaagacatgttttatgttgttatgtgttcttcggattagcatgtttcaataacaataagaggatgaatgggttttgctcatctttctatcataccgtgctaagcaactctttatggtatacatttaaactgtctgtcaaatgggatttttcttatccttgtgatagctgaagaagggttgttgtaaatatgacagaagcatgaaacaaatcgtttatccttttattcaggagcaaaatacatcctgctgtgtttctttctaatgtcatgctgatcatttttgctgaccttgagagacgggaaatgattaagctgaatagtagtactttcaaaataataacctggataacataagaaacacacactgatggtatttcaagtcaacttggtaggttttcttcctgtattaaaaattggttaggagtatgcccatcatataataaatcttggatcaatgtctatcaacttacttaaccaagagctaataactattgcccttacaatattctatcttggcttattctttcaagcttaatttggctctcaaaggacagtttgggtatatagccatgatatctactaagtactttctgttgttgaatttttcagtttttgggtgaggtgctcaagcattttgtttttctctataacagcagagaccagatatctaaatgctagcaatcgagagcttggtgatcattttcagacaaaccttgatgatgaaaatggtgtaaatgcatcaactgaaaagaaacttcttcggtttactttccaagagttgaaatctgccactgttaactttaggccagatagtattcttggagaaggtgggtttgggtatgtattcaaaggatggattgatccaaacagcacatctcctgcaaaacccggtactggtcttacagttgctgtcaaaagtttgaagcaggatgcacttcaaggtcacagagaatgggtggtaagtatgtgcttgtcctgtacatgtgtttgtgtaggtagagttataacttacaaacataccgtatttgcaggcggaagttgactttctgggacagctgcatcacaaacaccttgttaagctgattggatactgtatcgaggatgaccaaaggttgcttgtatatgaattcatggcccggggaagtcttgaaaaccatcttttcagaagtaagcaatctttacaaccatcttttcagaagtaaacaatcaaatacatgcattagtatttctttttaattcaaataagattggcatcacatttttaattcatgcaaaatatatactatatgaatactttcatatgccaatgtgttagtacatccttttgtcctaaaataaaatgaatcatgtaattgaaacatttagatattgtcatgtcttgagaaatatttcttgatgtagtgaagtaattaaactgctttatagaaactagtaacttctcccaaaaggagcaacaatggttgaaagtgaccctttgtttatttactcttttttcttccaaggtgataatgcatgcagggctgttttagaataagtagtacaatactcttttagaaaagctgttgttgacttgccttattgaacaccaagacttgacctcaacaatatcatttctaggtgttgtccattgaattgttaacagttcattgaaaactaggacctgtttatccttacacgccctctttgtttaggcttatacgccagcttatgagcctaaaagtctaaacctaaacagataagcagcttgtctgtttggttttttaaggacataagccactcttacactattaagccacaagctaggttgcagtagcttttttggcttatgtgaagtggaggtatgacttcaccattaaacttaaggcttcaaagccaccagcttataaaacatataagccaaaaaattggctaggcctaagcctaaacaaagagggcctaacgatgatctatatggtgttccctgatctattaggtcatccttgtctaacaattgtactttgttctgtaagtttcttgattggtaatgccttcaaattgtttcccaatctaaagttcctgttatcttactttgtttaatcttgaaggggctcttcccctaccttggccctgtagaatgaagatcgctctcggtgctgctaaagggctagcctttctccatggaggtcccaaaccagtaatttacagggattttaagacatcaaatattcttcttgatgcggtactatttcttatcaattcattcacatcatgctcataaatatgttgcacattttcacaagattatttcttgcatgctattctaacagcagtggaaattctgcttatacaggagtacaatgcaaaactttcagattttgggttagcgaaagctggtcctcaaggcgataaaactcatgtctctacacgggttgtcggtacctatggttatgctgcacccgagtatgtaatgacaggtattttacggaaacttttggttttttgtcgtctacttgaatcaaattttctttaatacgaatctaccagttagtattttattatgtttctgtgagtttctatggtgtgatatctacatctttgcttctaatttcatcacactgatattcctactagattgaatattaagatgcctcgggattccatctgatgacgtataaactgcagtatctagacatgatcaccaagtaacagctgatgatttttacttaagtaacaaatggcttgtttgtttagacaatgatacagacaacattcatcttggagcactcttccgtagcatgatttgattatccgaattcattggaataacctgaaaacgtggatagcaggaaccagtttggtattacatgttctactctgcctttctggttcaatattactgctgtatgcatcccacaagtttacttcctacgagatcttttctggcttcataaaaacttaaaataataaaaacaaagtaatgtcaaacatcagattatacttctccctctgagaaacaagcatacatgttcaagatctcattaaagtacacttttcaggacacttgacatccaagagcgatgtatatagcttcggagtagtgttactcgagatgttaaccggtagacgatcaatggacaagaagcggcctactggggagcagaacctagtggcatgggcgaggccgtatctaagtgatcggcgaaggctctaccagctcgtagatcctcgcttggggctgaactattcagtaagaggggtgcagaaggttgctcagatctgctaccactgcctcagccgtgacaccaagtctcgtccgacaatggatgaagttgtcaagcacctgacgccgttgcaggacctaaatgacatggcgtctgcatcatatagacctcgatcatctcagcgtggtgagttatcatctgaacaaagaaagaattaattcatcatcactgaagtgacctcaatttgtttgaactgcaagaatgaactgttttctctgctctctttgctttgcagttgtttttgcttttgtaaacttcttctgtagatcttttgcatattcgcgaaaaaagaatgaactgtctttactcacagctagaacgtgatgaatgattaaaaatgtgaaacttttggattagcaaatgaagctaactgtaattttttttcctcatcgcaggaaaggcacgtcggtgatggccggatccactgctaaaaagcagcgaaatttgatgatttttaaggtcatttccgggtgctttgttttggttttaattgtatagtgaaactaggcttgataatcctcaaatccctggagatgtgacgccccctgatgtctaatctcgcttattagatgatcagccgaacactgtgtttggtggctggttgcacaagcgaaaaacggcatgtacgtgtggttggctgcaacgtgtaataacaacttatttttctgacaagggctgatcatccggttgatgctttccaactgtgaataccgaatactactttcgagatgcatggtaatatagtggaaaggggtgtgtggtttaaccctcggtccctcacgtctcatatttaatccccaacacacttataatttcttctttaaaaataaatgtttgggatggctctccctccaatctcgtttttttttcccgaatactactttccctctcttcctcactttgtagctctgtatatttttattttattctgtattttagatctttatttactcgctcagcaggttactaaatgatgtgttgatacaaaagaaatttatataagattttgtgaaatgtttttagtagctaatttatttattttatactcttaaatagctgtcataagaaccagattactcatccgtctataatttcagctatttgaaatggggcatatatccacgtaattccattacttaaaaagtgtagcattgtaattgttgagttgtgatctaaattcatttgcacatatataaaggccaacttctgctggagcaaagcagaggtccgtcgccagaggcttgggccagaggcctgaggacgcctggggtgtaggggccccgcgttacggatcgttatccttttaagtttcaccttcatatatacttcttgtaagccgccgtttgacgttgtaacctcgccccgatatagtgaatatatttttctgtctggtgcccatggttctttctctcctgttttgagagggttttccacgttaaatctcgtgccttatatgattgatctattgtttttttatcatttgtatgtctatcattttctaacaggcctctcactctctgtttctcatagaaataagatcgcggtttgtcaaattacacaggtttttggttccaagcctgagaatcaccgtagcttatgcaaatttcgaatagaggaatgtcaactgaactaaattacataaagaaatcatttaaatttcttgcgcaccaaaggaacaccgacaatatagcaaactgtaaggtgttgtttgattggtatactcacgttaccaaagcttgccatattttatttaaggaaaaagtacgaattacccccccccccgaactatcgtggtcgtccgaattaccccctgaaccataaaaccggacattctttacccccaactatgcaaaccggacgaattacccccctcgatccaatccgcggtggttttggtctacgtggcgtacacgtggaatcccagtcagcgttttttaaattaaacaatggtgtgacccgcctgtcatactctttcactttcccctctccctctcttcatctcttctctctctcccactcttcgtctgtctctctcaaggatcggcggcggcgggagacactgaggggtgggcgggcggacggcggtgcacgggggcgggcggcggcgcgcgtcgcggcgatggccgagcggaggcggctgcaagcacggcgcacagggcgggcggcggacggtggcgtcgcggcaacggctgagcggaggcgactgtggcggcggctgccggcgctactgggtgagtggcggcgggcacggctgggcgagcggaggtggcagcagcgacgggctcgattgggcgccaacgtcgcctcgcgtcgcaccatgcccgtggtgcccgtggtgcgcgtggagctgaagctgctcccagtggtgcgtgggggcgacggcgcccgccgcccgcagtggatttccggccgccagccgccggacgcggcccaactctccaccacgcccgccgtgcctagcactggccaccaactcgcgggccacatctgagacagagagagattgagaggaagagggaaagagagagagattgagaggaaagtggggaagagagagaggtgggacagtatgacaggcaggtcccaccattttttttaattaaaaaacgctgactgggatgccacgcgtacgccacatagaccaaaaccatcgtggattgggtcgagggggtaattcgtccggtttacatagttggggggtgaataatgttcggttttatggttcaggggggtaattcggacgactgcgatagttcgggggggggtaattcgtactttttcctttatttaactaacatgcctaacatgtggctcataaaattaaagccacacttcagctgtatgaaagcaagtttgctacacttttactccatctatcccataatataagggattttgatattttgcttatactatttgaccactcatcttattcaaaaaatttgtgcaaatataaaaaatgaaaagttgtgtttaaagtactttgtataataaattaagtaaaaaactaaataataattctaaaattttttgacgaatggtcaaacagtgcaagcaaaatattaaaatcccttatattagaagacatagggagtatataccaataacacatgggacccacatcatggtgaaggaatcttaccttagaggttgtttggtttgctcctaaaatttgccaaacgttgacacacctcatgttagacaagtttgaccaagttaatttattgtttggttcatagccacacttgtggcaagattccttcttatctattataaccccacgtgccattaactcaataaggtgtggcgcaatcctatttcgctagttaaggtgtgatttacttattgtaagccacaacttagataagtgtgacataaaaatacggtgaatggtggcaaacttagtataacatccaaacagtcaaatctggctaacttgagttgtagcaatagtcaggcaataagtggtagtgaaacaaacaatccctagggtgtgttctgaccaaagggttctcaacccctctcaatcgtattccgcgcgcacgctttttaaactgctaaacgatatgttttttataaaaagtttctatacaaaagttgcttaaaaaattatattgatctatttttttaaaaaaaaattagctaatacttaattaatcgtgctatggactgttctgttttcgtgctagggtgatatgttcccatccatcagcagcgaacacaccctatgtccctatctgtggattgccagtgcgaatctcgacgtacgtggtggcaaatgcagccgcagtgctaggtggagccccaagcgggcgtccaggtcgccggaaaactccatggcgcgctctggcggtgtcaggtcacgggcgccatggcgcgtcccatggcgacaaccacctcagtctccccccctccccgcagcggcgtctcgacctcatcgtctgtgcctgtgcgcgccgtgctgccgagtgctagcgcgctagaagcgtcggcgcgcgtacgtccgcgcgcgcgcgcggtgctcgcccgtgagcgcccccgcgccgtggccgctagcgcgcgcgccccgggccaggtggccgcctcgccggctcgccgcgaacacctggcgcccatccacgcatgcatccatgccatgccatgcacgagatgacgagacgagactgagttgattaattgattaacatacaagctgcttggttagtgcagtgctttgtgaacttgtgattggatcaggtgttgaccatgggagattagtagcactagctagtggcactgacagtagttcgtgttcagtgtacgtgttcagtgttcagtgatcagcggaggcgtgggcgtccatggccgctctataaaaggcgcgccaacccatctcacgccaccgtgcaacgtcgagccgcgccaccagcatctatggctgcggcgctcgccaccgtcgtgtctttcctgctcgtcgtcctcgtctccgtcgcccacggctggaacaaagactgcccgcctcccggtagcggcagcagcggcggcggccaccacggcaagccgcccggtagcggcagcggcggcggcggtcaccacggcaagccgcccgagcaccaccaccaccacaaacctcccccgtctccccggtgcccgtcgtgccacccgccctacacgccgccgacgccacggccgccgccaactccgccgtacgttccatctccaccaccatacgtgccaccctacatcccgccgccgacgccgccatacgttccaccctacatcccgccgccgacgccgccgtacgtcccgccgccgacgccgccgtctcctccgccatacgtgccgccgccgacgccgccgtcgccgccgccgtacgtgccgccgccgagcccgccggcgacgaagacgtgcccgatcgacgcgctgaagctgaacgcgtgcgtggacgtgctgggggggctgatccacctggtgatcgggcagaaggcgagggcgaagtgctgcccgctggtgcagggcgtggcggacctggacgccgcgctctgcctctgcaccaccatccgcgcgcgcctcctcaacatcaacatctacctccccgtcgcgctcgagctgctcatcacctgcggcaagcacccgcctcccggcttcaagtgccccccgctctacggcgcctgaactgaacaaacgaagcagcagctagcaaagcttcgtcgtcgtcgtcaatggcggaggctactatactacaccctcgctagctagctatactgtgctacctttactctctcgatcgtactcgtgtctgcgatttgtgttgtattaatgtactacctccggttttaatccaagtgtagtttaattaattaatccacgagaaaagatccgacttatgatcaagtctctgtgcgaattgaggaatctctcggtgaattatactggaagcatatcaatctgaactagttttcgatttttttgtgtgaataatcgtccaaattacatcggttttccgtaggtaaccaaatggtaatgacaaagctgctcatcagtacttcagctttgcagttaagaatgagaaggcccaacaggcaacagcccattagatgctagctagtgcagtacttagatggtgtttagatccagggaattaactttagtccctgtctttagacactaatttagagtattaaatatagactacttacaaaactaattacataaataaaagctaattcacgatacaaattttttaagcctaattaatctataattagagaatgtttactgtagcatcacataggctaatcatggattaattaggctcattagattcgtctcgcaaattagtccaagattatggatgagttttattaatagtctacgtttaatatttatagttaattttcaaacatccgatgtgatagggacttaaaagtttaaaagttttagtcccatctaaacagggccttagcacggcccatcacatattgcatcggtgacgtagtgagtgacgcacgctgttgcagtgctctgcgcctctgcatctccttctcctgcacacttccctctcgaattcgaaaaactcgtataattcccctccacagctcaacggtcgggatcccatctcatcgtgcccgcatggcgccatcttctccgagaagaaaccggcatcggacggctacgcccacaatcatacggtccccgaaagtccacgccgccgtctcaatttcagcggccgccccgcaaaaaattcacaaaaaaaaaaaacccgcaacagcttgcactgcacgctgccccctcgccatgttccccgcgtttcctaccccaaactcactgacgcgtgggggacaaccggtagggcccacatgtctgtcggggtgggcggtggtggtgcccactagcctggttacctggagatattgccccccaccccacgacgccaaaatccgcgcgggaaacagctccgcgcccgcgcgccaaacttgctccaaatcgaagtattattttctctcgcgatttctccgatttttttttctagcgataaattaattaatgctcctctcgccgcgccgggaaagcatttaaatctccccctcctccgcgcggttctcccaacccaaaccctaccacgattcctccccactcccaatccaatcgccgcggcggaggcggcgggcgcgcgtgcacaccaggtgttcgacggaaggcctcgccgggtggggggcgaagatgtacgtggtgaagcgggacgggcggcaggagacggtgcacttcgacaagatcacggcgcggctgaagaagctcagctacggcctcagccaggagcactgcgacccggtgctcgtcgcgcagaaggtatgcgcgggtgtgtacaagggcgtcaccaccagccagctcgacgagctcgctgccgagactgccgccgccatgaccgcgtcccaccccgactacgcctcggtaacagccactgaacttcaccgttgttggtttttttgttccccattcggtagtaccttgtctcctcctgacatgtggattgctgttgtgaagctcgcggcgaggattgcggtttccaacctgcacaagaacaccaagaagtccttctcggagacgtaagcgattgattgcttttgtttcagttgaatcatgcgaagggtgttgggatttatggattaggatgtgaattgggatttggtcgttatggatgcaggattaaggacatgtatggacatttcaacgagagatctgggctgaatgctcctttggttgcccacgatgtatatgaagtcatcatgaaggtgagatatcaaattaaactttagggacttgcactgatagctgttcttgttctgatttgtaaaatttactgttccattcaatttattggtcattaggattattgatgtatgttatgcttcttacggtttctgatgttctgatccttattttcagaatgcttctcgcttggacagcgagataatttatgatagggacttcgattatgattattttggtttcaagactctggagaggtcttacctcctgaaacttggcgggaaggttgttgaaaggccgcaacacatgttaatgagagtttcagtaggtatacacaaggatgacattgagtctgctatcaagacctaccatctgatgtctcagcgctggtttactcatgcttcaccgacccttttcaatgctggcactccaaggccccaagtactgcacatttgaccagaaaaatcctagtcttggactctgaaattgcttgcttactcttttattctctgcaatgcagttaagcagctgtttccttatctgcatgaaagatgacagcattgagggaatctatgatactttgaaggaatgtgctgtcataagcaaatctgctggaggaattggtgtatcagttcacaatattcgagctactgggagctatatccgtggaacaaatggaacctccaatgggattgttcctatgctacgtgttttcaatgatactgcccgttatgttgatcaaggtggaggcaagagaaagggtaggttctatggtcaattttatttgtgaaaattactctaataccataatctccaggaattctcataccctcctaaaaatcaggtgcatttgctgtgtacttggagccttggcatgcggatatttttgagttccttgatctgagaaagaatcatgggaaggtaaattctcaaccagatcctcttattaattcctttgcatagaaaactgtaaccatttaaatcttctggatttgttgcgacaatgagctgatttcaatgtatccttgcatctacattttctgaacttgaaatggattgcttacatgtaatagatgttatgatgcagagctgaatgttcaagtctttggtgcaaattagttataccattagaaaaaactggtggatagaagaatagcaggctctagtgtatttcttcctataatgttcagaagcttttcactatccagcatactgtgatcactggacaatttgatatgctttgaacaatttgatatgctttgcttgtgctgtttatgtttctaatatatgccatttctcctaacttaaaggctttagcctgaagaaagatctgaaatgcatgtttttatgaatgacaatttaataggaggagcatcgtgcaagggatcttttctatgcactctgggttcctgatctattcatgcaaagagtccaaaataaccaagaatggtcattgttttgtcccaatgaagctccagggttagctgattgctggggtgatgagtttgagaaactgtacacaaaatatgagagagaggtaagttggaaacgaaatttaattgtactacagtttattgaagttggaaaagattacaataacatagctttgtactttcagggcaaggcaaagaaaattgtcccagctcagaccctctggtttgacattttaaaggcacagatagaaactggtacaccatatatgctttacaaggtaaatttggtagcaaaattagtagcaaggagtacttgattttggacccaagattcctccaaatatgctgctggctatagtcaggttccaagtattcattccgaatgctcttgttgtcccacaggatacatgcaataggaaaagtaaccagcagaatttgggcacaattaaatcttcaaacttatgcactgagataattgagtacacaagccctactgaaactgctgtctgcaatctggcatctattgctttaccacgttttgtaagggaaaaggtatatcttgttagtgctttggctgatttcaaccctaaatgttgtatgtttacatgtctgatcataagattctgttgcagggtgtccccatagagtcccatccatctaaacttgtcgggagcagtgattctaaaaatagatattttgactttgacaagcttgctgaggtctgctgtctgatcgaatctgtttattctaaaaatagatactcttgcctatgtcagtgaatgttctgacacgctgttgattttaccaggttacttcaactgtcacatacaatctcaacaaaataattgatattaattattaccctgttgaaaccgcaaaaagatcaaatatgcggcacaggccaattggcattggtgttcaagggttggcagatactttcatattacttggcatgccatttgattcaccagaggtaacttttcctagttcagtaatatagtagtactagttagtagtccttcctacacttaactgatgtaaaaaatgtgatcccctcttttcaggctcagcaattgaataaggatatcttcgaaactatttactttcattctctgaaagcttccgctgagcttgctggtaaagaaggtccctatgaaacatatgaagggagccctgtcagcaaggttttttgcttttactaatgtcactttttttagtagctgaatttaccaatttatttattggtgtagtttgactaaattgttggttggatatcaacaagtaatattctttctaaggctgttttctatccacttttcagggcattctccaacctgatatgtggaatgtagttccatctgacagatggaactggccatctctacggagtactatttctaaagttggattaagaaactctcttcttgttgctccaatgcctactgcttccactagtcagattcttggcaacaatgaatgctttgaaccttatacatctaacatatacagccggcgggttctaaggtttgtaactacactgttcttagtgctcgtgctcactacaggtgcttatgattgattttgtttaattcttttccagtggggagtttgttgtggttaacaagcatcttctccatgatttgactgaaatgggtgtttggactccagctctgaaaaataagataatttatgaagatggttctgttcaaaagatgacagtgatcccagatgatctaaaagcaatttacaagtatgttgttcattgtcctaaactcctaatgctatgttctaccagatgcagatattcatttatctaaacgtttaacctcaattgttccagaacggtttgggagataaagcagaaaacgcttgttgacatggctgttgatcgtggatgctacattgatcagagccagagtcttaatgttcacatggaacaaccaaactttgggaagctgacttctctgcatttccatgcttggtccaaggtattattaaggctatgtgaaagcatattcctgaactctatgcagcccatatttattctgtatttgtcatgccatgaaaaagaactgctgtctttagattgtgtttttgcaaggtctacaagtaaacatggtttcatcttggttgatttagggcctgaaaactgggatgtattatctacgaacacgagcagctgctgacgcaatcaagttcacagttgatactgcccttttgaaggccaatggagtatgtcttctggccctccccataattgttttacattcctgaatagccaactcaccattaaaaatattgttcaggaaaacggcaccaaggctgcagaggaagaggacgtggaagctaaaatggctcaaatggtttgttccttgaacaaccgggaggagtgcttggcgtgtggaagttagatgcttcactacacagttaaaatctatttttaaccaagacgacaccattatacaactggctgatcatttggtctcaataactgaaaagggagcccttcgtgtagtttgtatgagctgatttccatactggggggtagtggggctcccctgtctgctgaatttcatctttggcttgtactgtaacatcaaaattcttgggttactgcaaatgtacatatgtgttactgttaacgttattgacgtgtggtgttgccatgttggcaatggtactttgggtttgggagtctcatggttttgtatttgcttttgcgttatcattttttgatgtggtacgagtggcacatctttggctgtgtgatattttcaatttgttactgtaatggaatttatcaggagctgtacatcagtgtgtgcaacatgattactttttccgaaacagaccgtaagttcaatatgatggtattaatattagcaagagactaactagcattttccccatggaagtccagaaaaatggctaggtcgactgcttgattgataggcacatggatattgactggtgtactataacaatttaatgtagaattaatcatttgaaataattttttatttcatgataggaaatcactaattcttaattccctcaatctccagtaaaattaagcatttcaactgtaacggatgcagacagtagcttaagaaaaagaaaagcaagggctggaagcttcaaggattagtatgaatgaagaccaataacagattcaaagctttgacagattatttcatggactaattcttgcctaacctagtcaataacttgacccttgtacacacgcacagtactaaggtactactagtacaaagtacttcgtgcgatttagatcgtatctaagaaagagaaaaatattactactcccattgatctggcattcaatttttttaatgaaaatagtgctccattcatttcatattataaatcgttttgaatttttctctagtgaaatttctttaagtttaatcaaatattaaaaaattagtaatatctgcaacataaaattagttttatcgaatgtaacattaaatatatttttataaaatatttattttgtgtttgaaatattgctatattttctttataaatttggtcaacagggaaaaagtcaaaacgacttataataaaaaaatgagggagtacttattagtctcatattctaaaacaattttaaagatgacattccctttctatcgttcattaatacacatttacaactcttatgggctcatctcaacaaatcacagttaatacggctgctttggaaaaacaataggatgtatttaacaatgtgatttgccatatctctttaatttgtgtgagatttgttacaatgataaataatatgaaacagagagagtagcaaagtaccatgactatgtgtttttcccccactcattatccatttaagctgcttctaattgggggtggttatggtaacattcttcgaagttaacagttccatcaaacactttaatcctttatttatgtcaggtgaaagatcaaaactgtcccagacagaaacgatccatctctttcaacatgcaaaaaagacaactttaaaaatggaaaaacaaatgacaaaacaaacaagaacaccatccattggccgaagcaaacggtgtttggtgttgtgtgtggacacatcggatggcaagtcttcctacacgaccgccaaatccctcctccttcctttgaagttaataaaccctctcgagactccatagcctctcttgatttttcgtttcctttcccagcgacgaaacttcctatcaaaaccgcggttttataccggttctagccgccaagaaccccaacccccgccacccggcgaacgcgccctgcgagaaaatttggtgttttggggcctttttgaggtgggaattctgagaattctgagggttcttgcctgttgctccgaggatgaggaaccttctcacggtatgattgatcgccttgttgcctgttatgagttttatagttgtgttgattggttgttcttgtggtgattttgggggtgaaaattttgagttctcggttctgatggtggttttttttttttattattttgccggtttctgattattgaggatcgttttgtttgctgaagccttttgaatattttaattttggtgaacttcatgttatatggactcctggtttatgtttggatcgatcttgatcgacttcgtgacaggatcggatttggtgttcttactgatatctgtggaaattattgagttgttaagaaatatctttttaagacttttgtcaagacatgattatcataaatatcttgatgaccttttgtttttttttaaaaaaaaatcttgacaggattacgcggtgaattttgttcctgattttgtattagatatttgtttgaaacgaaaaggcaggaggattgccttttatatgttaattaatagagcagagcagaatttgtattagatatgctattatattttgcaagactatatatttggaatgaccacagtaccttcttgacccaagttttgattgcaagcctgatataatacttttttttatctctttcaaattttgagaaaaatgtgaaactaacagcatattttgtggttcttcaattttacaggattcgtttgagctcagcaaagtggaccaagcccctgcaaatgttgatatcgagctagggttgcagggtggcatgtccagttctgcgcagcctggctttgaaggcttctttgaacaggtgcgttcaagtttcggaatatcaacatagctactcagaactttcttaagtgattgaaatggttccattcacaatattcaggtcagggagatcgagaagctacatgaaacattgacaaagttactgaaggaccttcaggtgagctgcaatatcaaattggacctgttgctgaatttaaattgcagatattgaacatgcatcaaatctcagtagcacctacagaatatagtaatatacaagtgtgacgatgtgatacgtgtattccagatgctgttaaattaatagtgattaatttccctgaatttgtttgaatgatttttttattcaacaatgttactcttcatctctctaaaagtctgcgaatttcatgtagaactcaaatgaggagtcaaaaattgttaccaaggcatcagccatgaaaggtacaatacgggattttggttctttcctgcaaattggatagcttatggatacttgcgttgcttcaattttgcatcactaatttgattcctcttttcaaactgtagagattaaaaagcgcatggagaaggatgtcaatgaggtgacaaaaactgcacgtctggcaaaatcaaaagtagagaagttgaataaagacgtgagtaaattttctctcaatatttttttcccaatggtacatcattaagtacctactactttatctttattacttcctacagatttgatatatgccactttgattttcttttctgttacagaatgctgcaaacagagaaaaaccaggcttcggtaagggttcgggagtggacagatcccggactacaaccactgtgtatgcatcctacattcattctcttgcttctttcttgtcctttttgttatgtttttcacatcactgacttccagttgataatcttattgcagctcattgacaaagaggttgagagaacggatatctgagtttcaggtaccgccttttcactaagaatttcatcaattattgcacacaatctacctgatagaaattatttagcacacatggttgttaattcaccaactcatgtactctgaaataagcactaagcatcaggattgtacctatattgttcagtttgtaaaatgggcgtggttgttatccttactgtgaactatttttgcagacattaagagaggcaatccagaaggaataccgggatgtagtggagcggcgcgttttcactggtcagttatgttaaattctcaacatggtatcaggatttctatttgaattgcactgatagccttactcttgtaatcatccattgtgtaaaattatccaaaacagtcactggcgagcgtgctgacgaagaggtaagaagtatattaacttcaaatcatctgttaacaaatctgcatatggtgtgttgcttacacctggccaaattttcagacaattgacaagctgatagaaactggggacagtgagcaaatttttcagagagctattcaggaacaaggccgtggaagggtaccgattcttttggcccctcttatgataattctaacatagaaagcttaatgccgaaaaaaaaaacatggtttaacctgaatttatggcttttgcaggtgcttgacactctccaagaaattcaggaacggcatgatgcagtgaaagagatagagcagaagcttcttgagctgcaacaggtaatgaataagcaatcttccagaaaatcgaagctccaaatactgtgcttaccttgcaattgtgaatgcagattttcctcgacatgtccgtgttggttgaggctcaaggcgagatcctggacaatatagagtcacaggtaaaattttacatgccatttcagaggatctttgctactcctttgtgagccacatttttgttctgacttctgaatccctgaacctatgacctatctatctctcttcaggtttcaggtgcagctgaacatattcagactggaacaaacctcctccagaaagcaagatttctgcagaagaacacacggaaatggacctgcatagggattgtcatcctcctcataatcatcctcatcgtcgtcctctccttaaagccgtggtctaagtagaaaaacctgcatctcagaagcatcatgttcatgtcgattttggctggcaatgtttatcttttgtgcagttctacttctagttgtgtatatgccacggtgtggtagtgcgtcatgtacattctctgaaattttgggtgcgaacttattcagttctctgtacttcaaataatgaacatgcagcttgatcatacataattttgctcataaactttctatataagtatagtttttgtatatataaaaatttgttttgaacatcattaaatgtttgttggtcatcataaaataaacaaacaaattgccagaattcaaaagaaagaacaagttgtgcctagccttactagcctcaaggacgataatgggatgacatgtggaaaagagagagaagggaatggaacgccgcgggaaactgacaaaagaaatcagacgtgcatacgtggttgacgaaaacaaaattttcgaccggttcaatagtcttttttaaggtgtgtttgctgctaagctgctagattgtttgaaccttgaagcacctgttgataaattgttaaaagggaagtctgaaggctttaagttctttacagcttttcttttttcggattcttcaaacagatttgctccatgagaatatattttcttgatccgatcgatgtgttgttaaaaaccacttgttttaaattatttgttaagtttatttattacaatatttaatttatccctacaattaagtaaataatcggtagccacaatccactcaataatttatttaaaactgagccttaaaagagaatgcttagtaaaacaaaagagaatgtttttttctcttctctatctctactaactaaaagaggagtgatcctctttcacctccatgtaaaaacctattttcccccataaaccatccaccctcaaaattgattttctctataacttaaaagagttgttcttcatcatcttcatgtaataacctattccctccaataaaaaccgtttcaccctgaaaaactgatttctcaaaaaaaaaagatagccaccttaaaaaaccgaacagcccacccaaatcctctcaccaaagaacaaaaagaaaagatatgcataggcctataactaatctactaccttaaaagcaaagtctttctccttccatcccatcttttcaccgagcgcagcgtgtgcgcatgcaaaaagtaaccattggatgtaatattttatcctcaattatctttatagcccatccctaattatatgggcctgacccgttacaaagtacatacatattactatacagactatactattaatagatggagtcatcctcccttccttccaatataccctaattatatgggcctgacccgttacaaagtacacacatattactatacagtctatactactaatagatggagtcatcctcccttccttccaatatgccctacttccatataaaaaccgcctatttctatctctgtcccacttccacctaaaaaaccttctctcccataaaaaccgttcaacctaaaataccgatcagtgtaaaaaacaagggtgtccctaatgcgcgatcagtcgtgcggtcgcgcaggcgcgcgaccaccagatccactactactactcagtacctctccgcgcgcgacacgtgtccagtcgcgcggggaagagagcgcgcgactagccgcccattagctttttcgtaaaaaccaaacagcccaatcgatccaaatccttccaccaaacttaataaaaaaaaacctgttacaattcatgggcctataattaattacacgaaaagagaaaatgttagcgtgcatcttttgatgaaatcggactgggcagcatcttttgttgaaatcggactgggcggttgtttcggcttcctttccgtaaatcccacaacctatataagctatagctgatcctagatcctgcgccactacaccacccaaacacttcgatggacgccctcaaattgtgattgcagattttccttgacatgtcagtgttggttgaggctcaagaagagatgaacatgcagcttgcttatgcataattttgcttatactgtaccacattcataatattcatagttcatagtgctaaggagcttactgaaccacaacacctcaggcctcagtaacaccagaacatagaatttgtcacttgactcgtgtgtttctgggataagatcaacatccattagaacaggtaaatgttacacatcaaatccttgatttgttttacatcatcatggcagtcgatggtacaacagaaaattagggtgacatctgataatacactgtaaaacagtcaggaagcagcttcctaatcaggctatttcaactggagcagcgtatctctgcagtggctattcacaggaagcagacgcagctcccagctatcaactataatttctactcaaacaatctgctccataaaatcggtatcatctttcctcaaaactcctctttcgggacttggacttgtgttttcttccagaactcttcacactgtgatcttgttcgtgctgctcagttttaattttgttatcccttgaccttttcccgctggaaaatttgagcatcacatgtaaaaaacaaaagctagaaagcatgagtcgattgaaataccagcacaaaaagtagcagagatactatgttgcatatccagacctgttgatttccaatgcatattcatcatcgtgtactgacaaccaaagcatggatccagtgtgaggtgggattaaagaaccagttacgtgacaattcatttctgcatccaccctgtgattgaacatcaaaagaagagaacatgatcaatctgtcactcggaatatggagcctgacattagctggttccaatcatcccatagtccctaatttaaccattcagttgtaccggggaataaattgctggtcatttcttgtacataacacaggaagctaaaagaagcttttgctatatagattagctgtgctatgtaaatgcatgtgtgtatttcagaaaaccattcacattgttttattattagacttaagagccattgtatcaaaatgacttttttcagggctcctgtcataataagcacaccaggggaaaaacaattctaacatgctagaacaatgcatgttcgtgaacaacgtacagcaagtactgcatacaactaacaaattacaaatatagtaacatacaagtgccataacttttgaataaaggtgtttcacagtggaaagcaaacaatgaatgaaaattttgaaactgtcaaggggactaaagatcagcccataccttttcacagaaaatcgtatcatgcttccctttttaatcacgtgctgtttgtccgaccggcttacaaattttcctccatactttttctgtgtaaaaaatatagaattatcaatatcattttaagataaattgtttttacgaaattaatattatttacagaatagataagtttgtgagccacatattgtgttcactattcagtgaccacacaaaatggaagtatttggcatttctttcacagtataatatgagattccataagattctttccagtggatcagaagttaaccaaattgtcacaaaacgtacaatttgtgaagcattgaatggactgccccacaatcaattctttccacaataaatttagtcatttagtaagcactgatcctaatatttccaaaaaaaaaaacacttgaaagcggtgcaacagcagtgatatgcttccaactactaacaatgatcaaacagtatttgaacttagttattacagttcctgccaagctatgttccccctttcacatggcagttgttttgttgaatacaatttgtgaagcattgaagcacacataaaaaatggatgctaccaataaaaccgattagtacactagagacacaaagagtttcatctataaatttgaaagtcacaatgaaaagaacagagagtactttcaaaccatcattaatcattatgaagagaaaagctgatcacttgatcttactcttttgaacttgaacttctcatgaatatcatccaacatgatggcggctgaaaatacccctaatacaatggcatgtattgattcctttccaagcatttcaaccttcccttctaataggaaacaataaggaaaaaaaaattcagaatcacatgttccataatttaccagattggttgttccattgaaaaaagatataacaaatggagccatctacttgcaaaacaacaccacacttgatacaacacaatatgaaaaatgttctgctcaagtgccgcaaatttgtgtagccaccataacatgcaggcatcagctgatacaaaaaatgcacttaagcaggacagtgtaaatactctacaagttaagggcttctgtaataacacaacctacccagcatcatgtctggtttcggagagtaaagcagcagatttgcgtgcacgggcacgccaaagtatggtaccaaaccattcaggattttgccttgttcactctctacagttgcttcatgagccaatagtacgccatcgaagcgatcttcatacctgcatatatgaaaatcaatcaccccgcggggaaaaagcgaatctcgtggaagcttggaagcatcaagaaccatcatgccatgagaaatcgcagtccctatgactcccatttcaccttcctttcttctttttgtaccgtaatttaatttataaatgtctttagaaaactagcatggcatggagccaagaacgaggatgaggaggggggcagtagagaggacgcacgagaagaggagcgagctcagctggcgggcgacggcgcggcggacgtcggcggcgttggaggggtgcacgtacacggtcagcttggcctctgcctcccggagcgcatccatcgcggcggcggcgaggcaggaagctagtagaaccctaagcagccagcttctagtggttgttcgatgcagccgcggcagcagcagtaaccataagcccctaggcaggcggcggccgccgcggcgaggcaaggaagctaaaaccctaagtccggcgagctcgagtgtttggtggcgcggcggcggcggcggcggcggcgaggggaggggaggacggcgactctgcgagaaggagctgagcaacggtttggatcgcttcctcggcgctgatcgaacggccacggtcacagtgggtagtgtatatgatcagaaaatgttttggattttgttgatcatggcagaaagtgtcggtgattatcaatgagaaactaatgggcaaaaattttaatatcaaatctatataatggcgtcccatatgacgggttggttgattggagtatcatcttggcaccaaatggtttcatgtgttgtgagttggttgattatttacttgttactagtttaattggcttggagaaattagtgatgtaattacttaacagattctatcttgattatttggtatgattatacgcagatcccattaagtttttcttctagtaccatataagcaagttaacatgtcacgtaggatgaaactgtcatccaaactattaagagactttgatatattccctttgtgccgtaatataagaggctagtgttagcctaatactggataagacatatcctggtgtcatgtccagattagtagtcctaggacgtgtcatattcaatactactaagttcttatattttgatacaaatatagtgcattggttttaatagttgaaaattttagacctaattaaaaaggtcttattggacacttataaaaccatgcgttaagaatcgacctataaaaacccagtggcagagtcacctcacgggcgggttgggcaaccactcgagctctaccgctaccgtgttcgccatcaacacctataaaaattaattaatcgatcctgaaaaaaatattttattagtcactcgggcttaacgtcgccgccggctccgtctaaaggaacatgtcctcgtgtacaaggcaaaaacctcaaagcacggattaaaaaccgatttggtagtagcattccagcccaccaagcctgcatagcccagttgcctaaagcccaaaggaaagctgtgctgtgcccctcacagcctcgcttccctcccttattaatccccctcttccacgcaacacaaccgcgggtgttctgctttcgaacacagaagggggagagaaagagggggaaatcaagaagcagagagagaagggaaggcgtccgcgctcgcaatccccaccttctccatgccgcgccccgcctcgcctcgccgaccaccggcgccacctcctcctcctccacgccgcgctccgcctcgctgaccaccggatccaccgccgcctcctcctcctccatgccacgctcagactcacttaccaccggcgccacctcctcctccaagctgtgggcgcccccgacaatcacccacgagaacgcctccccctcctgctccgccacgcgggcaccactccggccaccggcagctgcctcctcctcctcctccaagctgcgcagttgcacctgccggattgataaggtgacagagagctcacgcatctcctccccattcacgttctgttgttcattttctttattttctttcttggcacgatcgcaaatagaggggctttctcctcaagatcgacgatgcccaagcggcttgatccagagctcgtgcactctttatatctcaactgcaagaaggatcagttagttatctacattgatggttttctatgattcagaagacagggcgtgccatgcgatccgccgctcggcgatgctgcacctgccgagctgcgtgctcttctggtagatccgttgaaactgtgattctgagttctaattcttgtacattcgaatctctttaagtccattgaatcgattggttttgaggcgagaggagaccaccaacgccgggcggaaattgtttggcaactcgtgcaagattccaggtctgcaatgatgcagcgattctttcttctttcttatatctcaactgcgagaaggatcagttggtgatctacgttgatggttttcttgatgattcagaagacaggtcgtgccatgcgatccgccgctcggcaatgctgcacctgccgaggtgccttctgatagatccattgaaactgttgattctgagttctaattcttgcacattcgaatctcttcaggtccattgaatcggtaggttttgaggcgagaggatcccaccaacgccgggcagaaattgttcggcaactcacgcgagattccaggtctgcagcgattctttcttcttcttcctcgcaagaatcacaagatatccatcatgtgtttgttgcaattcagtacttgcttatctgtttgatgtagattgtgtattgctttgttaattccttgaatatggtttgcagaatttttggtgaaatggatttttttcactgaaattccttgtatatgctggcgaaattttagtgtattatggttcatggacgtcagaaattggatttcatatctgatttagtgaaagttctcgccagtttcctcttgttctgaataaggaccttctatctaattaaatgtatcttctttattcagatttgttgcgcctcaggcagctgctgatctgaccagcggtgcttcaagtaaaggtttagcgtttgagcacatcaaattatttggctataaaaattacagacttttgatattggcttaattgatgagggtgattattatattaagtttcatctttgtaataagattgataagtttaaatgggctttagttttggtgtacgggccagcacaaaatgaatttaaggaacactttctttcttttctgagttagtttatatgtgcagtcataaaaccttaccaattatcattggtagtgattttaatattttatgtagtcctatgaaaaagaataatgacaattttgataatagatagccctttccatttaatgctattatagatgatcttaatcttagagaacttttaatatctggaagaaattttacttgagccaataatctagcactgccaacttatgagaagttagatagaatgttaatgtcgatggagtgggaaaaaattcttcagagaagttagatagagtgttaatgtcgacggagtgggaacaaattcttcatctacttccaatcgccatcaaaaattttaagtttgagttgggctgtctataaagagatgtttttgtggatatggttaaggaaatttggttaagtgttgttgatggtaatactcttttagagagttggcaggctaagattcgtagattaagacaatttttaagaggttgggccaaacatactaaattttattataaaaaggcataatcaactttgttaactcaagaagagcttgattctagactttatttgaggaatagattatcttgtcttctaagggaagagaaaattaaatggtatcagcgagctaacactaaagatattttgaaagggactcaaatactaaatattttcatttcgtagcaaatggtaagcataggaaaacaaggatttatcagctacaggatggtgatcaggtagttaatggtgatgcgaatttaaaggcgcatatcaccacttattataaaggtctttttggccatcccgaagcttcttccttaacgttagatgaaagccaaataagtgatattccccaggtttctcaattagaaaataatgctttagtacaagattttttatgaggaaattaaacatgcgatttttcaaatggaacataataaagctccgggtccggatggattcctagctgagttttatcaggttttctggaatgttattaagcctgatttggttaatttatttaatgattttcatggtggtaatttacctctttactctcttaactttggtactactattttttttccaagtgcaaagaggctttgaaaattcaacaatataggcctatttgtttacttaatatcagtttcaaaatttttactaaagttgctacaaatagaatttctggagtggctcagaaggttattagtcccacacagacggcttttatacctgagaggaatattatggagggtgttgttattcttcatgaaacgatactacatgaattgcaccgaaaaaaagagtggtgtactttttaagattgattttgataaagcctatgataaagtaaaatggtcttttgttcaacaaacttttagaatgaaaggtttctcacaaaaatggtgggattagattgcgtcttttatccaaggtggacatgttggcattaaagtgaatgaccaagtgggatcaaattttcaaacatataagggtttaaggcaaggggacccgttatctccaattgtttttaatatagttgttgatacgttaactatattaataaagagagcaaaagatgatggtcaaatttctggagtggtccctcatctggttgatgatggtttatctatcttacaatatgctaatgatactatcatttttctagagtatgatttacagaaagctaaaaatatgaaattaattttaactacttttgaaaaatatctggccagtataaatcacttatgtttaaaagtactttaagatgaagattatatatacgttcgtagcatagccgatcaaatagatctaacatgtatcagctagtactccgataccactctatgtcaagatattaaaacagacaaaatatatcaaacagcaagtctaatatactttaatgcaataaaatcttaatataaagggcagatttagcatatcaagtgaacatgtagggatgaaaggtagctaaatgaggtaagatcggctgaaaccccgataccatctcctttgacgatcataagacaaactagatatcgcagttatgaatatcacttaatagatcgaactcaatcgatgcaacattaagcataagaataaatacaatatctagacatgttgatgaaaacctctaggagatggtagatatgctatataatctagattaacaatgatatctaactctatcggcttcgggaggccgacgacgatgtcgtcgatctcgccgccggtgaccctgaacccaccgccggcggctctgccggtgcggcgccgactgttgggccctgactcgtgcagacgcatttgaggcgatgatatatcccccttttttttgtttagtgagaacaatattttatcatgggacgtaactacacagctagtggcaaaccagctaccactccatccataagaggcaccatccacctatacttcaaatacaattttctcttaaactactcatccgatctacgatccgattacaccgttgtgttcgtaacaattaaatctttacaacaagatctcacatgattatattttgacgaaaaatcacaaattacttttatgatatgtctaaattacttttagatttcactaagttacttcttagatatataaaagtaaattcagtaaaacctaaaagtaatttacatatattatagaagtaacttagaataaaatgaaggtaactttagcatgtcatttgaagtaaatccgttgtagagataaaaacatgactctatctaaaaattaaattaatcagcacaaattatggaattaactaaaataataataaaagtaatcacctcagagcattatgaatgtataggaagtattttaatcaaatctaaaaataacatatatatatatatatatatatatatatatatatatatatatatatatatatatatatatatatatatatatatgataatttgttcaatgaaaaaaggcattaattaaagttactttctttttgttataagttatttctataatatatgtaaattacttttaagctttactgaatttacttttatatgtctaagaagtaacttagtgaaatctaaaagtaagttagacatatcataaaagtaatttgtgatttttcatcaaaatataatcatgtgagatcttattgtaaagatttaattattacgaacacaacggtgtaatcggattagtaatttaagagaaaattttatttgaagtatagatgataggaatatttctcctacttgcccaatgaattaatagcaaccaaaactcctaaagtactagcacgtgggtgtctctggttaagactaattggagtggcctctccaattagatttaccgtttatcatgacaagatgagaacgaggcttctgtttgttttaggggtagtttgaattagtttatgtttttcaatcacgatcgattaggtaccctttgaaacacaggattgttaaagtacaggaataggaaaaacgtaggaataaaatatcacgttcattggattcatattggatttgattttggaaacacgggaaagcttcgaaactactgtttgatagtcatacatgaaaaattgtaggaattcaacacaggaagaataaaacatgaggtaagagcaagagctgggcttgtgtacgtcatggactcatggtcccgtactcagctcactgatgtagtcgccggcatcagcgagaaacaacgtccggttgaagagctcaccaacgatctcctggcggccatagacgccggcgagccggtctccggccagctggcccggctcgaagagatgaacgccgaagaggattctgtgcattttaatttagtgtgaatttgtattagtacgaagttgctggcatcctttctgataattgggcttgaggattgagactgagtttatttgtatgtaaactccagggcaaagggctgatatgaactttcaaaacaaaaactggcatagactttcaaaaggtacttcgtttatttagcaaatctccagggcaaagggcattcggcacaactactttgcatatgcttacagttgcgtccaacgaaaccaatacaaaattccacagattatgttttacttttgaagtaccaaaactatggaactgccggctgctgaccaactcagtgtattgctaactacaatatgatgaagtatgcgatctctctgactaaccatgggaagaacattttcaagcaccacaaccggtgctttggcaaattaacacttcagaaagaatcgtgcagtacaacaaagggaggatttaatcttcataatctacaccgtcctcatcgtctagctctgagctatcggctccacccatgagcgataggaatagaagaaccgcaacgagctgtgtcgcaaggaaatactttgcttttcgcctgaacttcttttcctcctctgttcgttccttcttagctctgggttttggcttataacctagaaagtatcaggttgattagatcgcaaattgcaaataaatgtttgaaataatccagaacatagtaaaaactctactgtgcaaagatctaggcaatattgaacttataatatcgattggcaactttgctgcacaaattgcagtccaaacattactggtaaggcctctcacagtgcgtctagctggaccgcgccttagtcgtgccacgtcggaattttgccgccgtgtcgcttggacccgcgcctaaactaggttcctcgtctcctaggtgagcaacgcaaaacctcgcgaaatcgagggcacgcagcgtggagaagacccgggtcgcgcgcgctgtgggcggcgtagcctcgccctggcatgccctagcgccgaaaccgtagcgcgaaatccccgattcgccctcccaaaacccattcccgctgcaccaatttctctctcccgccaccgattcctccgctcccgcgccgagaatcctcaaaatcagcaagcaaaaccaagaacacagattgcagcggcgacgttacaagaagaatcacacaaaatcacaaaagaaaaatcaagacacaaaatcatacaagaaaaatcaagaacgccgtcgccaagaacgccgaggaggagcgcgccctcctcccggctgccgtccgttcccgccgcccccgccgtcggcctccgcggatccgtccccggaggcagaagcggtcgaagcaagggagtgggggagggagaggggaggggcggcagacagatccaccgccgccgttgtcgccacaacgacctccatggcggcgacgacctcctgcgccgcggaggtgtagaagccgtccgcccgtcggcgccgcatcgtccactcccgccgctcccaccgtcggcgtcgcgccgtccactacaaccgcccccatcgctcccgagtccgagcggaaggagaagcgagcggcgcatgcggcgcggtcgacggcgaggcgacgcgcacggcggcggcttccccggcgtccgccgcgagggaggagagggaggagaggaaggagaacttgagggaggagaaggcgaggcgaagggggaggagaaggcgatgcgccgctgaggataaggggtaggtgaggaaaattaatccgtcggtgcgctacccgtgtcctcgtgtagggtcccgcccactgtggacttcgctttctttacctgtgtctctattcaactaagccacacatatatggatgcttgcactgtgaggtgggtgtctttggaccaattttttgggctaggggtacgggccccatagcttgcactgtgagaggcctaagtgccaatctagtttactacagttgacttaagtagtagtactacatgtcatttatttcataattcatatggagaagtgcgttactcccattatcaagcccaagaaaatcctgaaggaacacagtacaatacccacatcaaatttaacagattgacaaatgataaaaataacttgaaagcatatggatgtcatgcaacaagcaatcttggaattccggtgagaatcattcattgaaaacaaattacagaagatgagggatatctcatgaacaaaaaaaggtgttcctaatactccctccgtcccactttataaggcgtgtaattatttttactaagacctgcatagaaaagtttttttactgttatacccctaattaagtgcatgcaaaaggatttaatctcatcgcttcagtcggaagcggagaatatttgagggcccagcccatctgcatgctgcgcgaagctgcatgctccacgcacaggctgcactgaaacagctaacaagggctaatctcaggacaaatcaaaccaatttgaagatgcaccttatgttgtgggacactgggaaaaaaaaactaggcgccctctaaactggtacggagggagtattaagcaaccataaatatgtacactaatagcagtctgcatcacaatctgaatgaaaataagtcaatataataacttactccgaccagaagacgctcttttcctgggtgtagaggatgatgatggatcagttgatcccaatcctgttgctgatgaatcagaatcagcttccagtaattggaccttgaggtgcttggtaaagtttaccaagttgtcatacttctgcagacagcttcgcagcacagacgtatcctatggggcagaagtaagaattttgtcaagatataatcaacacagtattttgggaaatgtgcttgacagcttatgcttattgttagagaaaaaaaaatatccacgacaaacagaaccctaatgtaactatctgaagaacttgagatgtgcaactgtgcttgcagtgcaggtgcttcacaattttcaacgtggcatgcatgcaattatatactcatatatcaatataaatatataatcactttggcaagttaaagctgagtattgagtgttgtcagaactcaccggtaatacattaagaacaaaaagcgcatgtccaagaaaaagagcatcaacgtctgtagggctgcacagattgaaacaaaggaagttagtgttctgtaaatatcataccatatgaagagcaattatcagtcagtatgaacagaaagctgataaaataatacgaagatacattttcatgcaagtcaaaacaagataaagtgataatacctgttgtcaaagagaaagatctgatctcctaatctcgtagataaggcatcataagcagcatttgctttctggtatatctgttcaaaaaagacttaaattgtatcacgagattttcccatgtgatgaacaaattagccttaagaaatatgagtggggaagtagaaacctcctcttctttttctgcagcattaagcttagttatgcccagttgttgcttcacttctctcgttttcttccaatagagtatctttccaatgggccaggagagatcagaaaagtagatatcatgtggaatgcttccatcagaagccagccagagctcatattgcaaagcatctgaaagccaggtcataaccatggcctttgtggataatacatccgaataagaaacactaggatgctttgagttcaagtcaacaattttctcctccttgagatattcaattacaccacccttttcattgttgaatgcaacacattcaccaaactcgacatatggtatgtgatctgtggaatgaaaactaaggtataagaacagcgagcagtgaatatactttacaaatagtaggaaaaaaccaagatttcaagtatctaccattgtaaagatcaaatatgctctttcttttgtttatccccctctacactacaaaaaagtttacggacaggtgggacatacttcatcccccctttaactttcatagaactccacccttcagcacccaaaccccagatgtttcgtccctcagttccaccacccttccaaatccctttaacatcaaaccgaagaaagaaaacaaccaggcttgcaagttactctgacgctcgaacgatacagccagttactcactatgagctgcttactgtcatttaaacaagatctcttgaaatttcagctagccagttttagaagctgtccttgcaacacagaactggttgtggcattcaattatctgatgccgcattagtgttgcaaa

SEQ ID NO: 61495 - DNA, 3962 bp, Oryza sativa
ccaattcgtccaccgcaaaaccagatacatcgcatcccccaactaaaggtaaagtagcaatggcggtgggcggccagcgaggagggccgcggcggtctgtaacgacagaggaggtgaggggggagtgtcggggaggagggaggtgaggggggagtgtcggggaggagggaggcgagggagctcgagctcaccatcccctccgcggtacggcaacaacggcgaggagggggccaggagtggcgttggcaacggtgcgggagtcgaaaattgaggagaatcgctgttgagatttaggagaactgccacccatgctttgtggcctcgcgtcacacgcagcacctgctcttgcgccgccgatgccctgctgtggcggcgccaactccttgcccctgccgatgctgacgccctcctctcttcctctcttccccatcttgaggacgacaaccgatgggagaagggcagcacacggcgggtgccggcggccagtgagagaagagtcgagcgatgtgcggcggcggtgtcaagcgggcccttgagcatgcggtcgtcgtcctcgcgcacggagaaggacgcgacgtcgcactcctggtaaaggagcttgtacgacgaaacccatcccctgctcatgcatccctcctcgtcccaacctcccttgggtgtgctgctgctaccctcgctcacgaaggacgcagcgacgtgctcatgcaggggtggagctcgtgcggcgggacccagcccctgtcctcgttgccctcctcgtccccgttccccctatcagcgggagagtagttgcacggcgcatggcaggcgtcacggaggactccaacctaagggtccgctcgacgccgccgtcacgcgccgctaagttctgcttccgccggcatggtgatggggacaagaaggatcgcgggagcaggggatggatcccggcgcacgagttccttctttgtcgggagtgcgccgccgcgtcctttgtgtgtgagggtggcggccgcttgctcaaggcccctctcgtcgtcgcgcgccgcttgactcctttctcactggccgccggcgcccgctgcgtgcttccttctcccgttggctgtcgctctcaagatggggaaaagaggagggtgttgacgggggcacggagttggcgccgctgcaggaggagggcgtcggcggcgcgggagtaggcgctgcatgtgacgcgaggccacaaagcgcgggtggtggttgttcttcatcccgacgatggttctccatcccaatgacaattctcctccatcttcaactctcgcaccgctgccaacgctgctcctggccctctcctcgccgttgccgccttaccgcgaaggggatggcgagcttgagctcgctggctccctcgccttcctcctccccgccactcctgctcacctcctctgccatcacggaccaccacggccctcctcgctggctgcccaccaccactgctaccttaactaagttggggaatgcgatgtatctagttttgcggtccagtgatgaatttcaggctcgacgacaaattgagagacctaaattaaatttattccaatatgcctcggctaactgcaaagtcgcaggcccataaaataggctcaacaagacagcatgtaaccttagattcctttgggctccagcggtctagctgagtagctgccctcagtcccccgaaccacgacgccgcccggacgcccgacgcggcgaccccgaacggccgaagtgtcgacctcgccgcactctgtcaccttgcgggctctcggcgaaaaggcgggagacggaggccagagccctaagttgcgaggtggttagcccctgagccctctttcctccacggaccaagccaccacctggcaagtttcttcttaaatctcccaaccaatcttccatttgttttgttttaaactgagtagtcattgaattagttgtagagctagaaatttgaaaaatgaaaaagaagacaataggtttgaagtcgctaaatcaacccaatgtgtcactgaatcatttgctgtttaggacaagggaaatttggttaaacttgtttagttgtatcctaaaaatttctctaatttagagttgatgtatctcccatttcaactccaccactgatatatgtaaagataaaaggttttcaaaaatgtaaaatctggttgaactttatatcttgtttgttgaaacgaagaaacaccttagttatgaacttatcttccggtgaaaaaacatctcaaattcgtgctaattcttccagtggcaattgcagtgtttaaagagtgttatcttcgctgaatcacgtgaagaataagctatgaaaaagaataggagtgcaatatatgaaattttgaagattgcatacctacctttcttagcgtggctttttgtgcaaattaaggacggtcacatcacttctcgctttcgaaaccatggcacaaagttaaattgtacttttcttcaagtgttatgtaattcattgaaactacgtgagacatctccagaatgaactattagtgctactatgtgtactctaaaacatctcagttttgtttcttttcatatgaaacagttcttttaactcattatattcagctgcaaaatcctttgtccgtcacaattgcccatggactctgctgtcgatggcccgagacaacctccggctagggcgggaagccgcctctgcacacgctgcagcgagcggaaggctgccctcaagcgtcccaaaaccctagagcagttgtgcctctatgcccctcacattttccgtgtagtttgtcctgatgtttcgagacaatccaggtgcaataatttagctctagtagcttaagattaacagacattttttaatgtttttgtgaaagtaggaatactgtgaaatgcaaaaccgtttttgtttggcagttgtagatagtgcttacacatattcttctagatatgtagggaatgcttctacattgtctttgaggatgagatccatcagactattgttgagaataatttgtttaaacctggtgatcgtgtggccattggagcttctggtggtaaaggtatttccacacctgtatatgccatcactaactaatgaaatagcatgtgttctttatgcaactattgactattttctttcttcatgtatagctataatctgcatgcttctttctttattctgctcttgatcttccaacagactcaaatattttcatgtcatgactgctattatgcagattcaaccgtgctcgcatatgtgctatcagagttaaatcatcgtcacaaatattgtcttgatttgttcctcttatctgtggatgaaggaattactggttacagagacgactcactagaaactgttaaaaggaatgaaatacaggttcccctcccctctgccatcaacacaataatgcctgtctgctgcagctttttccttttaatattggttctattttttacagatatttaatcaccaacttttaccatttaaatgcatattcgtcagttgctgatacaaccgacttattgcagtatggcctgccattgaaaataatttcttataaggacctctatggctggacaatggatgatattgtgaaagcaattggcctaaaaaataattgtaccttttgtggtgtttttcgacgtcaggtaattcttacttgcctctttggtgcaattttttactagttataggttaagctttactgccaatccttttttctaggcactggaccgaggtgctgctctcttaaaagttgacaagattgtgactggacataatgctgatgacattgcagaaactgtgttattgaatatattacgtggtgatattgcacggttagtgctgatcattcctttgtccttttttttctgtggttgatgttaaggctgattttctttatatataggttaagtagatgtacctttataactactggcgaagatgggccaatcccaagatgcaagccttt

SEQ ID NO: 61496 - DNA, 1790 bp, Oryza sativa
tgttataccgtaccagatcaaatatcctcaggtctttcttagggtcaagatgatccgcggtataaaagggacccccagggaggagtgaggggtatccaattcaactaccaacacacccaccatagtttgcaaagccggagtacacgaagccaatttgccgggagatctcgtcgaaaccctcgactacgatctcgtcggtattatttgtctcgactactctctttgtaatctgttatcaccatcataaattccataaaaactggactagggctattacctgatcaggggcctgaaccagtataatccttatcttttgtctgcttgatgtcatacttcgtagaccctcgttccaacgtacccggtactcaactcatccggtccgtgagtatcactcgtcgaaagtttctacaaaaatcgtggtagtagctccgaaaacgtgttcatgataatccatatagaatcatttgaatttaagttagggaaacatttgaatcattgtacaattgtgcataggttgaatcatatacacagttgaagatagaatttataaaaatatttacaaaaatataattatgtacttaatttataaggaagacaacgcagtgggacaacaaagggaatttataaatcaaaacaatagaatgccattatttttctattcgggacgtatgcacatgcacaccaatagaatttgcattattatgataagatagttaagaagtcccatggataaacgatacgaatttgtccgtctcgacgaattgagcttgagcttatccaccgaccccttctacgtcattcaatgcgtattgcatttctgtgctcctttaatagttgataatctacttatgttttattagactcagttattttttcaccatgatatgttggattgacattgtcgatctacaaagtgaatccgcacatccttggattgacctaagaaataaataaagttagtcagtaaggtagtaatattatgcaaatgttagcgaaattgaaaaaaatgtaaggcttcgacgtacgacgaagctgttatttacgttggggcagacaaaatatctccttccacatgtttcttctgcaaaggaggtagctatctggcagcgacctctacaaccgtactttgaatgctcggaccatttaggtaaacctaatggattgttctttcagtctaagctagcaaattgtacccggcattcatactccatccatgactggttgaattgtgtggtcgcttctgtcaggttatggataccacatacctaatagtagttgactaaatctcggcaggacccaccacataccatgtcttatacagaaacaaccttcggatataggatgagttccgtataaggaaggatgaatagagttttacatggaaaagacaaggactactcggattgtatccatattagttttcctagttttacttgtacaaggggacacctatgagtataaatacaaaacaccttatgaggagagaggacacggacaacatagacaccacaaagccacaagccaatacaagcatacatacgccaagacaagctgctagatatcgacatcagagataagcctaggaaaaccccatatggtacctacgggaaccaaagagaggaatctagtgctgtctctgatctcgccgggcaagaactcgaggaggaagactaccctgttgtcgactacgggatggtttcatggccgccatgtcgacaatagatagataggctaccccaaacattgtattggtgtgattatggtgaataagagcaatgaccggcttcggc

SEQ ID NO: 61497 - DNA, 8160 bp, Oryza sativa
gcctactttcccaacgcgtgtgcacacctcgtcggatgggattaccgtaccagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaattccttaatcaaatggattaattctcaaaactcttcatcccattgatatcccatagaagaatgaattcacatgaattcctagcataatgagccttggaatttatttgatttaaatggattaattacccaattaaatctaacatgttggtctattcgaccactgtctttctttctttttagttttcctttggctgcccagctagctatatttgtaggtggaagattgcattatacgagttaaaacttcacgtcatatagtttcagcagttcctagttgcataatgcctcagtttcaggttataacatgttttaactttagtcaaaatcaaactgttttaaatttgactaagtttatagacaaatataataatatttatattaccaaattagttttattaaattaataattaaatatatttttataataaatttatcttgggtcgaaaatattattattttttttataaacttagttttgaccaacaatcagtctattggtaatgttagtacaataattataatattttctgcggccctataatttgctattatcatttgaataaaattacattactcggatttaaacttatcttttttaaaagaaatatatatgcttgtatgtagattatacttcaaatttgcaatgatatagcaggtggggtctgttaaaagcataatttttcttttgctattagaatattacctcgaatgaatagggtgagaggagaaacaacagttattgagtctaaaaccacaattattagaaaaaaaagtgtaacttttattagttgcacttcccaagaagacactgattaaatccaatcaccagaatgatttctataattaactcaaccatatctattctccttctccctcattgtcatgctaattaactgaattggttaacattttctgtttgtctttttaagaaaaagagaacgagtcctcccccatttccattaaagaaatgagcactgagtttctacaaggtttccagaaagataagagctaaaacagagagaattcaggagtacgcatgctcaaagaactactaacatgcatcctcttccagttgcaaactgggacaagaagacgccatcccatcctttcttcgcaccatctgcacctgcttccagacgatcgaccacaaagctcgaaaaggacaacaaataaacgaaccatcgttaacattctcaaaaatcaccatcgcaggggtaagcgatgcatgttaatagacagcactctgccaactatatatttgacaggtgttggaaccctgcaattttcaccacagaactaaaggatcaacccgggagaggatgccagtgcacaggcacaagaatagtctcgatgtcttccatgcccaagttcatggatacagatgtgactgtgccatgcaatttcgcttaagctagctttactactagctacctgctgagtattattgctagctttctatctcacatatatttgaccatccaatttatagatcaggaagatcgagatcccccaatggtttcgctggcccttctgtatgtcacccggtgacctcctagccaaggtaataaatagtgttcataatgcccataatagcggccgctatagcggtagtggacctctaccgctaccgctacaaggtagcggactgaagatagcatgttgtaacttagcatccgctataacgtttcgctaccactatagtagcctgttatataacgcttcgcgaccgctataacagcccactattgactttgttggaccgttataatgcttaaatgctattcttcatatatgaattgtagaactttacattgtttatcttatttatcttatccatctatatgttatttcatattttttatgttatgaaatataggaatgtattattaattctaatttttacgtgaaattgatgttaatattgatatatttatggttattttcttatatttgctattggaacttagcgtccgcaatagcgcccgctatccgtaattcgctacacagacactaattcgctaacaacccgctatacgctatttattagcttgctcctagcgtaggttaatacgccctccaccggaccactttctgtctagaggttacaaccaatctaaccaagacatacgtatttaattggagcctacgaaatacaaccaagagcattaagacttttatagttatatcttcaccactaatcatttatctaagaattgcaagaaataaagtgtcagtgggactaagggagtactatagctagtatataaaatattaccactactataaaacattacgtaaggactgatcttatatgtgctgatttacgtaaaaatgatatctatgaggcatttattgtgtaaacgagtcttttaacaagatagaaataaagaaccggcacctataaccactcattggtgctggtttataataaaaagggttaagtccgatttagccccctcaactatcacaaaagttcaatttagctctcccaactctaatactagatgttttacacctattaactttttaaaccagacccaataccctgaccgaaccaatagtagtttagtcctatgtattatgtaacatatggatgttcatatgggacgcactgtcagccccctattcattgtcttcttccccctaattaacaccccccacacacacacacacgcgagccgcagatctcccaaacatccgcttctcaaaatgtttcctactcggcgagctgcacttgattatgtgatgcatgcatcgtttggttcatccaggttgcactgatcttcaatttgtaataaaaatcatagatcgaacagaccaacaaattaaataacgaggaaacaatttcaaatgggcaattaagtgacaagaaactaaagaattaaagattttgttgtatctaggaaccaacaaatatgtagattatcatatacccgcatggatggttcatccgattgaagataggaggttgggccaattctgcatattatgtaaatagactatactttagaatatttcacaagtcttagttgtgtacgattatgtcaataaatgaggaaaccaagtcgtgtctgagagggtcctctccctggtaaccctgccccctaacctatataaggtgggcatggtcagatcgtcgatcaatacaacacccccggtagattaaatcctcaaaacataactaaggtattacttttcatcgagaagatctaaatctgtataaacctttccccccttactcatccactttagatctcctatgtcatccactttagatctcctatgcaaccctgttttttcattgccgatttttagaatcaacccttagcgcacttagtgcattactcagatacgaggcaaaacctactcttttttttttttttgcgtcgagttttcaactgacaagtgctactggatcaactttgggagccagcgactttgcttttcctccgagccagcatacgcggatctacaggtggtcccgtcagggaaggaccccacgtcctcggttccattcggactcccgtacaccgcccaaacctactcaatgatattctctgagtgtgctacatgtatgagttttattgattaattgagtttttcagatgagagttttttttttgggggggtttgagactagttccagctggcatgtatggagaaacatgtacatctgcattgaaattttgtaacatactcaaaaatcttgaatttttggagaaaatttttcgcgacaagatttccttttggttcttattgcatttttctaaattggagcatttcctatttttatcctttttaaatttatatttctaattaattaggttgtgtttttatttcaaaaacattcaaatccgtttggtaatctaaaagtttattttaaaatttctttgtcaagttcaaaaagtcctcaaatttatctcctcaagtttcatctcctttaaatcctatttcaaatctatttataaattgcaaaaggctcctatttagtttgggccgaagtcccttcattcggcccaattggcaaaagtctatatggcctccctcctccttcctgtgagccgccgccgccaccactgcaaccagccgccgccgccgctagccaatccgccgccgccacctcacccaaccaatccgccgcagccacctcaccgcgtcaatccgccgccgccacgcgtcaccgaaagccgtcgccgaccaacgaaaccgccatcgtcggccaatccgacgaggccacccggcgccgcttctctgcatttaaatcgaagcacgctgtgccgtcgccggtttctcttctatccaccgcctctcgccgcctataaaaggacgacgaggttccctcttcctccccacacaaaccgagctcctcaagctctctctctttctctcccatgtccggccattagtgccaccggcagatctccctcaccggagtttcgcaagccaagcccttgcgccaccaactccgcctcgccgaggtgattccatttttcccatttccccttttcctccaccttgagataagccgccgccaccaccaccttctcttatcgccggagctgagctcttgtcgccgctgttccggccacccctctctctccctccgccttccaccaccctccccgggtgcgcgttgctcgggaacaccatctccaaccggcgttctcacctccaggccaccggagagccggcgccttgcttgccctcctctctgttacctctcagctgccaaacagaagaaaaaaaaaagaacgagaggaagaacaggaaggagaaggcattgacaagtaggccccactgaataataactccctttttcttttatttgttttttaatctttaagagctcatatctcttcaaccacaaatccaattccaagaattctttgatctaaattcatccaatttcaaatcctttattttgataccaaatttcctatttttaaaattttatttaaaattctttatttaaaaaccttttccttatttatttatttatttactttctaattctaaatttattttaattaacctttaaaaaaatatatatattaaatttatttgatttattttatatccctttaattttaaatttcttgtttgaaaaacctttttaaaatttaattttcctttaatttctttaaatgccatttcctttcaaaattcaaatatcttttgaccttttgtatttgcctctcttcatactccaattttgttattttcttttaccatttatttgtagtactttttttttcttataggttttatttgctatcttttacgtatacgtacgttagacaatacagaagatctcatcgacatcacaggagctggcgtggatccagccgactacgctgaagccttcgaaagtttcaaggcacaaggcaagacaattaaaattttgagcacattaaataatcaacccccatatttactttatgcataagttaatcatatgaataacactatggtggtttcaaatgatatataatgcttttaaacattgttatatgagattatggaaagatacactgaacatcattttatgtggtttactattcaaacatcttttacaaacttagaattcggttaaaatgggcatttgtgaatgttgatatatgatgaagtttgttggtgtggggagtttggaaagttttgggtggtttaaccggattataattacccccttataccatagaaatgacatagttgcgtccatccacacgatcaagtaattggacttagcctagtacattgtcccactatatgaaagactgttggttggctcactagaagcaggattggggtaaacgcatgtgtaaggaggttgggggcatggttaacaacggtggaacccgtgaaagcagcaaccaagtagccttgcttaggcccagcaagtgcccgactgctaggacggatcaatatcccactcgtgcagtaactagtagtaagtgggaccttcgaacggctctggtgtcctcagccttgcaaactgttgacatcgtgtgggtaaagctggacagtctctgcagaggtgaattaaatcatttgaatgtccgtactcccgattctggagttgtgtcataagggtgattcctactcctgacatataagtagttttaaacataaaatagtggtaaagataatgagaatttgctgttatatttattttctctttattttaatatcttatgcttagaaggatcatatttaaatttccatgattatgttcataacatattataagtgtcttgcagagtacataagtactcattcttgaattatttaacatatagaagaaccgtgttatgaagaagtcccagaaggtagcgaggcctactacaacgacgagtttttctaggcttaatctatactcaagcttatgcctgtgaagtttagtagctttgggtttttctttgtactttcaaataaggttgtaatagtttgtatctttaaaaccattaacagttgtataattagtttgcatgaacaaatttgtataattaatcgaaagctgttctgtatatcaatctgtgcgtgatcgaaatcctggacgatcacgagtggactttcggggcaccaagcctaaattgggtgtccccacaaatttctatggtaaaaaagtaaacaatgtggacaaaattaccagttctacaaaattaaaattaaggaggacaaaatggacagcgtcccgtcaaattaaaatcagtacacaatgaacaaaattagataaattatactaaaactagtctctactattataaaaagttgaagatatttttaccggttctttagtacgtcatctatgtataagtcggtttttaaatttgtactgttttgaaaatacatatccgtatttgagtggaattttaagtttgttcgcttttggaaataaaaaagagtcgtataagaaatcttttttaaaaaaactcgcatgctaacttgacatgattttctagaaaaatatatatccaagtgaattctcacactgaatttcacattgaacaataataagattaaaaatagccttcgcccgttgcaacgcacatgtattttttctagtattaaaaaaattgaaagtgcattccaacttctggcaaacaaagcaaacaatgggaatatcattactgttatgcaaaactaagaacatttttctgtatgattaaaattgttactagaaataaactgaaatcaccatcctcccaaatgaaactggtattcaaaaataaatgaaaaaagaacgttctgctaaattaaaattagtattagaaaaaaatcagatagagattttctttcagcaggaatatccatacgggacttgttataataaaacaagcagggtgattagcgatttccaggaacaatgcggctgcttattccttgaaatcgcgatccaataaagtgcggcgcggtagctacacgctgggagaaggcgggagccatgcgctgggattgggatttgggagacgggcgtgaacaatgtgggacgatcgagcaaaagtgttagatagcaacagagaactcccacgttatagtttcaccgtagtcagctgagacgccggagaaaatagtcctgataccttccatttctaagtagatcgatgcatggatccaaatgtgcatgcgccagtgtgctataattaagtttgacggacttaaccatggagtacatatataggtttacttaaaacccgtgggatcggttgaagattaggggcgccacgtcagcaaatttacaaaaaaaaccctgtatttttggtaattacatactggtttccaccaacatcgtccgttcgatctcgcggtagagccgatctaaccgtccacatgtccactatggcggccctttctcagccgtgggatcgttgaatcggcaatcaacggcatagat

SEQ ID NO: 61498 - DNA, 2944 bp, Oryza sativa
  unsure (1)..(2944): unsure at all n locations
ccagccatcctcgccctagccgcactactaggctcgcgcgcgcatgacctcacctgccgccgccgccgctcgcccgccgccgcttgcccgccgccgctcgcctgccgctcgcctgccgccgccgccgccgccgccgcggctgctcgcctgccgccgtgccgctcccctcgctcggcacaccaggccaccttctcccctcttctctcctctcatctccaggccacccaccgcctccctcttcctctccctatcctcggtgagctacagatccggttcgggggtcatcggaatcgatggtctcggccattggtctcctcgccggtgaatcgttttgatacccttctgcatacatttagcacaaaatccacatggtaaggcaatggttttgacttgccattaagcatttgcattgcgtttgctggtgtttttacatgatcccccatcttgccttaggttctgtggagaaattgatgggctaggatgaggtgtaagtcgcagattacagagaggacgactttcattctgcgcatctaccgtcatactgaacaagttatcgagctttctcctctcttaatcagggcgtgcgatatttagattatggtgagtttttcttgagttcagattatttcatatgaatttagctgtcagaagttcgatggttattggttttgttgctgcattgtatggcactccttgatagaataacatcaggaagaaaaaagaataccatgataggtgttacaaggctataagtataaggtaatatgagagcattctgcaaacaggatatgcaatggaaggatattctttttattaactttggtaaaatacctgccaatagcccattattgacatcaaaaccccctagctctaatactgggagcataacacgctgatagacagtgtgcaaagcttttactggtgtctaatttgttgcacaaaattattactacttcaccggatttatgtggtttgttgtgttggtccagttcagcaaagaaagttggtaggatcatggagaaaatgaatcgtatggttattttttcattgcttggtggtgtttcacacaactcaatctgctgccatatatccataaaacaaaacattcagaaatgtagttatttagtactatcctaaaacttacattctgccaaaaaaaataacttttagcgtgcctgttatttttataatttaatgtgtaaatgatgaagagtgcaagcatctaattttctcctctgccttgacacaagagtttaggccactagaatgtcctagcagcactgaaaatactctatgcatataagcatataaattttccatgtggcacgtgtccacttatgccacattgcttctggttatgtgcacacacatattcaaagggccaaataaatatatatggtaccctgcctcaaggtccacttcaatccatttttatattggtagggggccttagcctaataaaagtatcccatattcctactatcttctgttaggctttcacatttaactattttattttgtcgacatcgtttaacttggtgttttttccccttttcctaagtggttggttgatactattacaatagtatagatacacataatggagccatgtttcaggttagaacttccaatctgcatcttttattgttatgttcaccttcaaattttcatgatgttcaaatgtgcttagaaaatcaagaaccaaagatggaagacattattaagctagaaacaaattacagccttgcagagttaaaagacttgaaagtggttgaccatgtctcaagacccaacactttcatcttagaaatgttaattgaaagctttctcaatgacattattttccatatatcaattactccaactaatctggtactagctactgtatatgcatagtgaatagttagtattgcttaaacaatgtctgggaccgttatattcgttgtaagcatatatttcaattgttttcctatgatggtcagtcaaaaccagataatcaaaaaagagataaaaaactactctctattggttatttgattttcaggctttcaagagattagactactaggcctgcataatttgaaatgctatttaataaactatatatgtatttaaatgttcagaaatttagttccagtttaaaatttcaggtgtatgcaatgttgaaaaccaccaaatctgggcatttccttccaaacaacttctttgagatgaaatagattctgggcagttgtttcttccaccgtccttcattatctttgtactctcgcatctaaattatcctatgtcaaatgtgcatatgatttagttcacagctaaatgcatctaaagggccaacaccagatcttctgcaggtaactgtggcctaacatctaaagccattagtagtacccatgttcttttttagttcataagtcctggtactgatgtggtgatgctaagaaaggtttatgtgtgatacaattaataagatgttaaccaccaaaaagaatacnaaaagctgtgcacttgtgcattaattgatactccgtaatttgtgtttgcagacgcagcaaaaatatattagagtacaaagggtaatttgtctttgccaaaagaatggagttgattttcctatcttcttaataggaaagaattcaagtacatagtctcttctaggtaatttcttccagagtttcagtgctgtctgggattacaagcagtcaatgcctcttcttaagtaatttccttcagtgtcgtctgggattacaagcagtagatgcccgatgccacaagtgttagcttatatgtgagaaacctacaaatacttaaaattagatgctactgccgaacctacaaatctgttctcaattctgatgggtttgatgcttgcctaaaagtgcagaaaaaacaaggttggtatgccgcatgtcttcactttctaccacagagttattgcacgttt

SEQ ID NO: 61499 - DNA, 1729 bp, Oryza sativa
ttgaacttagtaaattatgattggtgcagacctagagctatactggacatcataaaatcaggtgagaattttaggatctccacaacaacaaggatgccagagcaaggaacatgtgaacgttgtggctacatttctagtcaggtatagtgatggtataataatatatatatatgttgactttttaggacctcttccttgctgatttactcaatgagactgatgctaattagattaagtgaataacagaggtgcttttgctaagtcattagataggttgtcattttattttcgttttgagggaaacattgtcagtttattcagttataccagtttatttgtgccattacagtttgtttctttgaagtgtttgaataactcacccatatgatagttcaatccatcttgtgcattccatgaactatcgaaacatgaccatggctgctgaggccctctgcattgtgctcactcatataaaaaagctatctaatgatgtgactggcatgaattcccctgatttccaatgcttttactgaacatcagttgacattctggtcttcgtagaaattatgcaaagcatgcgtcttgctggacggattgaatcgaggcttgccaaaactaggcatagggaggaccaaaggcgtagctggaggtgatagtgactgtgagcagcaggccaaacgtccggagaggagcaggtcgagtctgcaaggaaaacatggaaacgtcgacttttagatattatcagtttttttgctcaaagcctcaaaggcttctgccgagatattttgttaaaatgtcattgttggtttactacacctggatcatttgacatgattcagttgtacaatctgactatgggcctatttttgggagcttctagttattacagtttctctcaaaatcagaagcttccctaaacagtctagcttttggtctaagattctaagaaactatacttgtaaaatctagaaaatgaactaagagccagaagctgagaaacccagcttttctatatttttataagctagctaaaaacaagctgcttctcacaatctgaagctcttcaaaagacccattgtaagatggcttgctaaactgtcagctggctgattccacagcatgtgttctgtacatgattcgcgacgaccagagtcgtccacacaacggtcacactatcctgttataaatcctgtttgaaaccagatactctctctatctcgtagtataagggattttgagcttttccctgtaacgtttgaccactcgtcttattcaatttttttaaattattatttattttatttgtgacttactttattatccctagtacttaaagcacaattttttgttttttatatttgcaaaaaacatttcaataagacgagtggtcaaacgttgcaagtaaaaactcaaaatcttttatattgtgggacggagggagtatgtttttgtttgctttatcccttgattttttttattttttattttatatattaaaatatttataggaatgatttttttgtttgaaaattattcctttatcaataaacagttgactttatgaaaaattctaaaaatagttaacagtgaatatgagaacacaattatttttcaaacattgtttcttaataatagatagaaacccggcctctatattcatatgtgccaccatttactattaagcgatttccacgattgggatgaagcgaccaagacaattaggataaga

SEQ ID NO: 61500 - DNA, 549 bp, Oryza sativa
ttcttttgattataacacacgctattgttacatgaaagctggttcagacctggatagcctgggtacgccctgaaaagggtaactgaaaatgaatcttaaaattatgctggactagtggaattggccaacctagcagttgtaagatttttgagtttgcgatactttgttgctgacagatctgctttttgctaattgaaccagggctttccaccatttccgaaatcaagatagcagccccattatcaagcatccagaattggagaggctcctaaaggaggagttccgaaccatcgaggatttcaaggcacggaaggcagcagagaaagaaactggcagcagtactgctgccgccgcaggccataacaaggctgatgcgaagtaggtcctagcatggcatgaaattttggtggtcatcccacaaaaaggagaaagtagcaaaaccgtttttgtttggtgaaaaacttaaggatttgagtagacacctgtgcagattttgttctcccctgccgacgatacttgtgtggccttgtccaggaaattttcctctcg

SEQ ID NO: 61501 - DNA, 776 bp, Oryza sativa
  unsure (1)..(776): unsure at all n locations
cgcgttgatggcttctcgntggtacagtagttcatcaatacttttgatccccaaagacagggatacgaatccaagtttgatgaccaccaacaatagaaaacattcatgtgaatagtccagcatacataaggtattgcattaaacaaagccgtatgatctgtagtgacacttgtgtataaccaaagtagtaggattaaaacgggagcaaaaccttacttttgtctacgcttttgtgctttgtcagtttgatttcacacatgatgtgcaaattatcatgtgttttgtgagggtaaattttggatatggtccagggaatatatatatatatatatatatatatatatatatatatatatatatatatatatatatatatatatatatacatactagtacaacctgtcaggtgtgggcctactatgaggcaaaaaggtttaagtgagaggaaccactgatatatctttgggcatatgcattggctcattatggtaatttaaaacaacattttttacgttttgatacaggagggtataatataatattatataatccatcaaaggtttcgatattgagtagaaagattatgggtagtgtacaggggcacaattatgctgccttctagttttttatagtacaagcattatatgaatattttaattggaatgcttatttttaaggagcattttctgttttataagaccattttattcctctttccactcgctaagcaaaatatgagcttcttttttgagagaatatcacttattcactccctc

SEQ ID NO: 61502 - DNA, 5956 bp, Oryza sativa
  unsure (1)..(5956): unsure at all n locations
tgttctaattccatacttgcaactccagacattccaatatggagatctagtgcactgtgaaactacttttgagaagatgggccgcacatcacaggtttgtgtctaaattctgatcagcttctttcttattttcactacttttcggatttttgtggtcccaatttaagcttgtggatgcatttctgaacatatttcaggtaaacatcatatgcggtcaatgcccaaataaagaatgcaaaggtctgttgatttttcttattttccatacacctttctgattcttggggggagtactaactaaaatttgattatggttggctgcatataacaagtttctgattcttgcggggagtactaactaaaattgataactttattataggcaaacaaggatgcatctgtagtatatcttatgatgaactgatgtgcaggtaaccagtttactttatttgcattttgggtgaagttttctttctgataattgatgcagtagttgtggattttacccagtgcctactgcctatactaattttcctttttagtttcttgtaaatgcatcccatccctattttatgtttgatgtactaagtactaactgccaggctctcccttgctgtattcaaaaaacttgtaagagttggggatgttttcatttgtatagaactattagtgtggaagtagtaaccggattccaaaaaattttatgttcgctagtaaacagaataattgaaccaagattactatttttttagaggaaaccatgattactattgagtctaggtcttctcatccaagttgttcccatgctgttagcatgccatgataatatcttgtaaaacgaaagacaatattgtgttaaactttgaagcggtttagcacaaacttttttagacacaagaagaggaatagatggacaaggatgtaatcatgtaaattgctttgaacagaatggtgccaaactttgtagagaatatgactgatataaacatgattctctaaaatcaaagaaaataaagtttgaacattgagtatgatatatatttcaaatctgtgattgcttcttggtgttttgttttactccttttttatatgttcttatatatgtttatagcattatggtgttacttgattgattctagtgtgtgcttgactggtggctaaatgtgatctttctgtcagggtgactggtgaacttgctatcccatgtcctaaaagtggtccaagagtatttaagggtttcactgtcggattccatccccggtcatcagagttggtaatgctggctgattggcttttcttatttttggggatcttaactattatttcagtttgatttacaagtaattttgttaccctaggtttataatggattgactcaactgggatttgagcaatctcatcatgagttcaggtattatcctgtcaaagtattgttaacttttaattagatgatgttggcctatttaagcttcagcttatctgaatagaaaatacgtaattggacactttgattgctttcagaaaagaactttcatcaggcttaatataggatgcagtgcctagagagggttgacttgtttttaggtgggatttctgtaagttattaagtataaagcctatatggttggttggacccagctgtctctgtctgtggggtgatctagttgcttgagtaaccagtttgttacttagtggctacaacagatgcatggcatgggctagaccactcaggcactgacctgtcattgtgggaacttttgggggggggggatgattaaatgaaacaccccatatccatccaaatgcatggatggaagggaagtctttaaacaaaatgccatatgttcaagtcaaaaactagagtttgttgttttgccatgaattctggtgctattagtggatccaagtaggtgctgaaataaatgtaggtcggacagggtaataatcaaagcttattctgatgcatattatgtaagaaaaacttggacatgattcaaaacgtgattgagtgatggatagtcctaaaatggttgattggatgaatgtaacacaatatatatagatatattttttgttatttcccagtacatgtgaaaattttcaactagtcctaaactcccagaatttctgctgtgaaattttaaacaaccgctacattatttacatgtaatttccattgcattattctgttttctgtgcagctttcagggtgagcagagtcatgtatccctgtatcttagtgcagtgttttcactctcaggacttgttggaaaaccttccttgaaggtagggaaaaaaggatttaggccataaaaacaacactttttccatatgtttttcttcattgatgaaatgtttttttcccatcagatttcgtacttttgtgatgttgtatgttgctccgtgttagtgaccacttcatcagtgcagtcaagcctagcttagttgataataatactgcagttgtcattagtagaactgtactgtatacatgtaacttttaaaccattttattgaaccaggttaatccagttaaagggcttgatgtgacactgacaggatcagggaccaacggtgctatgcctactaccctgtcccctacaattctgaatgtgatctggagatgttagttgcatccttgtctctccgaacagatgcattgatacattcaatgtatgagcttgttttctatattttgtaggtgaaatcgcgcggagcagtccttatgaggtcaacattttgattccagtagaaggctatgatccaattgaatttacgctcaccaaagaatgtggttggttcgaccacataattgtcagttctacataagtgcatattgacttctagtcgcatttagacacatttcaattgagaaaatttcgtacgttagaaatccgatgggtttagttttcaataatatgggacataaatttaagaaaaataaaaaaaactaacattcattttaacttagtgtagtttgcaattctatgattagcaccatctgaatatttgctctgtagattggacaagtgtgttcctatcttgaagtcaagaagtcaagatatttatggcaatcattagtttattatatttatcttgaagatgaataactactaaaagctgcatataactagtattgtgatacaagcaaggtgaacaaaagttagttgattagtcttacaattctcatcttccttgttcaaaaatgcacagatatatttcagtttgattaccctgtgagttatgcatttgtttgtttgtgtagttcatatacaagaaaaagagagtaatccaatgagaggctgggcaacatttgggattatttcttgcatgtatgtgtgccttgaactttgtaaattagcttcacagcaatggtatatatcgtaccatgaattacaaagtctgttttctgaaattagctcttcctcaaatttggaatcgtttgtttcatatgtataaattgtcctgggccttataaactagcttcacagtgaccacctcagattctttcgtaaacatctttgttgcaattagttttcctctgacgctctattcatcgattttttactgtttttctatgggcatgcagcttcattgtgttgtcaagtctactttgttgtggaggtttcatctacaaaacacgtgtccaacatcaggtaaaattttattctgtaaaacaaaaatcttataagcaatactgtgcagaattgtcttgataaatggcacctttgcgccaatttcagtctggtttatatgcgctgcctgggatgaccatcttgtctgccttcctagatgcggtaagtgttgaaacttttatctgaactacctgctcattgccatatgacaaagtaattaataatcatataataaaatgccaaaatacttatttgtaacctaatcgtttgtgatcaggttggtggaccaagctacatgagagcagatgatcatggcggaaaccatgcaagccaagcatcatgggaacgcatgcctggtacctcacaagcagcagagcatggcaccaaagataggagatacggatcactttgaactgaacgatgctttagtttttgagggttgcttttttgtaagtttgaagtattctgtaatcagacaaactctgcacttcatctgcagttgagcttccgaagcattgcttatcatcttttcagcttagatggtgttatgaattgtggtggtggatcattcagcatgccaccatcgtcatcgccatccgatcgacgtgcatgctcattagcagatactagacctctgttcttagatagtgctccctccagtttttaatgctcaacattattgactttggacatatgtttaatgatttatcttattaaaaaacttatgtaattataatttattttgttatttgttttattattaaagaaaagcatgactttatattttttttgcatacttacattattttttttaatataagatgatgaatagtccgacgtacatccaaaaccaaaagtcacggatgtcaacatctatcatatctagggttttcaatttcgaaatcagttttttttttgtcgggggagaccgaaatttcggtaatttcagaaattttttttggccaaaattatttgaaactgactgattttgattaaattcgaataaaatttgaccaaattcaaaaaaaatgcaaaaaaaaaaaaaactgaaaatttcaggtgagatttgagcttgccggtagggggcgaaattaccgaaatttcaaaccgtgatcatatatttaccctgtagttcaataaatagttttactcaccactcattctttttattcatcgctcaacggtccagatcatctcgctcacatccaacgcatgcatcagaatcaactagccggaaaatcgcgcacgcgggatccaccaaatcgcgcgcccttctccctccgcgcgcgcctacgccaaatcgccaaccgccgccgccctctctcccgcacccgtcgcgaatccccctccgcctccgcaatccgccgcggcacccacacctccctcccctcccagatcgccgccgccgatcccccgcgtcctccaccgtcgccgaatccccttcagcgttggatcgagcgccgtcgtcatcatcatatcctaactgaccaagcaagcagcggtgattttttgttgaaggcggtttaattaccttcgttattcggttcgtgcaaccacactctctcaccttcacttgacacacggacgatcgatgggcaacgccgtcggcgcggcggcgaacggcgtcaccgccttcttcggcaacaccttgttcgcgccattccgatccctcttagacgtctcctgcgagtaagaacttctgttttttttttttactgaaattgatgttcttgcgtccgatgagaagaataatccgtgtaaatgttgttcaaattaatcgcgcgctgattttgttgttgttgttgttatttaaattaattcttgatcatcttctagtggcgtttgcgcgggaacatgggacgcgttctgcttcatcgaccatctctgcgcgctcagcctcggcaaactcatcctgttccttgtcctctcctacctcagtaagttttgctactcgtagcgtttttttttgtttgaattctatactaaatttcatccaagtttgttctaaattaatctagcagcgtgttaattgatatttcgatgatttgatttgattcgcagtgctgctggtgatgtggaagctcggcggcaagtgcgtgctcaagagcgcctgcaagacggccatggcggcgtgctcctgctgctgccacgccatggcggccgcgccgtgctacctctggcgcgcgctgcggagcaccaggcgcgtgcgccgcgggcgccgccgccgccgcgacgacgacgtggaggaaggaagaggaggaggaggaggatggggcggctcgtgatgaagtacgtgcagtagcaagnggtccataacgcgg

SEQ ID NO: 61503 - DNA, 5434 bp, Oryza sativa
catctatacgcgattttcagaaagtctggtccgtacgaccaatacaaccattaccgttgcgctatggccagacagtgggatgtacggtcctcttctaggtacataacgtatttcatttctgctgcttcaatgtatgaactaacataatacttaatgcatcatattatacacatgtgcatccaaatgttcgagaagacataataaacgatatcttactccacgatcaggtgaagtttgccttaagatgcagagcaatcaatctacaaccgagcgacactgacactacctcatctcctgagagagactgatatgaaaatgaacgtgaaatcgatgatgacaaataaatattctatttttcggcatttggttgttatgtaataaataaacaattaatgtttatttcataaattaccaatgtattgcttacaataatgttattttttatttggttcctactatgattatttaataatgtatcagtaaatgctcaacaataaccgtattttttttctcaattctatctatcaacgtgcattgcacatgcacgctcactagtaattatagcttaagacagttttcttatggcaaaatttactaaaggacacttcaaaattgtgtaattagctgtgggacatccgaaagatgtaaatttgtccgaggacactctaaaagtgtggtaatttgctgcaggacattgggcatattaaaatataatatccactgaattgatgagagagaaaccacgtaaaatgattgttttgccccttctcttcttccccttcgtcttccccaacactagctgcctagcgccattgccgatttccgcttcctcggtgagccccgcatcgattccttgcacctatagcctccctaggatctctttaactcgttgggcatacatgcatggcagtccattgaaggaatcaagccgtcgccgttcaccatgctcagcgtcctcgtcatcgcccacaccgccgcccatgtcgctgcaagagacgacatcgaggtcgtcgctcccggaccggctcatctcgttctccactgccacgccctcctcctccccgccgctcggctgctggtgcggtggtgactgattgggtggttgtggggtgcaggcgatacgggcaaaggatctgaacgagatgttcccggtggccaacgcggaggtggcgccgatgttgaacccgcgagggttcgcgaacctgctgtggaagcagctcaaccacctcggtaacaccgggttcgacctggcgctgttccgcgtcaacgcctacagcaacatgctctacctccatgccgactccacctcgcctctcacgtaagacatcgaccactggttcccctgtgcccgtaagaaacacagaaattgaacgaactcatcccaagatccgcttcgagatcattcattcgtagatagggctgagggcaattttgtcgttttgaaatttctctcccatctttttatcagaaataataaaatattgtctcgggtgtcctacagcaaattacatgaattttgtggtatccatcagcaacgacacaattttacagtgtctcacaaccaattacacaatttttgggtgtcccagggcaaattttgccttttcttatatgtcgtctccataaaccccatctttgaattgctgcatgaatcatacgcatttggagctaaaaacgagttgaacacaaatagtaaaatgttttttttcaaagaactttaacaaaagacatatttctcacgccaaaaccgttataagtcttttcttttggcatgctctcttattacctgcatcgtcataaatcttatataatcaaaggatatatatagctgatgccatgtaatttcagatggctggaactgcaaccgtctggcatggcctctactctcttcgaacaccttgcggttcaccttgggtacgtactaatgtactatagtgatctttccactccttgatagttggattacgtttccggctgctaattaaagtcgtgcattcagtcgtgcataccgcacacaaattgttacatcaagattcaagacccaccaagatttatgcgacgggacctatcacggtatcacctttcacattgtaggctggatacgctgatttcaggtcagattccgcttgataggcacatcacaggatggcacacaccagccgccagaaaaaaaagctttgcacgagcttaaagcgccaacatggaaacgtggttgctctcaggacacaaacagttaaagtgtttcctgatcccaagtaaaaagacggccgagaagataccatttcacgtggttgctcttaggacacaaatagttactgaagctaagtaaattgatcgactcctatttcacgttcgagacccaaaagaacaagaaaaatattggagtatgagtgaaatacagacttaagcttttggtgaaatggtttgtgcgctatctcacaaattgcactggctggtttaatcatggatggaggaccaaatctgaaggaacacttgaagcatgggacgaccctgccttttcagggtgcagatagaatcgaaacatgtgcaaaacgagcttttggaaaagaagatgctaataagcgcatcgaatcgaaggtgattatgactttaaaaaagggcgccagaatcaaacatgacgaagtatctaggataaagaccctggttttctgataagataagatccgtctaatacagtactaagtgactggtactgatggcaatttttgtttggttctctccaaattggagttactactacctaaagaagagaacgcaccagtaaaaactaaaaagacagtcgagcagaaggctctttgcatctgtaataccaccctccttaagaggatacaactcggtaccgatctgcgataaactgccttctctttccatggggcaaacggcagagtgctgataaaggagtatgcatatgagggctaggccattctttacataaacaaggagaaaagtgatagggctattggttcaagtatctcaggcttcctttgaatagaggtttttgcaggcatttcgagggtgtatctaaaaatctgtcgcaagtttattgcgtaaaatttttcaaatgtaagtatagtacaattttagtgtaattacattgcaactatactaaagttacagtgtaatacatgtaactaatgaaaagcatgcatatctcagctgttaaggagtgcttggtgcgaagcagggaccctgagttcgatccaccggacccacagcgcgccttcacgaatctccgtgcacatcagatggccagaaaatcagaagttgccccaaaataaaactgttggaagtttttttagcgaaaccgttccaaaaggacagggagagactttagacaaaggcatgcacaagtgtacaacgccaaccaacaaataagacggctcatcgcaccttttagtaatgtgaatgacagaatgagagaagaaaggtagataagagagacgaggagaaggagactggccctatagatggacaggttcaggcaaccaagcattagagcattgggggaatccccccgtatctattaacaaataatttcagtctgctaaaatgagagaaaaacgggcacctaaacattatgctgtactgtgtttttgcaaacttgcaacagctgggatacgtaccaatgttcagatgccaagtattcttgccatggtcatgcagctgtgtttcttgcagtgcttttcgcgcagatgaaacttctaccagtttatgcaatttaaaatcgcatatttgcatggctgcagttccagatcaacaaacatgttagaactaaaacaaaaaggagataagaactatgaataatcaaagggataccagaaagcagcctgcacctttcccaatgttatgttccgaaagatacacaatattactgaaggtaggggtgctaatgggtggaaatccaatccattactgccccaacccacttctgtaacaagcatccttccaattcaacccagaccacttctccttcttcaagccccaaaccaatccaacccataaaaagttttgaaccaaacgagtccaacccattctagttaagtgggttcaaccaattctaaatccatggactgaaaccgcagtgtccaatccttggttcaactctcttcacgcacgtacatacatatacatgcatgcgcatatacatgcgtgtatactaccaatatacacatgttccatgcatggatgcatatatccactttagtatcacagaaactttagtatcacagaagctgtggttgcagcgcccagccgaccaccggcgccgccacagagaactccggccacatgggagcacctcctccggccagtggcggagccagaaattatacaagactaggcctaaggtagggctcgactaatggagtattagttttatgaaaaaattacatggtgaatcaacaaaatttaagcaagtttttggaggcaggccgccctaggcctgcctccgcccctacctccggccgccagcttccatgtctccacatttttgctgctgtctccacagagcagaggtgacgacgtcgtcatcgttagtgccaatgatccgctgccccatctggggctaaggccatggaggccgacagctaccagccacctcgtctgcagcgccgctggtgacatggtggcccagaccaggcaggccaaggttgaggttgaaacccatgccaacgcacccctccagcagcggtgccgcaccgagcacgaacagcgagtcagagcagctggcccacatgctgggcagaggtcgccggcggcggcggcaggatgatgatgatgagccggtggtgatctcgccgccatgctcctgccagcggttgcaacgagtagtgacacagaagggtgtgggaggcagagaggaaggtggcaagccaccggcggcgtcaagcgaagtggtggtggtgccgtggctgtcaatgtcataggaagacgaatgtgatttggggacaatccagtggaagcccatgggctgaatccactttctacccaaactttcctaaccaaaaccaatccaatccaaaccgttttacatctccatccaacccaccccagcccattagctgcatcaatccatttcaacccatccaaagccaacccacactgaaatccaatccattaaatccattaggatccaatccatgagcaggcctaactgaaggcatcaaagttggcaaagttgatgatgtagtagcccctttttccctgaaacataacagaaatgcatgtaacttcactattacaatgccattattccagtgggtgacagtgtctcatcaattcagactagctatctagtttagtttgctacttgcaaaagagctcctgagtatgacttttttttgagagagagagaagctcccgagtatgactttactcacactggtgttcgggcacgagctccagttaggcagtg

SEQ ID NO: 61504 - DNA, 5119 bp, Oryza sativa
tgaaagactgcataagaaaccaaattatcagacacatcatcaggattcaggagaaagaaaaatcaggacatgaataccagttgtacttctcgcacaacattttgggggaaaagaagcatgtgaaactcaaattccaaggtagcatcaaacctgcaattttgtggtaccccccatgacaatgccccaaatctttttaagcttggtggcatagacatataattcctccagtcttccattatgactcttagatcatgaagtttgctctgtaatccaatgcaacagtttgcatgcatagtgcaaaccttgtttaaatctctgctgggttcacaaatgccaccaaagtatgtagtgcttaggaacttaattttcagtccaatatctgtaatgtaaggatcatgctttataaaattaaatacatcctgatcatgatagccaggatatctcagtcgcgaagaataccaaaacttgtagaattctatactttgattgtttgacctcacatagttaaatcccccgtttgctatgttccccaaatcagttgcattgcctacatagtgatcacatgcaatctgaaaatctccatcaggatagaaatgaggaaaaggattgcggaaccacgtgatgtctgcatcctgaaatgcagataaaaaatatgtcaggtgtgactaataagaaactctatttcagcttcacatctgctaatttttcaggaaaatatacagccctatgtgcgtataaaagctgattttcaatatagataggacacactcaaaatgcaattgactttaccgagaaaatgaagctgtaacctttttcaagaactagccgcaagaaatccagccttttccacatcatgtccagataaccagcagtcagaaacctcttctcttgagaaaaatccacattctcggttgcaagagcaaagcagtatgcgtggatcttcatacaccttttgtaagccttccaatcaaatgttattatcacaagatgtctcaaaagtgagctagtcctaacaccacggcgaaaactgtcgataaaaagatcaatgaccgagcctgaagaagcccatgcagcattcagtgttgtcaatataatggtcttattatccatggaggcctcctgcagaacttgctcaagtttgaggtcgtcactgtcctaaaagaaaatgcaataagccaataatcaaaatgcaggtctattagctctacttgatctgatgatctctcgaattcaatgacatatcagacagcagtgaaattggaagaaattgcatccgcaaaggaaagcagcaatatactatggcttattgttcacgaatctattagttttcagattttaatgggagaacaaattattggatgctatgtatgataagcattcattgcagaattgatatgacgaacagcatgaaattttgacccgtgaaacaaatataaggaatcttgacccgtaaatcacaatgacggtcatttgattattgttcattactgcaatgcgtatctgtaagtcatagtcgattgaatcagttaatggagtgtcaaacaggatcgatgactaaaaataacctcaaaagcgaaatgagtagaagtgaggtataaaccacgcgattcactaacaacggcacgcagaaaacctatatatatatatatgctaagcacagcaattcgcacctcagataactagaaccgctacagaaaaactcagggggacaaaattaaacagcagaaacgacggggaggaggaggtggaagcaaagcgcaccagatcgtcggccgcagcgggatcgacgtcgccgtcctcctcggggaccacaacagcagggggcggctggccccgctcccaccacggcccgcgatcccatcccacctgcaccggttggaccgcgtccaacaccgcggcgcggtacagcacggcacagggcagcgccacggccgccgcgagcaggagcgccgccgcggctttccggagagccggcgcggacagcggcagcgacggcttcgagtgcccagggaagtgacggagggaggtggcggacgtccgtgccacggtctggttcggcaacggcctcgccattgcgagagcggcggcggcggcggcggcggatgaccacgacaccgacgcggacacgcggcgcggcgggggacggggaggggaaagtgcaaagcggcagcgtaacggtcggtgaaggcgtaaactcgtggtttccgtaacgcagcgttaaagcggataccgcctacgggagagagagagaggggatagccgctcgcacgtgaggcggccgcacacgcgggctgccagatgggccaccgcatgcgaggtgtcactcgcgcggtgcaccgctgcaccatcaccgccttccagtctccatgaccgatcgggcccactcttggtcgctctacctggccccacatgtcatccactcgtgctacgcagcagttgagcaatcggtgattaaaaaaaaattccacacccaaaccctagccccgcaccgatccctctccctctcccgccgccaccgcctccgcctccgcctcccctcgcgccgtcgccgtcgccaagagccgccacttccgcttccgcctctgcctcgtccaagtccaagccaactacctaaacctaaaccctattcttcttctttcgcctccgccgcgatgtcgtcggagcctccacccgatgccgccgccgccgccgcctcctccgcgggggatctcgcggccgatctctcctccgccaccatcagcaagaagcagctcaagaaggatgcgaggaaggcggagaaggccgagaaggcgtcgcagcgccagcagcagcagcagccgcaggccgacgccgacgaccccttcgcggccaactacggcgacgtccccgtcgaggagatccagtccaagaccatctccggccgcgtgtggaccgagatcggcggcctcgacgaggccgccgccggccgctccgtcctcatccgcggcgccgcgcaggcgatccggcccgtcagcaagaagatggccttcgttgtgctgcgcgagagcatgagcaccgtccagtgcgtgctcgtcgccagcgccgacgcaggggtcagcacccagatggtgcgcttcgccacctccctcagcaaggaatcaatcgtcgacgtcgagggcgtcgtctccctccccaaggagcccctcaaggccaccacgcagcaggtctgctctctccaccattatgttgggtcaatatgatcatcaattgcatttgcatcaacccttggccgcagttgattagaatatgcattcggatagccctcttgtgatagctctagaatgctgaatatttcatgttagatgatggttctgcaatcgattggaattcacattgtgatagtcctcttatgatacctcttggaggctgaatattcatgtatggtggtttttgttggactttttgtatccatcttaatttaccgtcacaattagctcgatttaatcccgcaacataacttattatacggtgtgcacatttaaaactgtgctttgtttcagttagtactagctaatgaagtgtcttttgtttttgctggcaggtggagattcaggtgaggaagatctattgcatcaatagggcgatccccacccttccaatcaaccttgaggatgcctcacggagtgaggctgaaattgaaaaggctgaacaagtatgtatatgtgcaacttgcttgtacatccacaatgtatatttacaggatgcctataaatattataatcattgtgagacttaagaaattaaccactgctgccgtttcaggctggagagaagctagttcgtgtgggccaagatactcgcttgaactatagagctattgatctccggacacctgcaaatcaagcaatattcagaattcaatgtcaagttgagaacgtgagtatttatttatttatttttactgttatcatttttgtattagtggattgtattgtgccaacgatgctatgtgatctatagctcagttaacacattaaattttccattgaataaaaactactctggcaaatgttcatgctttcagcttagtcaatcttgcagtaataaacatttgcctcttgggaactaagctcaaactttgcacaagttattgctgtttggagatatactgatttggtgaccccaagatgttcccaataatctgtgccttgcaacttatctaattgcacttgtcaagggttagattcaatatgtttgtcttgagtgaaggccatgcgtgtagtatatattcatgtccaagccttatgtaggctaattcttaattcagtggaggttaaacaacgagcttctattatgttttctatcgcgtatgagcgtgttatattcattatggaaattaaatcgttgtcatgtattttgcagaaattcagggaatattttctgtcgaaaaattttgttgggattcacagcccaaagctaattgctggatccagcgaaggtggtgcagctgtattcaagctacagtacaatggacagccagcatgtttagcacagtctcctcagttgtataagcagatggctatttgtggtgggtttgaacgtgtatttgaggttggacctgtttttagagctgagaattcaaacactcacaggcatctgtgtgagtttgttggccttgatgctgagatggagattaaggaacattattttgaggtaaggaaaattggatgaaagatgctttgtattagtataagcaaagtgatgctgactaagtgctgatttctcaacacaggtttgcgacataatagatggtttgtttgtagcaatatttaaacacttgaatgaaaattgcaagaaagaactagagacaataaacaggcaatatccatttgaacctctgaaggtgaacaagttcttgcctctttttgttccccttttataatattatctaactcatattttgatactatattagctaactcatattatgctaattcatacagtatttagagaaaactttgaagctcacgtatgaagaaggaattcaaatgctgaaggtaaatatcttgtttcagtcatcatctctatgttacctcttatttggtatgggtgaatttctgaacatatgtctgatctattgaatgaaccagggctgcaggaa

SEQ ID NO: 61505 - DNA, 57448 bp, Oryza sativa
aaaataagtctattttacgtccctattctttcgaccgtggcaaataatatgtctatttttactccctattgtttatgtgtcgggcctggcctgcggcccatcgtgccagtggagaggcccaggcacggcccggtggtcgggccgggccggcacgggcccgacccttgacgggccgtgccgtgcttgggccaggccaaaacaccgtgccgtgggccgggtcgtcgggcctcgggccttttggccatctattgatctagttgtactaccctgcggtcagtgcaatatacactctatgtaaaaacgttcggttaaggtagtaggtaggtacctcttattttgcaggtggttcttcagccctttgatgagttgttcctgggacatggtttcaatctttgcgtgtctgcttcctcctcgtcgcctgcggtcgccaccaccactggcagtggcaggcagcatgacctgactcaggatgctcctgaggaccgcacggtcgtcaaacttctggggcatcgtcacccacgctcggcagtcgaaattttggccatgcttccggtacagcgccgccgcgattgtgctcttgcccccgccaccaaacccatggatggctagcacaccgcggttcttgtgactttggcttttcatccacgcctcgagtttctcgatggcgcgcgccacgccgatgggctcctttacggttatgagccggcgcccggccacctggttctctcccgtggtctggtcaccattgcgggtctcgccgcgctgagggggaatcgggttgaggacgacgccgtatcgcaagcgccgctcgcccacttgctgagcacggttcttgagctcggcgagcttggcggcgatgtcacagcgaggcctgcaggtgtagatctcgtacagcgccctgtacacctcgacgaggcatccgtccccgcggggatcgtgacggagacggtgggcgaagtcgtcgacgcagtcctccatgtcgtaggcgatgtcgcggacctgcttcatccagtccttggtctgcgcgtcgtggccgtcgtcgttgccagagctgctgagattggtgaggaaggcgtggatgctggccatctcgtcgctgatgtactggatgtcgccgcggacacccctgatgagcgcgtactcctgggcgaggaggtttcccaacttgcccaggagggccttcatggtggcctccgaagcgcctaccaccaactccatcgtctagctcgaacctcttgatttctctgtgcctgatctttcaccttcttggcaaatctctcgtattttgtttgggaatgtgctgaatgaggtatggagtttattcctagagaggtctaccagctgttcggaagtaaacaaacatgaaacatgatagtctctcaacaaactacatacgggatcggaggagcatcaatagagagcgtggtcttaacgcgttacaccttagtgtcctctctccctttaactttcccccatattccacacccatgtgggcataaaagaccaacccggaagatgtgacttttgtccagcttggttcagatcacataaaaagaccatctataagacgtactattaaataccgcccctagcgcccccttcccttttctcattttttcatcatttccacgaatcctagcacaggaggtatttgttcatgtggcatactgctccggtctccgttcaccagcaagttggattttatcgtcttgttcttggcaatggtacggtacggtatggatcagtttcatcagcagcaggcagccaggcacttgctctctcgccggcaagccacttttgcatcttctcttgcgccacggattacatgcaccttctcctgctcaaattggaatttagagtttgctcagatcctttgacaaattatagttgagtttgatcagatcctcagaggacaaagtgtattaacggaaattttcagttgatgatgctttttttcagcacctcgatggtgttcattttgtagctttggctgcccgggatccgctccgggtggatagctaatatagctccagcatcctgagggagaggcggtagtagtactcgttcgtcgccggcggcggctatgtcgtggtcggaattaagatcgatgcagatgaaccagcaaaagttggacagcgttttggttcgtatagtacatgcaggcgggcatcggcattccgatgtaacggatcggactacgagaccagatgtgccacgcgatggagctacttgtcggggagaaggtacgacgtcaagagggaattggggctggaacttgtgttggttaattttatcggagcccacgagtcggatgtagagcatctccagcagggatctcaaacctagcccctaaacagtatttgagggttaagataaaataactagatccagcagggatcctattagagcccccaaagtgaagaggccctcaaatcctgccctcaagccctaagttctgggggctcggagcacagcctccatcgatgttttttcttgcgcggaacaatttcactccgccgctctcatcttctacccgcgcgtactggttctccttcggcagccgccatcgacatcccttgcactttcagcaaggttgcccccaaagggtgagattttccctacctccgttgcccgtcattgcaaagactccgaccgtcgccctcctgccatccgactagacacacgccgccatctgcacgccatcccgttgtcctccagcgccgccgtccacacgccacccgtcgtcggcctgcacacctcccatccgcacaccacccgcacgccctccgtcctcccgccgtttgctgcctccacgccgcccctcatgccccctgcagtccgcctaccccccacgccctccacctgcaagccgccctcctgccgcacaacagcacgccctctgcccgcacctgcgttacctctgcacgcaggcgaaagggctgccacctgcacaccgccctccgtccccctgtcgatttatctgaagaactgcgctgctgctgctgcttcttgtaggcaccatgcggctatagtgaagtgaagtagtagtacttgtggttgtagtggacaactgaacattgattttattcagtgaacagcagtacagcacttcattatattggagtactacatgtagcattgaatttgaattgtgatgtttcaaattgtaaatctaaatataattgaatttcatgctctagaaatatttatgttttaattatcatggtcttaaactatgcatgaacataaacataaacataaagtctatcttaaaatagaagagaaaagtaaataggggctgagaaataagggttgctgctagagttgaatgaaattttgagatcctaaagaattaggggcagccctcttttttcctttaggggctctaaaataggtggtattactggagatgctagataaagagagaaattagtttttgcgattggataaaattaattttgactcctagtataggagatgagctcctgtacaccaccagtgctatataaagatgacttcgcagagaggagaggacgctctaatatctcaccaaaaccctaagacctaatagccactaatcggcaattgcactagaaggcactcgagacgctgtctctcaggccagattcttgtaatttagaactccaatattgtggtatcatagtagcataatcaatcccttattgatcacatcatccctgttagaagccatctaagcaatttaaaattcaattatgtttcggtttgttttagttagatcaaaattagggtttcaagtactactgttttgcatattcaattttcaagttatttaatcttctgcttagaagaagggaataaggcaattcaatctatgccaaaatccacaataagccggattgaatcaaaaccccaattccccgaaatccccaagactcaagaaccctaattcggcctaaagatccaaaatcccaatttttggtgaatcaaaattaattttaagttcaggttatttaccggattcaaaacccaaagctcgccggatctatatggcctcctcaggagtggagttttccccaccgttctcgccgggaatgggaagcgttggcttggcgttgcttatgctccgggccctaccgacgatacccagagccgcttggcgcccgctgttgcttgcatcctcacgcttcgccggaccaccgaagccgtggaacggcttggtgccgcccttaggcgtgacccctccgatgaagatggaaccgcaccacacgacgcttgtcgccgtgcgcgcgcttcacatcgccggtcgctgtcagcgctattgccactgtccgctctcacgcatcaccgggggaaggggatcggggagagaaggggagataattgaaattagggttagggttctcaccataaccacccaccggtggttactacgacgtggagacgatccgtgccatccatcagatcggatggctcagatcatccctgcgtcgggccatcgtcataatgggccaaggttgtgggcgacatgcctcttgccccgcgcattcgcagaaatgtgtcggcccgattttgtgtcgattctggaagaaattgggccaaaattagaagtttaatttcaatcccatcaaattagatgtttaattttgtttatactttttcttagcttaattaaattgctaaaagtattatttgattaataagtaaattatttttggttaaatggaaccaacgagaagtttaactagaaagagtaatgatatgaaattattttttgaccaatgtgttagggttatggataccacatacccaatagtaatcgactaagctcggcggggtccactgcataccaagtcttatacagaatcaaacctcgtatatagaaggagtttcggataaagaagaacaagaaaagttctacatggaaacgacaaggattactcggattgtatccatattgatctccctagctagttccacttggacaaggggacacctatgggtataaatacaaacccccctgggaggagaggggataagccacaagacacaacatatacacaagccaacactcgttgccacatattgacatcaaagattagcctagacataccctatccggtgcctacggaggccggcaagaggaatctagcgccatctctgatcttgacgagttcatattcgaggaggaagactaccctatcatcaactacgagttggatattcatgccgccaagtcgacgatagctagataagttatcccaaatattgtacttgtgtgatccagaggaataagaggaacaccggctttggctaacaggagtagagctatttcctgtcagataagggggcccgaacctgtataaaaatccttgtctccatctcttttacctcaatctcgcatataccatggtccaacgatccccataccatgcaaataccatagtcgagatctcaaccgtcgacacaatattattataaattcatgtcaaatatatttattatattatcccttagtattttctgcccaacggtgatataattaaggaattaactttaaatattgttttatggttatttctgctcaacagtgttttgtctatgaaaattctatatttaattcgcacgtaatagattaagccaatttaaatcaattatatgcattattaatattttaaatgtttatgtttagcaatgggacattataagactgttgttccctttgatggatctaattacacttaaaggaagaacattatgcttctaaacttagccttgttggatgctagtatttcttacgttcacatataaaatccgcaagcgcacaaatataccgttgtagcactttatccggaagtattccaaggtattgaatttccacattgaacgtgtgtatttaactcttcttcatgttcatccaaggacacaagataaatgttgaccaaaggggaaagaagattatctaatgtggtacatgatcatttagaaagcttaactttaatctaatcgctatgcttcaggcacttgcttgcttgctattattagaacgcactctactccgtagccggatagggaggactacggtgatctcgagggttattaacacctctaacgtattgtgggatacgcagcaaacactgggaattaactacataaacaccatgtctatgcaattaattactactctagcgttaactaaacactaaaataatcactatttcttaatgaacaatactgaacaatgatccaacaagctaaatataactaacaaagaagtataccacacaagataaatcttaattacttaattaaaatattctcaactagagcaaagtaattgctatggtacaaaagaaatagagagataccgacaattccggaactcctccaactctttcttcctcactctctcccttattctaagtataaaaaaagaatacaaagagcctcttataattcagctcatatcttggtgtgtattgaaatgaaggaggagaaggccttttatagcttcctgaaggcggttggagcatgggaaccggccacaaccgccgtaggaaggtcggcagtaactaccaaaggcggttttggctgggctgggctaagcctagatcggttggccgacacctagctgcccctctagcccactccttcctcctgggccctagcatgtgggtccttattctattggcatggtggttaattgggtccagttgcaggtatttcgttaggtttatgggcacaagactccccagcatgctaaactctgggtgctacaaaaaaaaatgagtatgttggaatgtttgtaggggtgtcaaagtctcatctagttactttgcaaacattaagaaactagttaacatgaaaataagaggttggtgaatgaatgtgaattgattgaaatttttgtgattatatgagaaattggtagatcttgccttttttttattgccaatatataagtgctggtttttattacaaaccggcacctatagtcattgtcatgtgaccaggccggtcaaaaaccgacacatatatactacttataggtgccggttgtttaaaagaaccaccacctacatggatagccatgtggcatcttagtttataaccgacaactatactaccatgtaggtgccgattattttctaaaccaacacctatatgtctgataggtgcctgttctacaacaggtaccgatgaccagagacatcaggaccaactactaggtgcccgttagtaaatccggtacctaaaggggttttcctacttgcaccaaagagcttttctttagtagtgcacaattcacatggaggatatatatagacgccaccgatagtgtctgcctttgttgagagtataccctgaccggttgttgtagagagcatgcaattataacatgcagctctccttgatttataagactgcctgtgactatttcctaaccacactttgataaagaacccaagttcgtctttaaaaaatatttcaggtagcaagtgggatttgagaaaactatagaatgatggcggcagcacacaaatttcagccttttcccttgtttccattcatgcttggctaaagcttaggctagctttaacgattattttcaaacatcttctttctttgtagggactcgtgaatctacgcaataaaaaaatcacaagacctaaagacgggtacatgtcgccagaaaccttaactatgaccaaaatttgattttgaccacccaacgatgaaatggttcgctattgcctattggtccctcaactatcaaaacagttcatatttcattccttggtctgaaccgtgctgattttttatatttatggcattgtgtctacatggagcttacttagatgagctgtgatgacaccattgtccctgtcaataataaaccaaaacaaaataacgaaaatgcaagaaaccacatgtagcatccttgcttccttttcctctcgctcgcatcctacatatcttttgttattttgacttgtcaaccaggtgtgccacgtggtgccatgtcatcgaaaaacgattgcaagagtttgaaggaactatagtaaccgattcctgtgagggaaaacattagaatgaggtgatcttaatgtgaaaacagaagcaggatgaaaataattaaagctacctagttgtgttgcaacccggtaaacaagctgcagcagggtcgtaaacgtacgtgtctcagaaagtaaacggccatatgtcagtgactgtacaatatatgtccataatgctagctaacgacgtgactctaggatcgtacaagaccaaataaacctaccagaaaaaggtgaatggtaggaaaaaccaaaaacccaaatatcttttgcgtacttaaagattaccctcaaaagaagtcgatgacgaagccctgtcgccgctggtcgaaccacccacttgccgccggtcagactgccgaagcctcgccggtcagaccacccgaatacctgcggtcagaccgccgctatcccaacggtcagaccgtgcgcacaccagcggttagactgtcgggatccagaaacacaggtagatgacaaactcaaatatgtagattgaaacatttcgactttattacatcaactagtgtttacaaagtgcacaaacatcactcctcaccaaaatctcgaactaaactcgaaaccctaactttctctcaactctagtctctctacaaccgatactaggaggcctcaccctccctctctatttatacatgaggtaggctgtacaaagcccacgaatgtaacataacttaggactcctaacccacgtaggaaaccctctcctgcagatatacaactcatctctttccttatctcaatcaaacttcccgaattcggactcccttccaaattcgactcctctttccatacgtacacaattcctcttgtatactatatggatttcttcatcaccacgtatattgttctctagcctttagtattccgcatgatctcctaatccctggtatcaacttctcccaagttgactccgatctatcaccggcaacactctcgtgaggcctcaagcaacacctgcacatacaacaaccaagaaaccatattccgagcccaagttcgtcccaacttgactcacattagtataacaacagtaaccatacgcatagaaaccatctagaagccaaatccccgaaggaaatatccaaatccaacaaaacaacccgaaaccgaacacgatcaggatcctaccggtcagaccgtcgagccggccggtctgaccgccgcaacaccggcggtctgaccggcggcactcagccggtccgaccgccagggtcaaccgaaaacatccacttcacaaaatcaatcgtcttataaaatctccaacttaacattagcaaaccatcaatattttcaacacaaaacctaaatcaactccttaattttacagtgaccacggtgctaaagtgctaattccatgtgccaactaactccaccgatgctagaatagatatatagttgaaccatgcaacatgtagcttgctttcacgattaatactagttccagtgctctactaagtacattttcgttgaactaaataagctgacacattgtatttgtagtgatgtgacaaaaaaaattaggaggaaatagaacaaaatgtttctactcaacatccagtgatccagaacatattgagagattagtggtattaaatcaacatgttgaattaatattgtgtgcattagaggagttggattgggtttaatactagtttctaagttagagcggagaatatagaaaccacagatatcattgtcttgcctgtagaatgcttggacggttggaccggttattccggagtgcaggcaataacaacatccagctcagcatgatgtatggggcataacgcaccacaaaacaaatgcaaaagctaaagaaagacagagcgcgcctagactatttgctaacaactttgatgcatgtagaacccaagttcatcttttaataataatcttgcagcaagtggcatttgagaaagctctagaacgattatgatagctagcacaaatttcaggcgccgtttccctaattccctccaaatcttggcacgttactgctttatttgtaagctttatagatcactttcaaaatcttctttcaatgtaggatctcgtgaatctatgcactataaaaaaaattcaagactacgggaacatgtcaccggatacaccgagaaatgcaaatttagtttctatcgatttgtcccaaatgcatgttcttttatcatcaagaaaagttcacatttgattcataattatagccaaggttagattttagttacttgatcacgaaaacgttcacaatttgtccctcatctctcagaataattcatgtttcatccttttccgtccaaaccagggtgatgatgtattatgacatctaatctacatggagcctacttagacgattgggatgacaccatcgccacacatattgcatttggctccctcggcgggacgggttacacaagagggcgggcaggaacactgtcagggaagctgatgaaggaggtgtgcactgtggtgaagccgacggaagtgtgcacataagagatgcttcgaatagagacagaggtcttgggtttgaatcaagcttggcacatttcatgaatatgggttgaaaagaattatgtgacttgtgataagtgaaatgtgatgtggtaggtgcctaataaaatgtgaaatattttttttgattttttcacatctgcaaatgtaaaaaatggattcaccctacaagtgtcggttctaaataaaaaccggcaccataccggtaccaatgattacctccattagtgtcgctaaattggtacaagtttgaaaactgacacctatgagaggtttagaacgggcaccaataaaggcaggttttttctactagtgaatgtttctactcaacacccggaacacagtgagagattagttgtattaaatcaacatgttgaattaatattgtgtgcattaggggagttgggtctaatactagtacgtttccacagatatcattgtcttgcctggagaatgcggaccggttgttccgagtgcaaagcaacaacaacatccagctctcagcgtgatttatggggcataccgcaccacaaaacaaatgcaaaaagctaaagaaagagacagcctagactatttgctgacaactttgatgcatgcataacccaagttgatctttaaataatcttgcagcaaatggcatttgagaaagctctagaacgatgatgacagctagcacaaatttcagccgtttcccttctctccaaatcttggcacgttactgctttatttgtaaactttaaagatcactttcaaatcttctttcaatgtaggacctcgtgaatctatgcactataaaaaaaggggcattttcatggtccttaagaagctatcacgaggtaccaaaaatttagcgtaaaatttggtacctcatagtatctaagtaccaagaggtactaagtaccaagaggtaccaaaattacaatagaaaaagtggtacctcatagtatcttctcaaggaccgtaaaaatgcttaaaaaaaactcaagactacgggaacatgtcaccggatacaccaagatatgcaaaattagtttcgatcgatttctcccaaatgaatattcttttatcatcaagataagttcacatttgattcataactatagccaaggttggattttagttacttgctcacgaaaacgttcactattagtccctcatttctcagacgattttttatgatatcctcttccgtccaaaccacggtgattttttttatgacatcgaatctatatggagcctaattagacgattgggatcacaccatcgtcacacatattgcattcggccccctcggcgggaggacgggttgcacaagagagcgggcaggaacactggtggtgaagctgatgaaagaggtatgcatgaggtgaagccgacggaggtatgcacataagagatgcacgtgcattgatgaggacctggagctctgtcgtcggcggatctcacgacctgagctccagctaccagatctattatctataggacaggagaggaggacatccacacggccggatccatggtgctcgaccgccagcgctgcccctgagcatcaacggtgccaatcctaggtgaaggcgaggccgtctccacgttgcttgagcaatcgctggatccgccgtgctcaagcactggcttcgctggatgtggatggagccgacaacccgtccttttgtgcaacctgtcctccaaccgagggggccaaatgcaaaatgtatgctagcatggagcgtcatgtcggcaatcctacatgatcagacgaggtttgaacctgttgtggtaagactatggttctacatatgcattttacaagatcagtaagttaactgacaccaactcgcaattttaaagaccctgtcgtatatcattaacctaattcatttaatcgatgatggccacatgagtagataaaaaacaataaatgtaagttagtgggaaacaattcatcgtattatatactagtaataaaagattgtatttctaaagcacatgtaaaagtagtaaaaaaaaacatctagctggcaatcaatcttcctcttcttcttatctcattacaaatagaaaatactacctccatacattaacagaggaacattgtatgcaccaaatttcagttgaaagatatcccttataattgtggacggacgaatcagcatatatgcaggctataacccactctatcgtatctttcgaactacatatacagcacacagcccccgcagtctgcactcccaaaactcccaatcccggacagtgtcctagctagccacacgcccaaatttccccaaatcgatcacaccaaaggacgacgcatccactcaggtatttgtgtcggacttttgatttgttttccacttccagtgtggtttcttcctgatacgaggatgcatgtttctgcggttctagaattttgttttttgggcgatatatctccctcatcattttctacgaagaatatatgttttcgttcaatgaaagatctacttaatttttacacttgttatttgatctatttgtttgagctctcgaacacatttaatttgggccgatgcttgctcacttcactgagccctcgggcaaaatttggtcagcttagttcgttaaacttactacctgaccaagcgaatcaattgtatatatattgttagatggaatgatggatcaacagagctcaaacttaagaagatacagtttcttcactggaagattttcacataatgtacatccagatctggaaatactatatatttacagatgcaatgtatacctatatcatactatattagattaattatcagaaaatcattttctgacctccgggttgttcgtattgaaataagtaaatatcagtttactcggcgaatcatttggttgggtcagtaatggtctgttgtgtgtatcggctacgctacttttagctcaagaacttacttgctagataaagtagctagcttagctagctagttggcaatgcatgatatttcctagtttgttgcaggcacggactatggggaaattcagtattgaggcgttcatgcagcttggtgtttctgatgagatcaactggttaaagggcacggtgagctccatcaagaagacacttgcagatgctgactacagtgccctgaaagatgatacagtgaggtcttggtcgaggaagctgaaggatgtcatgtacgaggccgctgatattcttgatgtctgtgacgaaatggagggtgaagaacatggtggtcgctccaggaacagcccggtggccttatgcctaccgattcagggccacaaaatcaggcggcaagttaaggcactacgccagaaggcggatgcaattctggaggaggggaaaattttcgacctcactcatgtcagatctgatgaagatcacaacgtggatgctactactgcctgccatgttccgattccccgaactaatgttgtggggagggtgcaggagactagaatgctggttgataagcttacagggaaaggcatctcaggcccagggatgactggacaaaacgttgaagtcatcgcaattgtgggtatgggtggaattggcaagaccacccttgccagagaaattttcactaacgatatgatccaagggaagtttgacaagagactgtggatcactattagtaaaggtaataatagtattagtctattgcaacaggttatacaaggacttgggtgtgagcatgaaggtattcgtgatagcgcagtattggagcacatcatttccagtgaagtaagaagaaagaaagttttccttgtgatggatgatgtgtgggaagctagaggggtggtggacatttttaaaaaatcatttgtgggcaacgctcaagcaggcagccgaattctcatcacaacaagatctaaacaagtcgctcaagagatgcaagctgctatagtccacgaagtcagcaaactaagttctgaagattcgaggtcgctgtttcttcaggttagtaacataaaaattgatgcccaagaaaacatttcctcagttttctcatcaatacatgtcttatcatcactcctcgttcatacactttcgattcttgttacgatcataaaaaccggttcacaggaataacgtgtaccagcggtgatacttggggtatcactgtctattcttattacgatcattccggctcattacaagaactaattaacagtgatacttaaaacatcattgagctatgaattcacagtgacaagtatgtaggatcgcacaacaaaaccaaacctaccagagaaagatgaatggtaggaacatcaaaaaccaaatctttttacggaacttaaagattaccctcaaatacctgatgaagatgtattggtcagaccgccacctaaccgtcggttagaccaccgtgtcaccgccagtcagatcgctgccctgtcatcggttagaccgccaccaagcctccagtcagaccactcctctgtcttcagttaaaccgtcaagatccagaaagcacgtatcaacgaaactattgaatgtagatcaactttattgcatcaatatgtatttacaaagtgtatctaaatcactcctctctcaactcataaactagtattaaaacctctaagcgaaacctaacttttccctccaaaaagtcaataccttctagcctcaacccctcatttatttatacccacaacgtggcagcccctagccacccctagccacaaacccaatgtttgaggtatatcacaagggccttcaaccgaggctaccgaaattacatggaccagggtgaagcaccaaccgaagaatcaagttctcacattgggcgaacatcaggcgaagcaggaaggattcgccaagggtcttgacgccttcaccatagggccaaagcattgtaaggcctaaacaggttattcaccatatttgggcccattaaggggcctagagcaaaatagacactagttacccttataaatgttcccatcataagaggacccatgtaaattcccatgtactcattaactctagggtgcatgagcttatactaaagctataaatggccctcctaggggcatgtaatgggaggatccccaaaaattccatcattaatacatattgctttactattccactgtgtaaaccacgtccttcggcgtgcacggttgtctttcgacaacagctggtgccgtccgtagagaacccagggcgaaaccactgatgccacccaagaagtcgatgagagagagagttgtgcctaagggaaaggagggcgaaggcgaagcggagatggccggcgaagagtttgcgaggtccgaaatagtgttagagcaaccaagaggcgaagggggcggagggcaagaagggggcgaagtcatgcagacgatcgccataacccaagcagcaacttcgatcattcccacctcaactcaagctacaacgcaagctacgactcaagcaagcacaaaagccgaagcgtcaacggcacaaagggtagagatggaagctatgcgacaagacatgatgaggttgcaggacacgcttcgccaaatgcaagagcagcatcaagtatacgaagcagccctgcaaacctggtcaacctctttagcaagacccactccatcttcgatacccgcggcaaccactctagcgattcaagcttcgactcaagcaacgcaaccaagttcgactgttcaatcgatccaagcttcgtctcatgtggtgcagccgactgcgaccgtgcaagcgattcaagcttcgactcacgtggtgcagctgcttcgaccgtacaagtgcgacatatccctaaagcaacaatgttgcatgtacgtccgacggtcgccccgatcccgccgatgaggccaattcaggctccaacacctcaagctttggtggaggccgcttcggctctccaggcacaattccaagctttccttcaacaattgagtcaaccccacatgattccaagtgtaaccccttcggtccaaggcaatgggggatcgagccaggacgctatggcatggcagccgacgaaccagctccacatgtgcgcaccaacccaagcgccttcggcaaatcctcaaggaacaatggctggtcttggcagtattcgaaaagttgttcaaccaaacatcgtggctcagtcacatgacattagcttcgccatttgcacaaccatacctaggcctcacatcgcagtaccagcaaggcatggcgctgcgggcagagggtgacaaggtatggcgctgcgagaaatcatctgaatccccccccccctcccagttcaagtactcaccagtgacaaggtactcgggtgaaaccaatccaagcaagttcttgtcgatctatgagtcagcaatcgaagctgtccacggcgatgaaactaccatgtctaaggtaatacatcttgctttggacgggatcgcctggtcctggtattttaacatgcctccaagcagcatttacttatgggaacaattgcgtaatgtttctatcatgaacttcagagggacgtataaggagccaaaaaccaaaccagatttgttcggcattcggcagaagctaggcgaatctacaagtgagtacgctaggcgtttttcacaagcaaggtgccaagtgcaggaatgcaggatatcactgaggcctctgtgatcaatgccgcttcagcaggccttcgcccgagcaagctgacaagaaaaatcacaagaaaagagccccagattgtcaaacatctgttccacatcattgacggctatgcccgtggcgaagaagacaccaagcgaaggacccttcaccttcacatgcattgttctctagcctgagcatccctcaggatatccttgactacatagacctcaacttctcccaagcttagtctcgacccatcaccggctatactctcacggcctcaagtaacacatgcacataaacaacaaagaaactccatatctgagtacaagttcgcaccaatttgactcacttcagtacgcaatagtatcacatacgaatagaaaccatctaaaagtcatatacacgaagcaatctagatatacatgaagacagatatacaaacgcaatggcaagaaaaacactccccttttcaaaagaaagaatttcttgaatctcttcccctatatttgcaatcaaatcacaaaatcgacatatgatcaaaactactacctcaaacacaagcatatgaaaaaactaataaacgaggaagtagaaaaaaattatatcaattcaaaagtatattgatgttacccagaaaagcaattgccgtatcaacattgaatgcacatggggagtttgtcgccgaaatacctccaaacaagaacataccgaggcctccatgttggggttagaaacaagaaattttgaaatccaacaccgagtcacatgaccaatagaaccagtaggtacatatgcacgaataaaatcaaaaccagaattacctgaaaacttatcttaatgtttcacaaaagtctgatttgaattttgcatataatttgccgagactggtctgatcactgttctctagccagtctgatcaagcctggttgatctgacggactcgcccatgttagtctgaccatactcctctaaccaaaactcgatttttgccacctttgtttcgcataaaagcaatttctctttattttttctattacaagcaagtccaaaataaaaaccatccaaatatccatcttttccataaaaagaacaagtgtacttctcatgcaaaaaaattttttgaagttgatggtgtagaaattaatagttctgcaattaaagattttgtttcttgtattgttgaagaaagagatggcaaaatactaacagatttaaaaactgttttctctagttcagtttttttcaaagtttcacctttttaagttatactcaaaattgcaggttggtgacatgtataatagacattagtttcaaaacctacacaatgattataggtgtgcacttttgatttatcaaaatcatatgaaatttctttttaccagcagaatacatttccaaagtttttttttcaaataagaaactttttttgtcaaatttgcacaattttcgcaaccaaccaaaacacctttgttgttgtgacacttagaacgagaaagcacttcatgagttttcaaattgttttacaaaagctctataagggaaagtgcatcttttaatttcatctcattccaaacacacttcgagcaattttgagaatccaaaacatccttatgttgtttaatcatttttgcactcaaaaacattgaacaaagaacttacataaaaagcttatatttattcaaaactttccttatcaaaactaattcattaacaattcgagcatgcaaagcaaatctaagagcaaaagaagactcgagctttttccttttgtcaatcttagattccaatcttaagcaatgtgtagtattaacatctcttattcgtgaaatttcagaaaataaaacctcataacttttgcaattatcatcatcaggaagaagagattttaatctagcgacttcagcattaagagaatcaacaatgaaatcatgttgtttaagtttttctcgtattttttttattattggaatttagagaaaaagttattttcaagaaattctctttgggtggggggtcctttgcggtctgaatctgattccccacgagccataaagcgcacaccagagatctttcccttgtcattgtcatcgctttccgaatcaatatcacttgagcacacttgattacctcttttgatgttcctctcattattcaaagctagagataatttgttaataagcaaaaccacgtcctcctccgagattctctcaagatgaccattggacatgaccattgaagtgggcaaagcaaagatcaacaaagaatccaaataagaacttgatgacgagattaagggttccatcttttgtttacaaacttgaaaatatattccgtcaacaacatggaccttggtcgataatttttcagccatcgcaaaaactcaaagatcggtaaagaccacaaagagtaaacgtggctctgataccacttgtaggatcgcacaccaggaaccaagcctattagagaagggtgaatggtaacaacaccaaaaaccaaatctttttgcggaactaaaagattaaccactaatatgataacaattcggcccaggtagggttggccgaggcccaacaaattaaagttgcctagaccccaacagttcttaggcacacccactcggggaaaggcctaatctccctaaaagactagtccaataggggaagggtggcactcccttttaaggtggcttcctcctcccaagctaagcaaggtgggatcattcagaggctcacacggtcgccgcccgacttttgcgtctttgccagtgggtaatagtggaggatgtcctcatcagaatacctgaagaagcgttggtccaaccactagataaatgccggtcagaccgctatctaaccgcctgttagacaacggtgtcactgccggtcaaactattgccctgccacctccaagcctctggtcagaccgctcctctacctttggtcaaactctcgggatacagaaaaacatgtatcgatgaaactcttgaaagtagatcaatcaatagtttcgtctaaatttgttgtgtgcgtatggaaagaggagttgaatttgcaaagtgcatctaaagcactcatttctcaactcacgaactagtattgaaaccttgaagcaaacctgtcacgcccggaatttctatccaaaattccgaacgcttacatgcgtgttaaaccctcgtccaggaatcaaccgaggcacacaataacaaattgataatagagtacaaataaataactatttaatattcgtaaataataaatcattacagaggtggatagttcctctcaaagaataacattctacgcagcggaaaacaaaactaaaacaaactacggaacaactatggcgactccactccacaggcatgtcaaccaagaacaagcttaatcctccagatcatcaccttcgctgagatactcctcttctgatgaatgaatattgcaagaatgagcatatgacatactcaacaagccacacagcaaatatgcaagtgcacaggataacaaaggatggcataatatagctcatttgcataaacagcatttaatatttaagagaatagtaaaacagttaagtaattagtcaatattaaataaacaccatacaacacacccgtgttgtataggcccaacctcatatgaacaaccaaccccggttgaacataccaaacctccaaaccaggaatataccattccaaaccaggagtcacattaattaacacagttaccatttaatgtgtaatatgagactaatcacgaaaaacattgctcaactcacccataaccgcgggtacggctattcgaatagattaaactctgatcagaggtgtaccactgtacccacaagacacaatcccacaacatgttaccatgcgccttagtaccaccacggtacctcggaaaggaactgtgacattacccctcgcacaacacaactcaccacagtgcaccgttcctggatcataatctccccctcaaaatcagaggcaatgcagcgacccccacggacttctcgccgcttcacagtctggcacactataatgaatcatgctatacaaaagataaagccgttgcccacgctggcttgtggttggcacggtaaatgtttcacaacagtagctcgcgaaccggtccttaattgtcatgagcacaaccatcaaaaccatatgctcacaatccaccttaactaggttttaattatccattaattaacctcacacaattaaccatcgtgagctaccattgaatataaccataattaataataataatataatatagtttataattaaccccttgagttagctaatgtgtctaagcatggctaagcaaacatacatatagcatttagctgaaccaatccaatatataaggttcatgctaatcaaattataacccataggaaaataaagtcatcttcggccattacttatacgggaaaaggttcaccacccgatgatattcgaaaacaatgcatagttgaaataaaataatagctttaaatgggttcaacatgctcaaagggttgtttgggatctgtgtgacttgccttgggcttccgcaaacgcttcggaaccttcctcgacagaaacgctctcctccggaacgtcggaaactaaagaaaaaatgctaaaatcaataaaacagtacaaaaacaagcataaacagtacatgtggatatttttaacatgtagatcttgattttagaaaactttagcaacttgaaccacctgaaacggatctacggttatttagttatgatttttcgaagatttaatctattagaaaaagggaaaaagaaaaaccgatgatgacgtcatgatgacatcatcaatggccggcccaggttggcaacctcgccggagattggatggtcggctgcggttttggagcacatgtacacgtagaggacgacaagacgaacgcaacggtgctcaccaacacgtctaacgaccaccgacgacggccggcgacgagaggagatggcggcggcggctcggacctcgccggcggcgagctacggcggtcggcggcggaaaggagagggtggccgagcttccccacggcttggcgaagcccacgacagtgacggcgaccgacggcgatggcgaacgcggctgcgcgacggcgccggagatagccggcggcgacggcgagcaaagcggcggtggcgacgaggctacggagcacgggaaggcttgggagttggggcaaacgaaagaggaggactagggggtcctatttatagccttggattgaagagatcggactcctcccgcaagaaatcagctcgggaaatcaaaaactcggttttggagataaactcaaaaacgagttcgattcggataaaatactcaacgatttgctccgatttttgggggtaaagatagaggaggatgagaggataaaaacccctcaaaaatccggaagaaaagaggagagattggggcggattcggaggggaaagggggcggctcgggcggcatgggtgggctcggccggccggctgctagaggttagggaagcgtccgacatgtggggaccacatgtcggtctcccgagtggagggggcggctggcgggttggctgggccggctgggccgacttggccgcgggcgagagagagagagagttgggccaaaaacggcccaacaacttaaggaagggattttggaactttttaattaaaataatttgtgaaatgttgttccaattattaaaaatacttcccttgctcaaataattcccagaaaattctagaaaatagagaaacaagcaaagtatttaataaaattttatctagcttgtttttatgttaaaaattttcctagattattagggtttagcttgtaggcttttaatttaatttctaaaaatgacttaaacaatgcgttttaaaattaggcaatttttagggcgtgacaaaaccctaactttttttttctcaaaagtcgatgcccttctagcctcaatcactcatctatttatacccacaacatggctacccctagccataaatccaactagaactagaactcctaatcacataggaaacccaccaaaccaaggaaacaatatcccatacaacttcatacttcaatctttctaaacttggactccaatccaaatttaactcctctttccatacgcacacaacatcatggaaacattcacctccacatgcattgttctctaccaagagcatcccacgtgatatccttgaatgtctgaacctcaacttctcccaagtctaatcccgatccatcaccggctatactcccacgggctcaagttacacctacacatgaacaacaaagaaactttatatttgagtacaagttcacgccaacttgactcacatcagcatacaatagtatcacatacaaatagaaaccatatataagtcatatacatgaagcaagctaaaaattccacgaaaacaactcgaaaccgatgccctcctgaagtttgcaaattcaaaactttcagttcaatttttttaaaactttcaagtcaaatattaaaaaattcaagtcaaaagttaaaaattttcaactcaagtttgaaactatgaacttaaaatttaaaaactttcaagtcgatatttgaaactttcaacccagatttgaaaattttcaactcgaaatttaaatttttgaagttaaattttgaaaactttcaacttttcatctcaaatttgaaaaactttcaactcaaatttaaaactttcaacccagatttgaaaactttcagcttaaatttaaaaactttcaactcaaatttaaaaactttcaagtcaaaattaaaaacttccaattctacatttgtaaagaggttatcagaaagaaacagcgctaaaaaaagaaaaaaaggtccggaggcaccaaaatcgggaaaaaaagtacgaacataaaaaaacgcacggtgaggcgggccaagtggggcgcgcgccagctaaattgctagcgcgtatgcgcgcattagcaacccccgtttatccccaaatccgtatgaatcagttccgtagccagttttgatcatattatcaccaagatcaaaagctacatcattcgcgatccaagatcaatatgctacctcgacaactgtatgtgcacacccaaccttttttttttgggtccgccactggtcgtattaatggagataagtaaggaatctgatacaaatcaaatctaacctaaaatatcaaactaccaaatactgtaacaccgttagtccatttgagatttctcataattaatatcacatttattttatggatgaaatgaaacccagtggtatagtatagattaagagcttattaataatttgggatttaattgttgcaggtgattatgaggaagaccggccaagatgagaacgagagattaaaggaagttaaagagaagatcatagcaaaatgcaatggttcaccactagcaataatcatgctggcagggcggctcttggtaaacagaaaccgaagcgcaaatgaatgggagatgcttttggaatacgctgcagagccaacagatcatggagatattgacagcatattccacctgtgctatgcggttttgtcatttcctttgaagcagtgcttcttataccactcgcttattcccaaggatcatgtgatcagctgtgacaaagttgtccagatgtggattgctgaaggatttgttggggctgatgctacttcagagttgccagaagtcttggggatgaaatactacaaagaattagttgcgagacatcttttggaacctgttgacgagtatgatggccaaggtcattacaagatggataacttagtccatacatttgctaaaaatgtagtggaaagtgaatcattagtggttgaagagggagaggaaaatcctgaaccgttcgacgtcgaagagggacatattcgacgatcttgggcagcaaaagagaaaattgaatggaaagctccaaaggagctacactcattaaggacattaatcataattggaaatgttattgttcaggcaagcacaggcagaaccttgagctccctttcaaggctaaggacgctacacgttaacaaaaatgaacatgtacatatccttctcgatagtttgcatcatatgaaacacctgagatacttggacctgagttacacagatgcccttgctttgcccaatgatattggtgagatgaagtttttacagtacatttgccttcaaggctgtaaaaaattggtgaaacttcccaagagcattgtggaactgcacaagttaagatatctgaatatctctgagacaaaaataaagtcaattccagaagaagggtttggtggactgaagaatatggtgtcactgcatggtttccccagtcagatgatggaaagcgtcatagcaaaagattggtgcagccttggggagttaaagtatatgtcccaacttatgcatcttgcactagagggtctggagaactgtgcttccggctcaatggctagtcttgccaaaatcgatgataagaagaatcttgcatctttgaggttaagctgcacaagtagactgtcggttaacggcgaggtcgataaggagacagtcgaggaggtgtttgatcagctttgccctccacccaaattgcaggagctaaatattaagggattctttggagctcgactcccgagatggttgatttttaccaaccttgcggaactgagggtattaaagctagacaacttagtatgctgcaaccagcttccatctactttatggcagctcccttgtttggagtacctctacataaagcatactctgaatgtcaagcacatcgggcatggattcctcctccagtcatctatacctggtcctcgtgaaaccgacgttgcagcgacaacaccaacagcagcaacatcagcaactgcagcaacagcagcaacaacaacaacaacaacaattggaggaggtagtacccacaaccgggggccctatcatcggctttctggtgctgggtcagttggttctggcgaggagggagagattgtggctgagagcgcaacagaagacgcagcaacaactacgggaagcagcaatgcaattggcttcccaaagttgaagaaacttgttatgtatggcatgatgaaatggaaagaatgggagtgggaagatcaagtggaggccatgcccaagctagagaacatgcatatcagctggtgcctactgaatcaacttcctcctgggcttgcatcccaggcaaggtctctaagaattttggttgttgataatgtcaagaacctcatctccatcgatggtttctgttcagttgtccagctccacgtctcctccaacttcaaactagagaggatcagtgatcttccaaaaatggaaagcctgacagtttccagatgcccaaagctgaatattctgcagcgtttgccagcattgcagagcatggagttgaatgaccaagagatggaaaggctcccagattgtcttagagatcttccagcaaaactacgtcatctgcggatcacttgcaacttggatcttctcaccctgatctcccgggggaaaggcacccccgagtgggagaagatcaaacacatccagcaagtgaatgcctgtacagatgcggaagacgacaagaccgacaaacggtttgtcttctacaaaagagattccgacagcactgagacgaatatcgagccgagcccgagcacatcccaagttggaggtaactaagttgatgccgctgttaagtgttaatactgttgtttcaggtcgtttctcttatttcttttttattttttgttctagtttttataactataaagtatagctatggtatcttagccaatctgtctagtcaacaaataaatggaagttttctctcaaaatgttgacatgtatgttttaccattagtttagttgcttactgtttctactgcttggataattcagtaggtgcacagtaacatggtaagaagatcatatgagtatatgggccaattacaagtggaaaacgccatggggattttgaagggggctaatttacatccagaagttttagctgaagatccaagattgggtgaccgcaaagatggatgacgactcaaggccacaaatagcaggcgattctgttaaactgggagatcagtgaaccagattgattttgcttaggggtgtacttgaacactaaaaaaagtgaaaacggtatgtgggcagttttttgttttctttgcgatttgatatttttcttgcgcattcgtggttaccagaacatcacaattgtcaggtagatattgttcaggttctatgtattaatgtactcattactgaataaaaactctccaaccctctttagataacatttggtagaactcctagttgaagtaggaaacatatccgggtcacgaattcagatcaaatacacatgttatatgtataaaagtgtatgaaccgaaatgcagaaaatgagattgaggtacaggtatgcaggaaatgagaatgtatgaccaatgtaggcccagtagatatatatagttagagacggtttgactaatgattataggttattcaggtatctgtagaaagtctgttaattaacagacaatattcttttctttttttcctttttcctttcttcacaacatcataaaagtcccatgtgacatcttctcaagaagagaaatttcacactagtgttcatgctctatttagactgtcttggcttatgccgtatgatcgagttttttatttaagagtacatggtcggatggctagtatagtaaacagagcggagtggctaatgtttgtgtggctgaatatgtgttgtgatggttgtgcaaactgtaggtgatgctttgcaggtccatcttctgctcccctttatatatagagttagtagccattgtacctgtacaatcttgatgatgtattgtgcctttaaccgctgatgaaggttgatgatgcatcttttgaaaatatcgttcaccatgataccccttttgacatcttaggatatttattccaatatatcttattttcaaattaaaagtagcctcctaaactttcatcggggatcaaaggaattatataaagaagcttccataatagctaccgaggctttcataatagtactagctaccacctaccaaggcttttatacaaaggaatttcatcagcaataaaagagcactgtcatcgagattctccataatgggtagaattttgtttttattttttgtactttttattttttttattcttaaaaataaatcctcataaaacttatttttagaatctaaatcgtttggtctgacgtgacaaaacaacactaacacttagcaggcatgatatttttgttctaccacgctagtaaggttgacgtgaccaaataacgttgccacgcttatcaaactgacctaacagcgttgttttcccacgccagttcgactggcttagccaaaaggcatgagaatgtattttgaaaggcaaataaattttggaaatatttacctttcaaaatatctgccattgatcgctagctccaatataaattgaaatggaaattgaagtcttgtcttggaaataaattatgaaagggtttatttttaaaattaaaaatagaaaagttaaaaaaatatctaatggcgaccaatgtgagaaggaatgcaaggcatctcgtaacagcccacacgaccaatcagtccatcacaccataaattaaagtcaacatgcctcataaaattggaccaatagagtattttgctagtatttcatagtcatattagcatttcctttcaagtaaagagttaatacaaacacgaatttcaaagaaactcgagccaaacctacaaattttacctcgatttttttttcaatgtttacagtacgaatttcagttacaaatgcgacagaggccaagaaaactgaggaagtaggaattttatccaaacattgacagctataactaatggctaaaactctgaaaactattgatttgtttatgaggtggcctaaccatagctctttcctactagtcctaagtcctccctcatctgtatagtctaccaagtaacacatccaacacaacatttttcatacggaacatgtaaaactgatgctttttccacataggggagatgtttctaatgtaaacacaacaagaaatgcatctagggcctcaacgctctcttctacaaccacattgccagccacacccacaccaaaatgggataaacacagctacctacattgccaagttcacaatatgatcagatgaacgccaccacaaagacaagatcgaggtacagatatgcagaaaatgagaatgtatcgctagctggctacgcttcctcttagtcggttagcaatgtgaagaaggtggtcgatgttagtcggtggatagtgctgcagcagctggatgttggcagtgaagtctccagctaggaggcgcctccggacaaggatgagcatggcacagcatattcttagcaacgtgtcctgcacaagaacatgcaaagcattagccccctgcagttgtacaagtaacatggctgcaaacctagtttggaggcttagtccagaggttacataccggaggaccttctggatcacccaagatagcatcccaaatgtgaatacacacattgaagctgaactccattgtcaacagtagtgtgatccatctaaatgcatagtattgtggatatacctgtattttcaatatccatgcatgactatcaacaatggtgggtgacataccagagtgactaaatttacccacaaaaacaatatagcaggctatcaatattagtatcttgttcagaagataaacctaaaacagtaacatactgttaaattgacaaggaaataagagcaactttaactgtacaatgcgagaaaatagaccagttcctgttcctttccagtggtaatactagcattttcacttaggacaagctaataaaatagaagggttaattggatctatgccattgtaatggcaaattgtaatggcatgacttcaaatagccataggttaattaaccctaaattgtggaaaagtgagaagaggtgacattacggatagtaagatgtccaatattagctattgaacaaataacatgacaagtttttctgggtgcaattccatgtgcactttctcagcatgcatgctacagtagattttgcagtctgtgaaatatattactgaatattccctacctttgtagtgatctccatatgtcgccatagctcttcatcatgtctcttcaagagctgagacaactttgaaagtgtagaccgaatacccacttggctgttgtcaagatgcttacagtagttgtctttaaagccactgagcaattcaacaaagcaaaagaaagtgtctgcttcagctgaggcctgtaattccaaaactgaatggttcagctaatgaacacatttcagaaccaatcataaaacagaccaagttgtgaattaatattcatataaatgagctattctaattctccagaaagaattcatttagtgttgattttagaaactcaaaatatccacaataaagtttttgtgttccatgtaatgagcgagagagaaaagcagatagatatccttatgatagataaattcctcctttgtcaacattcaaacgttccatttaaaaccatgtgatcaaatagtaaaagaacatactgaattgcttgtatcagggtcattcttgaacacataaaaaagaggtgccaaaacttcattcatcccttgcacatatcttatggtaggatttaattttgagaagataatgagaacacgccttagagattcctgaaatgtgtttgaaaaatttagtccaaatgacaattacttgtagtttaaatggaaataaggaattccaaggcactgaagtgaaacctggttagccttggcagagaaaaacggcatttcaggatgtgttcttttcacatctcgatctatctgttccaggatttctgattcctgtaaatttacatttatcagaatataagaaaaagaacaaatgaaatcttgtggctgccatgccagaaaaccatgtttaataattaacatctagactatacagaacataaatgttcagtgcatatcaaacacataggcgagaaaacataaatgttttcgcatcgctcaatacagaattcagaaggactaaacagttgtgcactttcctctttccttgcaatatattcccttcatttatttttacttgcatcctaaaatcaaaatccatgaaactaaactttctaaaattgatcctccatatgttatgaatatatagaatggtgattaaaaaaattatcattacatttgctattagaaatacttacaaacacttagtattaacataaaaaaattacaattaaggtcaaagctacatcttggactatgacaaagcccaaaaacatcatgtaaataaaaatcgagagagtgcttgtccttagcttttcacaacagtgcataaacaaaatgtaataccctgaccattagtagagggccgtgtggcccatggtgttgtattagtaggattagtctcacaagaggagtttagataggttgggcccaataaataagctcaaatgttttaaccatggcacctccagattaaccattttatacagcaacaatgagaaaagtgtcaaagtggggtgctatgcatatgtggggcttgctcctaaggaagagatgagctaatgtagatctcagaagctgaggtgttacacaaaactaggtccagtgaaaggcacgcaattctgaagacggacaacaaatgcaatgtgggaacttaatatgagccccaacataccgaacagaacaaaatcaaaacctagtgaaaagaacaatgaccacagactggtgggaaatactggggactgtacacacctcacagaccacatgttatgcaaatactattaaaaatcccacagccagatcagaaaaataacaataacaagaaactgtacctaccagcaatttaactagaaagaattaaagattataatgagaatgaggataagaaattaagattccatatctagatataacgatcatcatgagcaaagacaaactcataataccaaccaccaaacaacttaaaagcagtccaaacaatttctcataaagtaaatacattataatgtttcagattaactaaacacaattcaggtcttgaagggaccataagagttaagacacgtgaaggaaccagctggcaaccatgggttcccaacaagccttgcagatttatttaagatggtaataagtaatacctggaagtattgattccacaagctagatttaccaaagctcaaagggtgctcttcattagtaactttggctcttggtagaaggccaattttgtcactatttaattctttctttcttagcaactttgactcctcaaatctccgtattttttctgactggtcaaaagaaaatatcagtgtattcatacacaaccaattgacgccttgtttcgcaaggccaaaatctccaggtatggaccagggttttggcctagccaaacaaggcttaaaatgccttacaaaggataataaaaaaagtcttttggactaataaatcttcattgataatttaataaatattttagaggggcaatcataacttacaggatttaggagaaattcatctttatatgcactatactggctccgcttcttttctagctcatgaggccaaaaagcacgctcagttggcagatatcccaacagaagctgcacactataaatataatagaataaatttcttgtgtatgaactatggaggttgccacatagcacggttcttgttaaaagctaatttagaaaccatcaatagatcataaataacaaataatatgctgaaagtggtcattttcctataccacttgggcattaaacttgatgtagttatagttacaagacatacttattcaatatacatattagattgggaaatagagcaatttcagatggtcatgtgattgcatgatatgagaattggcaaacaggatagggatacgcaccaataatacagaccaattcctttttgttcccatgccataggtaactagttcaaggtacttaaaagtaaaaaaccagtatccttctaaagttcactcttgaaaattagtacccatctaaagctcattattgaaaattgaataatggatgtttatttgaggcaaaatctacactagacatggaaatggattactttctttcagcgtctccacactggaaacataatcacttccataataccatgccgggaagcagaaatggttcgttttaatgaaactgttctatgctgtccgcctgtccgtgcttgctcacggtagagtccccaaacaaatatgtaccgagaaacaacaaaaagtagtgcagcagcagagtagaagagaatgcgggtgggggaccttccagacgagcgggcggacggcggcgccgccgtccggcacgccgaggcaggcgagcctccgcagctcccccatgttcaccaccttcttcgacagctgcaaaccccaacaacacacgatcagaaaatggaaattccaaacaccccccaattcgtacttcaccgcgaaattccaatcccctcatccaaaccaaaaccccccctcccctcgtcaccacccacccacccaccgcgagcttgaagtcggcgagcaggtgcgcccggagcgcggccccacccccgacctccccatcctcctcctcctcctcctcccaccccgcctcgctcctcgccctcctcgacgaccccaccgcctgctcgtacgacgggggcgggacggtcggcggcggcttgggcggaggaggcgggggcggggagaggtcggcgccgtaggggtcggggggcacgggcggcgacggcgacgaagacgaaggcggcggggccgaccagagcgggctgttgagccactccggcaccgccctcgccggcttcttccgcatcgggagaagcgtctagaaggctctagaaggggaggttagctagcgacgcgacggccgcgcgtgcggcggcggcggcggcggcgtcgtgacgtgggggaggcggaggcgcagatctggagcggcaggtgtggccaggggaagggaaggtgcggggaagagagagagagagaggtggaggagtgggttcggttagtcgctgcggggtggggccgtggtgtcggtgtagacgtggggcggtggggggtttcctttcccccaagagttggcacgtgacctctccgccattttccgtgttttcacccgtgcgttttatcctaccagtacttgtcgtcggttgtggagcgttttatcggtctactacctctttttcaaaacatagcaactaacagatgacatatcctagtactataataaatttagatagcatgagagagtattctactttggatttggataccgccgttatgaacaagtagtttaatactacctctatcccataataattgtatctctaggatttaaatttgttccaaaataattgttagtttaatactacctctatcccataataattgtatctctaggatttaaatttgttctaaaataattgttataatataggccgtgtttagattaaaactttttttcaaacttccaacttttccgtcacatcaaaagtttagacatatgtatgcagcattaaatgtggacgaaaaaaaccaattgtatagtttacatgtaaatcgcgagacaaatcttttgagcctaattacacaatgattcgataatgtgatactgtaataaacatttgctatcgacggattaattaggcttaataaattcgtctcgcagtttacaggcggaatctgtaatttgttttgttattagtctacatttaatactttaaatgtgtgtccgtatacttaaaaaaattttggcacacgaactaaacacagccatagtactaatgatcttattaatcaattatcatcctaatttctccctactttatcctacccttaactacccttcactcttacatataaaccatttaataaaaggtattctcatttttttctcaaaccttaatatatgctaaacaatctagaattacaattaatttgggatggagatagtagaaggttataagccaactatgaacttatatgaaaagataatttaaaaaataaagacagttggtccttatgtaaaagctagctattcacatactttaagataaatacattaaatgaataggtaagaaatggagagaggagaaaaaatagagataatcttatataattcatcaaatatatatgttaactttaatatgagctatttagaaattgcttcaaaatatcaaataaatatattttttaaatttatataactaaaacttaattaataatgagctaatggcttttttgccgtgccctaactttacattcatgcttattataaacgaacaccacataggtaaggccactaagaccattcccagcagatgcgctatcccatcctccatcgagaaaatcgtgctccaaacagatacaccatcgctgcctccaaatttagtgcatgggagatagaaacgtcaaatttggcgttcctctctcctcacgccatattgcaaccgcttgcttcgagaccgagcttccgcatctagccgaatcgatgctgtgtggggtggagtagtgaaggtgaagactggagaggtagaagtttaccagagatggagatgtggatggcgaagagaggcctacgaccactagaggcctacgaccactgcttcctcgtcccaccgcccgggtgccgactccgaccgctacttctccgcccgccgcgccgcctacgccacctggtcactggcaccaaccgccgcttctctgccggctctgcccagtcgtcacctcgactaccacttctcctatcatccttcttttttcttttttttcggtcactctctcttctttcaataggtacagataaatatgtttgagcataaaaatgagattatggtattagtcgtcttctactattttgatagttccgtaatgtttgtaaatatagcattataaaaaataatacaaatgtatggatagttgaaagatattattattaaaatataggaggatgtgatatagagtatgtaatatggatggtctattggaggaagaagagtatcgagtgggaatcttttttaatggctatacaaataaagatatgggtaatcaaatttggatgagccgctcaaaatagtagaaaagaaaataactttcatgtgactgggaacagcagaaagcaccaccatcaccatgttgacgatccaacaaattgaaaaaaagaaaaactccgcctcttcaacaaatggagaatctttcttgcatgattcctttcaacgcctgcaccgtaagtactcaccgggtacaataaaatactgcggatcccgtcttttgttaggaaatgtttttgtattcgagtcgataaacctactggctttattctaaacctttgattagagatgtaataactatgttttcccatcaatagagctagccatatggcattcaaaaaaaaaaataactgcagatcccgttgcaaccatcagatttactaattgagttagtgctgccgtatagaaggaagactgctatcatatactccaacctagtacttagatggtacataatccagtacaacgaatctatgtaccatccaagtgttttttttggacggagggacatgctgtgtataggtagggtgacatgctgtgtaaactgttggttacctttttttttgaagcattgatgtacactcctatatcagttccttcttaactttctgaaaatgtattacattgcttgctgcaaaagatgcacacaatgcaacgacgatatggtatcatctcaagtcaatttcaacagtccaggatgaagctaagacatgatggcctggatgcaaaagcacaacacctagcgctacagtcgatataatatatgatacataaacgaaatgatcaatacaatctacagccgtggttttggacattgctcaaaattgtacacaatggcatcaatcctcaactgtttgacaagtaatgaagtgagacagctactaccgccacaaatacaaccttgagtagcagctttgttgacaacagagatgtaggtgaagatccttgtggtggtgggtcgaccttcttcccccttagcttggctatcaacagaggaatcagcccacgcttcgcggctgtagtaagatcgagattggtgagttgaaatttataaatctgagaagtcgattataaccacaatagtagtgtagtaatgcagcacccaaaacaacaacatgatgatagtgatacaagccgtaacaaacggtatgtactaaaaagttgttcatgtgtagaaagtgtatgaagatcaagaactacagaagatcagatgatagggccaatggtgcagcaaaaataattttattcttgatatccagtgccagaagcaacagatggatggctcaatgccacaacataataaccaatacttgtgaatttttggccaggcaagctattataaactgatttttcctgcgctacatcaaaacacaaggatagtcttgaaaactgagacaagagaactgaagaaaaaacaacctgaaaattacacctaatgaaactccgctccacaatggctatattgaaatgtaactccagaatccagagagaatggttcaaatcaaatcaaaagaagacaagaattgattgaacagataccagagaaaggtgtaattctataattgtttcctatttattacaaaattaaatggtcaactttatatttgccagaccatgtattgtttaaaacagcatgtatctgttaaagcagcgaataatgtaatcacccaaacacaagcatttctaaaccatgttttcttcaaactaaattccttctatgccatcaagggttatctcaatcaattatttgccgcaggagaacttctcttgtatgccacttcttgtaggaccattacataagttgccataaccccttaaaaaggatatgttagttttttctaacaggtactgttgccttcttctgttgacttacctcaggtagctatagagataaagaggacatgcccttgacaggctgaacttaagtccagcttgctcctggctgcagaggagcagcttggtggacgggtggaggttgatgctagtggaagtagtgtcaagatgtcccagcacttttgtgaacctgcacaagcctagagtttgtggttctttagatgtttaccggcatgtataggagtgaagaacttcatgaataatctctgccttgtcaggacatagctaatgatgagaatccagctgatttgggtacaatcagtataatttgtcattttggcatgatccacactgtggatgagaaaggggccttgaggatttcttttttgttgacttatgctgtctgctcagtccaaagtaagagtgaaaggtttgggagtggcagaaaggacaaaggaatgcacaggcagagattgatgggccgtgttgcatccaagaatccatctcagtgacagcagtgatctacttggcggagattgggggcagaaaacagggctcagacggcagccggcacaatagcaggaggcaaggtggggaatgaggtggcggcagaggaagacatgttttgatattttccttgttcagttaacagcatggtgacaggacatggacagctggcaacccacaagggatgaaaattgaattccagtggcatataaggatggcaaatgtttttcaatagcggacaagggatcaagacaacattcgattgcatagaaggaatcttctctttgttttcttcagcacatcacattgatttatttctatcttatatgaattctgagaagtcattatctagcacaaactataaaatatcctagaagcactctagtcgaaaataagaaagatagtgcagtgtaatatggttcagcacttcagctagtaaacagaacaattgataactatattaatctgctgacttttccatagcaaatttatgaactctcaccaaatgctaaaacaaaagaactcttggagaacactaaatttatcaagatcattaaattattactaggcaataccaaataaaccaaatgttttttttctctgtacatcctgcataaaatataatcttcatataagtatgaatattgcttgtgcaattcatagtgtgagttgtcttaacacctgaaaaaactcatcctaactcatacccctttcatacgtgagtagaacactaaatctatgttccagtcataagcaaaatactgccattgtccatccgcatgatactaattgttgtgcgaatagagcactaacttgtaattttatatttcagatcgaacatccaagtaaacaatatcaccaaccagatcaaagaacacaagaagtcatgaactcagggcattgtgaaaaggtaaccaaatgaacaaagtagtaaaattacctgcttttttcaattccctctcttcttcaccaattcgtcgtctcaaagcattaagtagtgaaccaaaataaagtgctaagacggtgcaagtgaaggtgatgacattgtatggcatgctgaaatcaggagttgtcaagggaacaagcaatacttctgtatatgacttgaccacgccatcttccttcaagttataacaatatcgcaatcagtaagtattgaagcatgtcatttcagttcacatggtagtctttttgcttttgcttctgatactattagtcaagtcacaagatataccttgaacgtttgtagcaaaggtgacacaaataatgtatcaccttcaggataacttcggctagaattgaactcaggaaatgttaccaaagctgatgggatgtcaaatccttgattagcatcaggaggatattcatcgatatgcagaaacccctgaaatatgcattcatgtaaatataagaccaaggtcaacatttagttctatatatcactaaataaaacacaaaggggaaacaagtaaatttaagtagcagaacaaaccttgtcaaagtccagcgacagggtagctgattccatactgcaaggtaatcttagtagcatctctagagtaccaggtaaatgtttgtcttctgaaggagtgacatgaatcttctcaactacttctgaaatagccttactgttcccatcaatgaaaatttgtaagctgtgataataaaccttaacataccatggaacaacttggaaaactacagcttttattgagcaatcatttgagcttccaaataactgcttatgcaaattagtggatctaaatgacagagcaatcgaccctctttcatttccactacccatgagaaatctgtttgcatgatacggtgcaggggtgcaagaccatatgaggggaagtttccaggttatgccaacatccaaaggcttatcattgttgtagttactaacatcatattcatatagagaagaagattgggcatccatgttatttaattccttgagcaccctgtctggggcagttgacagcacaaagagttcattagtccaagaagcttcagttccagatttgtcaactatatcgttctcaatctctaaaaatactctgctcgatttggagacacggcattttcctgataacttcctgttaaacagatctttcatggaccagctgggctgcagttgtccatcagtagaatgtagttgctgaccccaaaaagtatccggctgcagaaccactgtcaatgtctgatcgataataataccaaaagattgagatgatgtcaatttcagtttttgggaatggtaatatcctttatatattgaaggcctgtacagcaaagaagctatcccagctttgtcacgacaaggaagaagtttcaaccaaggtgtgagattctcagtgcacaccgcttcacgaggcaatgcaccatatcttagattcccttcattcaatttgaatccccaacgaggagcagaaaaggcagtggatgattctaaaaagttaatggatgcacaaaacaggcctgagagtgtgtgtgtcaggttcttccatgtggcatcaatctcatccaaaggaaggtcaaaagctgcccacagctcaacaccaggaggctttgcataattggtcgacattgggtcatatccaccccactgctcataattccattgaccttgtgtgaaagatagctccaattcactaatatgaaattgttggacctggtttaggaagcacagcataatgttaacagtaacccaggacattctttgaaggcggtagaaagttaataaacagatggggaatggaggatccattcttctgatgtgacagaaggaacaaaattattatggttttacttgatataaatccaatagcatagagaatccatatgaagggatatttaggttggttatttagagagcatgagcacattaaggaaatcttagtaatctgaacaatagcacattacagaacgttagttaatagtagtatctattattagctacatgcaactatggacaggggacatatgctacacagatcttcatgattcagtattatctcatcgttttattgttctaaaaatagttctcaaagacttgtttttcatattaggaagtgctgatatatcacaaaatctgcattaaatagtgtttttttacttatccatcataacatttatcgaaaacaatgtaaaactgttaatataaagaataagtttgctttgtagctttgctatcctggtcctctggggacacattctctttgtgctaatttatggttcctactcataccaacactttcaatattgcagtttagacaccatgtgttttacagacgactcaagaaaaccaaagtccaaacggcaaaacagattgagtcgattggaacacaaaatatcatgaagccattgttttacaaaacaaataaagtgatccaatacaaaattgtgcctgagatagtcagcattatgcatacagcagtgaatatcctcgtcgagtcccaactacagtgaatcaactgaaaaatctctacaggagttgctacacctcaccgttgctgcgcataaaaaacgagccaattgctctaaccccgtctagtatcacctgattctacagctccgcacggccaattcacccaattcgaacgaccactaaccatcgaaccctaacttcctaggtccagtgaccagtcgcgagatctatatctactggggcagtgtgggggagaacacgggggtgcacgtaccagctgggcgatggccttggggaagaggtggtggtggcgtccggcggcggcggcggagggcgacgcggaggagcggaagtggaagtgggccagcgccttgcggtcggggagcgggcgcaggagcagctcctccgtgaactcctcctcctcggccgccggcgctgccgccgctgctgctacggatgcgaggaggaggagcgagaagaggaggaggaggaggagacggcggagagccggcggcggcgccgccattagcgccggcgaggtggggggtttgggcggcggcgtggtttggtgcgagagttgttgcggggtcccactccacaggttagggacacggtcacacggtagtaccgtgttactacgacacatggtgcatcagccattggttgagctttgagattcgtgcgtataaaaagaccaatttaatccatagagaattgcaaccacttgtttgttagaactatctccgtcacataatacttgtcattctaggttgtttagcatgtgctaaggttagaagaaaaagactataatacctgatgtgaccatgactactacggatacaatcgttgctcacatcatagatgaacaagatgctatcaagatcaagtcctccaagtgctggaatccgatttggccacctgctacactgctaacttcaaacggccgccgaatattcatacgacatccgtttttgacccgtgagtacttgatggaaagctctcggagtcctctttcaaacggatctaacctcattgccaaattccttcacagtcgtgatggaagaaggtgttgcgtcacctgtaataggcctatgggcttgtaatttcgtttgggaccctggcccaagtggggcccatgtggggtgcgccccaaccaggtagaggacgacctagaggtcctcccaccttcttaaatagttaggtaccccttcagggtttcttgggttttgtttagatgaaagtttagccattgctacttccttgcagcgcgcgtgtcggctagaccgtccgtctgcttgtattcgaaaccccaacttatcttgtgtattcattcctatttgcaattcaaattgcttttatcttcttcttgcttgtttcttcgatttgcttgcaggaataaggttgatctgcatcggcaagatcaacaacccacggagaggtgtatcgatcgctaaggcgcaacacaacgtctcgtacggttgtagttggatcgtcaacgtttctcccaaatcgtagttatctcaactcaccgaaagatcgcgccaaacaactgccttgagtgtcgagaggaactcagggttcatcaggtggtatcagagctttcgttactcggtgagtttttatctacccataaccagaaaattgccataaaaaaagaattgcatcctttacctagccatacttgtgccattgcattgttcttttcagtttttgatttgttgaattttgtgttgcatcgtcacatcgtgttgctggtcatagcgtctagttcgtttagagtttcgagttctggtcacgttttgtaccacagtcgtcgccgcccgccgtgtctttgttgtcgtcgggacctaggaaaatggaattgtcttgttgttgggatttcgcttttctagtttccagaagtttttgtcggtcggttttggagttgttgagttgcatataaggttgctgagttggttgtctttctgttttggccgtgcttgtgttcgtgcacgagaggaggaagaaaagttaccaaatcattttttttggcagtatgcaagttagatctggaaagaaatagtagattggtttggtttctatctggggccacgcagaaaaggaatcggtatcggtttccttcttttagaattctcaccaagtcccaccaccttgcatgcggcattccttcctcagtccggctccctccaaatcacgtacatcacaaagtgtgagtcgtgttaaacaccttggtgaatttttgtttggtgtcagtttcgagatttgtttgggaaaacggaaccgacataaactcagcattccatttttgtataatttttatttttgtttagacttttacatttgagtcctagtaaattttgtatttacatttgagtccctataaacttgcattgaggtccttaagtctgtttttggtaaaaaaaaatcataaaaaaagtgagaaaaggcagaaaggtgcataaaaaaacaaagaaaacaaaagccgcaccgaaaagaaaaaaaagaaaagaaagtaaaaaaagatagaaaaaagaaagaaaaggtgagaaaatcaattgctatcattgaggttgttttgatatatcagagttgtgcttttattgtgctatcttgtggtatcgtttgtgtctaggctcgcgtctctagtacgttctagcctaggaccagcacagtactgagtttgaacttttattcaactttgcattctctgattttaacatttgctattcctttgctagatacttaagcctacccagagctccacagatttgattgcagccgtacgacaggtgtttgccaaggcatcgatatatccaacctccattggggtgcttggttgagttggtgtatgtcaccattccgcttgcattggtaagaatttgtaagagctcgatataaagcttgagtgtgtgtgatttgtgagcttccactacctagtagttgataggaacgtatatattcttgtatatgtttcttgtttgctactaactatggcagggttacataaagagtttggagctgttcgtgctcaatgtggacattttcacctgggacatcacatggcaagtgaccaacatgacgcaaataaggtacatgatcataatcttgcaagagtagagtctgttttgacatcttttgatggaaagtatgattccgctgcatacattaattgggagctagcagtagaaaaacaatttgataagtatgatttttctaatgctcaaatgattaaggctgctagtaataagtttaccggttctgcatctttttggtggcatactggaaataagcttgaaacatgggatgaatgcaaaatactgatgagaaaaatatttgtgttttcatactatagacgtgctctccttgagaaattagaacatctaaaacagggtgataaaaccgtgcgggagtactttcatgactttaaaatttgtatcacttatattggtccaaaagaaagcaatgagaacacaatgactagattttttagagggcttaattctgatattcaggctgggcttattaacgtaacatataatcatataggccacttgttcatgcttgcttgcagtgttgagagcaatattttaaagaacccaagtaagaaacaatctatgcttgtgcctcctattactgacattttgcagggagctaagaacattcaccatgaggagaagagcaatatgatcgagatgacatctacatcgctcacgaaggaagaagagaagactgatgcacctacatcatccgaagagagaaccacaggtaatcttaatggtgttgcaattaatcaaggtaagtgtgccgttaatgaattaaacatgtctagagaagagcaaccattagtggaaccaattgctgagatgcctttgtcacaagttgatttacttgctgttccttatgataaagaagagttgtgtgataatgcttcacttaaatccatgccacaacaagtgaatgaacatgttgtttcttgtgtttctttgtgtgctgattttaagcatgttattcacattgctaatgaagtagaggaacgtgaattgacatcttttttaaatactttgggctatgttcaatgtgatgatttttgtgagctcgatagtttgaaggagaaattatttgataaaactgatttgccatgtccgactaatgttatttttcatatctttggcgaatataatgatagacagatatacttggtgtataaaatttatatatgtttggatttagaacctcctgtagatgtgaataaaatatgcaagctagagagacctattattgctaatcatattatctcgagtttgtcttgttttgattagaagaaacagattattctaaatggaccatgtgacgagcaccatatggaaaaaccgaggacggttttccgtaaagaaggggaggatgatgtgaccatggctactacggatacaaccgttgctcacatcatagatgaacaagatgctatcaagatcaagtcctccaagtgctggaatccgattcggccacctgctacactgctgacttcaaacggccgccgaatatttaaacggctgcatcagagtcagggtttaccaaactgtttggggtggggttaccgccaccccacggtttgacggttatcgcgagttatatcgtggtttcaaaaactgaaaagattaccgcacgtgataaccgcgataaccgtacggttttgtgaaccccgatcagagtcgaggatgcaaagtagtatgctcacagaagaacgagagcagaacttgcagctatataggagaaatgctaggttgtcgttatgcttacagaaaaccaagcggtggcttttgtcaatctatcacaccagatgctcacatcagagtttcataggtgctattatttaaggcaattcctttggtactagccctttatacttcttagggggtcttatttttcaagttctattcatgggatgctctggtctgaaggtataaactgcaaagtttaatgttagtaaatgaaacaaaataaaccaaaagatttgacttgtaagttagttccagttagcctttaacttttatattggcaatttctgtaacttgggatgctggttgctgttgccactagctggtttatgccataatttgacctatgaaatttaagcagatcaaattaaagctgctcacctcttgcagattccatgatcatggagggatgattcagttggcaggaaagagtctgactgaggctgatttgtcactgtgaagaaggcatataaaacactggcatttcaattcagtcaaactttttgttggtgcaccacatattttggaaataaaaggcctcagatttacgctcatcaactcttgtatatactgtggagttcacctcatgattgaattaaacacaatttttggggcccctaattttttttttttgccctgcgcagctcgcacgtgcccaagacaggccagattttaacattcacaaattacctgcctttatattggtgctagttgcatggtaggtagcacaaaattatcggcctgttttatagttattgagaccggaccgacaattgaactggtgagtctcttggttcaatggttaactggtttaatcggttggatcataggtctaaagctctaaagcagttcattaaccaattaaatatattacttatttcttcagaagcatagcatcccatgtggttctgggttcaaatctcacttgagcttgttttgtagccggttctaataaaaaccggacagctcaaattgagaatgtttggttggcagtcaatgttttacatgccaaaccttaaggtgtgtcacaactcgccttttgttgagcttaatcaagccacactttattagcatatttgtcccatatatcatactccattttgaccatactctgtgtagctttgtcacatttatgacaaattagtctccaaccaaataaataggcacttatgatatcattttttttatgtactgtgcatccagagactatatagggatagagtaaaatgattatgaggccactctccacgaattatgagccacaacaagtttagaatttattttaaaattatttagaattttatactaaaattattttcatcaattcagtcgcttgtgtacagcttataagttaacatatcaattatagattcctatccgaacatacgtttttcaaagcaaccgtatacatatcttgctcccaaaagctggggttatctaaaatatactgtaaaatttgactaaaattccccaagtttcatgaaaaatattttgttttaaactgaaggatgttttactccatatgaaatgtgtcagcctgtcaggttaaacgaaacccccccaggcctcctctccaacccgatgacaaaagagaaaattgacatttagccatcgtcaggatggggtttcgccagaatgccactccggattgtggcttcgttataatgccattttcgaacgacgccacattgctactttgccatttcgaccaaattagctgatttgcaaatgatttccaccgtggtgtgacaaaattgcccctgtgaccatttagttgacttgcgtggaggagatggatccctggcgccggcgcggctggggacggagatgatgccggcgtgggtggagaaggctgctcggctcagcggcgtggctgggacgatggtggcgtcggcgacgccatccgcgtcgacgtaggataacatccccacttgccccaaccatgtcggcgccgccgccatccctgtccccgtccccgtccccagccgtgtcgccgccttccccatccccagctgcaccgacgccaccgcctgtatgtccacatgctccaccgtcgccatcccaccctcacgcaagaagcatcccgatgacacacacgacggtggcgcgacgatggctagttctgaaggcaaggcggctgctacatctgaggccggggtgacggtggcggctatggcggaggcggcgtcagctaggtttgggggcagccttccccacccacgccggcgtcgtccccttccccgtccccgtccccagcttagctggcgtcgtccccgtccacagccacgccaccgagccgtgctgtgtatatgcaacggagaggaagaagagagagatgagataggataaagggtattttagtcatctcagcaagaaaaaacactacaaaaatcattaaattgagaagaaatggataaaatggcattacaacatgttgcccctgtttgaggatggcattttaacgaaaccacttttgggagtggcattcgagcgaaaccccgttttgacaatggcaaaatgtcaattttctcatgacaaaacccttttcacttgagttctgcagaaccagtggcagcagcagccggcggcgagccatggcaagaagccagcaagccgctccgccgcctcacctccgtcgtcctcgccgcgccgccgcctgccgtcctatggtacgtagcctcctcgcgcgcctcgaaccccctcgtacgtcacgacggctgtgccctcgctgcagggaggcccccccccacccgttcggcgaaatgcgcagctggagcgctttgcctcggcttgtactctggcgtcgatgccatgattatgtcggtctccatgggtgatgcattcccggccctgggatcctacccgcaaaagagctgctgtcccgcggtgggtaattggtttattctggttatcgagtacaaattcgattagctggtggtaatgatttgtttgtttctttccatgatgcagaggccccgctcgatttcgttcttgcccctgccagaaggaaaagcactgggaggggaataagtgcacatcaatggggattttctctggctggaaagcaagcaaggtatggaatccaacatcgatgcttgcacaacatgtcttttttgctttgctgatgtctcaagaaacggatcaaatttttttccatgtcagatagcagaaggcactcacatagcttgctaccttctgcagcactataaatacgttgttgctatcttccacaccactacacacaaatagcttacagcccttgtctgcgaacaagaaaaatggccgttgtcctagatgcttttgcgtcctacgtcagcgacctgctcttgcaggtggccaaagatgaggtgggcatgctacttggtgtctccgacgagatcaccaagctagatgaaaagcttcaatttctcaaggactaccttgctgatgctgaaaagaagcgcatcaccgacaagcatgttgacgggtgggtgaggaagctgaagggcatcatgtatgacgccactgacatcctagagctctgccagcttaaggccatggagcagggttcttcagttgacttgggctgttgcaaccccttgctgttctgcctacggaatccattgttcgcgcatgacattggcagccgtatcaagaagctcaaccagagccttgatagcatatgcaagacaggtgccgagtttagcttcatgaagctggaagcctatcaagatcgaaggactgcctctccgctcatcagtcgtacaacatcaccggtgttggagcggtcaggtgtggttggtgatcagatcgaagaggatacatcagcattggtgaagttgctaactgatgacaaggagaccattcatgcggagaacaatagcctgttgttagccatagtgggtgttggtggcattggcaagactactcttgccaagaacatcttcaatgatgatgccatccaggagaagtttgacaagaagatatggttgagtgtcacgcagaagttcaatgaacctgatctcctgaggagtgccatcattgccaccgggggtgatcaccgcagctcacatgacagatctgtgcttgagctaagccttctgaatgccatcaaggggaagaatttcattttggtgctggatgacatgtggactgaaagagcatggaatgacttcctccagataccattcagtcatggtggtcgaggtagccgagtcattgttaccacaagagatgagagaattgccaggggggtgaaagccaagtaccttcaccatgtcaacaaactaggatctgacgatgcttggtccctgctcaagaaacaggttcctctttttccatctttcatttgaagaactgttctttctttggttatttacccgtctctgtcctatctgtcttgttaaaatttgctgatacaaaataaagttacctttgtagggtaaaatggactactggaagatattatttctagaaatacacatggcaagtactatcggcgctagataactatgacacaaaccgtgttaatgttgacatgtagtgccaacgttcacctttacatctaaatatctaaaccatattgatgttgacattttgtttgacatggtctattagttgataatatgcttgacttcagttcatttccaaaaaaaataaataaaaatattgatgtaaaagttttgcaagctctataggtcaagatgaacaatatgcatgtccggacttcccactggatttattgtatggaaaaatatgcaatttatgaaagctctgttggttaagataagaatgatgataggcagatctggaattcacacacacacacacacacactattgtagcccataattttaagagcacctttttagggtgaacaaaaactacggggtcatgaagactttcgtttgtgttggagtccatcttgaagacattattctgcacgttgctacttgcaatgcaaactatatcatcccatgtgtgttccatagtttacaccacaaaatgccttcatctgacgctatgaagaatcaacagtgctaccattctttgcggatgatttttcagaaaaggtgtagttacagattttatgaacctaggtgcatatgcaccagcaatcttgaccatccataggcctgtgcagatcttacagcatgcatacttggcactagggtaaaatgtacctaccaagctttgttcccttatagtgagagcaggggttggtacatgatctaaaaaccaagaccaaaatatccttaaagtagtactccattggttctgttggacaataactcattactcactcaaaattccctcttgacccatgcacatggtaatgttagaagatagaaatcactcgattaagttatatcattaataatcattgttagcacttgattttttttttggcagttcacctcaaataatttcttctggtgattttgattccacatgagttcttataatcttttgtgatacatcaatttgtttaacaaaataatgccaacacgtatatataacaaatcgatatttcattttgtaattgtcaaattttttggtgaatgaagatataccgttcttgtaaatgtagatatactatattgaaatttcattgtatgtagatatatagatcaaagtttctttttgtaaaatgttattttggtaaattggcacatattgttttctatattacatttgtaggtataccatttaaatgtaaatctagctttatgtcattagttcaaatatgcatgacattttatttgaatttgaaatgtgtataaaaaaagcaccacaaaagtatcatgtgagtgtctcgtacctctttattggagtaatgtacacgtggcataatcttataatttttattattacgtcatatttttatttaaaaatgatatagatgcaatttttctcctcctaactattgtaatatccttccttcagtggatttcaggagaggtatcatttacaaatgtcatttagtaaaagatcaatttattaggtgcatgtaatgtagttgtatgaaaacaagtacgagtgcttatttctgaaaaaaaaaagggaccatgcaaagttgcacaccatgagatgaagaactcaaaacaacactaagaaaaataaagtaatattaattgtgtgtttaacatgaaagagagctataatctagttcaggggtaaagttggaaggctaggaagtgatgtcaaagtcacagtgacactatgtactaccttctttttatgcctttatagttagacttcacaagtacagagcaatgaacacttagtagcacacatcttggaacacatcaatggttcagattttaggtgcaaatgaaccttggttcacatatgcttttccctatatatatatatagaaatctccaaactcaataagaatgatcatttcctaaataatgattccatacatgatttgattaatcgatgaatatcttttgtcatgtattgatttgtaaatatcaattccttaaaagtatgagaaccattttattgtaaatcagaattagaaattcctgcaaatggagacataaatatatgctaattttgtttgagaaataaacattactgaagataactatttgccaatctttcttatagaaaatgtcctacaaacaaatgaatatgttgagttcaaaaacatttggaatcttctcttcaaagatattgtcgatggatgtttgcttgctattatatccatctgacatgatccaagatttgtgcgacggaaaaattatttatttgaaaatgggaggttgggtcgagctttcaaattgaacattaatttcccacgacgtcaaggcaacaaaaggtgtgtatataattgtacaatgcataaagaaagtacaaatcatcttgaccatccaacatatctaaaattgaaagcgatggtttagttttcttactgtgtacaaaaaagaaaggagaagataggtagagtacgaataagtagatgtatatgtgcatatttatgcatccagaagaacaaatagacttccagccaatatgtgacaatcaactgcatgggtgctgttgtggcttacaccttacaggatgcatgtctgctgccgtatgtaggtaggatttatttttaattaattaaacctggtagaaaaccaactaaataatgcttaaaattatatctgtagtactccaccagaccaccatatttaaaaatctaaattgcatggcattttagtatctatttttttagagaaaaatggcataggatctaaacttcttcggttgcgccgtttcttatgtctgatccagggccgcttcagtattttcttaggattgaggtttttctacaccttagggtttctacttgtcccaagcaaagtatgtacatgatcttcttaatcaagcttctcttactgatcagcaaactcccatggatcttaatatttatctttctgctgctaacagtgagcctcctatatataactactaggcaaggtgtaatagtactttcaataaaaaaaatcctgaggacctcacatgttactattatctggttgggaggtcttgttatttgggtgtcactcgtcctgacattttcatgtccagttcttattttgagtcattttgtttttcctcacactcacctccactataaccatcttctttgtgttctgtgttatcttcgcgggactatctctcattgtctttgctttcctcgctctacctctttatagtttcaggcttatttctgatgctactgggctagcgattcctatgatcgtcgttctctgtcagcttactatgtttttctttgtgtatctctcatagctcggaagactaagaagcagttcttagtcaaataagaacagtgagcagtgacatttttgttggtagaggttactttgtctgacttgtgagcagtggcactaaagttcataatagactatatattccttaccaatacctgtaattttcgtgcaaatgtatttcagtattaatattatttgatacaatacaatcaaataagcataacccaataggaaatgcataccatagaaaatggaataaaatgcggaatgagttaatagtacattttttgcgatcagtcgaacattatagtgcttaacttatatccttattttttttaaaaaaaaaacaaacttgcttatgcatgtgcatgggttgatggctagttcttacataatttgagtttttgtaagctcatgtatgttaaagaaaaatagacccatttatgcatactactaattgaatttgttgacttaaattgcctacaggttatccttagtgagatagatgagcctgagattgaggcactaaaggatgtcggaatggagataataggaaaatgcgatggtttaccactcgctatcaaagtgctagggggcctcttgtgcagaagagatagaaaccatggtgtttggtcagagattttgagtaattctacatggtcagttgatggaatgccccaagacctaaactatgtgttgcacctgagctatgaagatctctctcctcatttgaagcaatgcttcctgcactactcacttatccctaaaaatgttgtccttggttatgataccattattggtatgtggatcagtgaaggacttgtacttcaatgcacaaaaggattagaagaattaggagaagattactacaaggagttgatcatgagaaatcttttggagccaagtatagagtatgttgatcaatggcactgcacgatgcatgatgttgtccgctcatttgctcattatgtggctagagatgaagcattggtggttcaaggtagacaaattgatattagtaatcttcattcacagaagttctatcgattatccattcaaactgatgatgaagtagagtggaatcttctaaaagagcaaatgtcactcagaatgttaatatcagtaagtgatatcaagctaaggcctggtgattcattgggcaacttttcaggtctacggatcttgtgtataaattcatcaaattttcttcctttggttgactctctgtgccaattgaagcacctaaggtacttgtccttggcaacagatgatatatctagattgccagatgacattggcaagatgaaattcttgatgtacattgacattaatgcatgtggaaatttggtgcaacttcctaagagcattttaaagctaagacagctgaggtatctaagccttggtgacacacatataaatgcaatacctgaggggttccataatctgtcaagtattcggaaattatatggttttccagctcacatgggcactggtggtgtttcgccaaaagagaattggtgtagtttggaagagctagaatgtctttctgagctcagggatctagacctaaattgtcttgagaatgtctctgccagctcttatgctgcaaaggcttcactttgcaccaaggagcatcttatcttcttaaaattacgctgcactagtagattgggagatgatgggttactcaaagaggaaggtttatctgagatggagcagcggcttgttgaggaggtgtttaatgagttctgtcctcctcgctgtttatacaatcttgaaatttttggatactttgggtgttcactgccaaattggatgatgtcaccaatatccagaacgcctcttacgagcttgaggtatctgtttcttaaagacttggcttgttgcacccaactacctgatattttgtctcagctccttcatttgttcatgctacaaattgttcgtgcaccggccatcaagcgtgtcgggtctgaattcctgctctgccatgatcatggccatcattccctgacggcgaaagcatttccaagattgcaagtgctattcttcgtggggatggtggaatgggaggagtgggagtgggaggaacaagtgcaagcaatggctgtcttggaggagcttttacttgagcgttgcaaactgaggtgccttcctcctggccttgccttccatgcaagggctctgaagaaactatggatatgtgaggtccagaacctcaagtctcttgataacttcgcttgtgttgttgagctcagtgtggatgacaaccctgatctgcagaggatatctaattttcccaaattgcggaagcttgacattatgttctgccccaaaatggaagtattggagaatgtgccagaactcagaatcctcacacttaaggactatagtattgaaacactccctggttatttgcagcaagtaagcatgaggaatttgttcgtggactgcagctttgagcttcttagttccatagccatgggagatacaggtcctgagtggaacaagatcagccatatccagcaagtgaaggctaattcagatgatggatacgatgaaacgatgtggtatgtctcctacacaagagatccctacagcttcgagacaaacatcatcccttcgtccaatcccagtggtatattttttttcttgggcttctgctcctttagtttctttcacatattttcctcatgttgattccatctttcatgtgcatatcatagtgcaaactaatgtccttctgtttgtttag

SEQ ID NO: 61506 - DNA, 13583 bp, Oryza sativa
tcaatccccttgttggtggcattaaccgaacaagccatcatggggattaaacgaacaaggcctaaagggtgctcactactgctattcaaataatgccgatgcacagatttatatcaccaagacattaacacagtaagcatactcaagtactcaatggtgatatctggcacgtcaacacttcttaggtcaaaaaaagacagagtgatgcagacgtccaaataaatcaggcgatttcagtgtatagttatagactgaacacaacaaagcacacccacaaggcaaacatttacctaaattccagccaacctttgattctctccaaaaaaagagttggcaaaagtggcaaaacaaacagaaatggaagtttaaaagaagagatcttactcaagattcaacataatcatttagtgtatcaaaagcacgacagtaaacattcaaaggttgattatctgtgcagcttcatacctcaacaaagcttttatatattgcaagatacaaccgatgaacatcttcatggtcttcactaacttcaagctcctttgcaattatctccttaccaaagtgctgtaacatcaagtcaagaatcagtggtaaacatctgaactatagtcatggtcctcaaatggcaacttgtaaatttcaatggtctaatacatcatgctggacaaccaaggaggaacttggtgtcaaataattaagaagaatccatgagcacatcaaggatcgaacgcaggaggatcacaaaaggactgcaatataccacactagcaagtgcatctcggtctaatacatcacaaaaggacatcatgatcttaaatccactaataaatggcccatcaatctgtctagcgtggtaatgcagttaaagcctcttatgtagcagtttcaaggttctacctaacaatgtagagaactttgttcatcgtcgtgtttgctaacaagttgtcaggaaaaaagctcaggtttcagaatgtgaattatccatgggaagtaccttgtaaacaagcccggcactgctaagttttgtgttaaagccatgtccaaagacctcattaaagcccttctggtgatgatcgtagcgatgccggctgggatcatagacaccaccaacatcaagcacagcatccagagtatcgaggatctacaatgatgcccaacaagaaaaagggaaatacaggtaagttaaagatctaagaatctaagagcacattacaccaaatgagaaggtttatgattattgtatcatatacaactacaagcagcgatttttacataaattacacaacaatctgtactgtactaattgttgcacagacgctagtacaatgggaatcattctgtcatggataagagtaaaatcatcagcacctaactaagacacacatctagcacagatgcaagcgggacatttaactatttgctacttttaagatgtggtgtgtaacaatttgccactcataatctatgatatatgggccatcatgtgtctatgacatgtgtgtccagtggcaaattgttaaatgccacatctaaaagcagcatgtacaattcaggacaccagattatacgtaattaggagaaaaacacaactcagttaagtttaacagagagttgcattattagtatatacagaatctaattgaaacacaacatgtctacaaattgtaggaactgccgcgtacagacccgcaacgcaacccctagagacagacaaacttcacagaaccaaagtcattttacaaccccccccccccccaaccaccccccacccaaaaaaaacagaaaaaaaacaaaaaaaaaaccaaaaaaatgtaaggcaatggtaggttaatcgagccagtgagaaggcaagagacctgggggtcgcgggtgcggacgacgtcggcgccggcgaactgggaggtgaggcggatgaggtagcacccgagcgcctcgtcgcagtggaagctgccgttgtgggtccccacgcgcttgccgctccccgcgccgttcgcggagcggccgtcgcccgagacggacgagtagaccctcaagcgcttgggcgaggcggcggcggccatggggagagggtttagggtttgggatcgcacgcggggaatgaacgtgacggctcgctgcgacagcctccaggcggcgagcatactacaagtcgcgtgcggtgcgggcgatgggggatgaggtggtgactttcgctagatgttgggtttttgaggtggggtttggttggccgttcaaggccgccgaactgcaggaacaaggcccgatgcttgcgtgagaggtttgagttgttgccttgttgggctccctcttcgcatccaagggccgggacgggatttgtccccaacttacgggcatataaatatgtatggttggccggccatataaatgatcacttccaataaataatttgttctctttctaagtcatgtaaaatgagtgtatgttcgtgtcttttgtccataaatactcttactttgagttagattaaacgtgtatgtttaagttgggaaattggaggcaaacaaaatagatatagaaatcaattcccactcctttccatacaatggttaaaaactcctatcttattccgtccagcaaatggcgtacgtttagtcccatcacccctccggctgcttatcatcttccacttccaagatttcaaacaaaaaaatttccatccgggctaggataccacatgggcgattgacacatctgccaccttctcccgtcgaatcaagagccctttagtcccatcacccctccagctgctcatcatcttccactttcaagatttcaaaccaaaaagttctccatccgagccgggagactagctggtcaagggccgggagaccagctgggcgcttcaattgcagtgagaaggagagccatccccatccatccctctgcgcgcggattcccatccatccatctgctcgtgcggatctagaatttccgagaggaagaggcatggtgagtttgcaggccgccgagcggcgtgcggtcccgttcgtggtcttcacgccactcgccaagcccctgactgccgcgctgagcagcaagaggggtgatgggatctcagatgaacttattgcatgcatatatcatatgaccaccactttttacactttttagactgcaccttcgtaatgcatgattatgtatggttggctggccggccacatgaatgatcaataattcattttcttttcaagtcatgcaaaatgcgtgtgtgttcgtgtctttttcataaatactcatattttgagttagattaaacgtgcattaagatattagaggtaaacaaaatagaaatcaattcacatcactttccatcaacacgttgcggggttgtatgagggattggaggcaaacaaaataagtataaaatcaattaattcccatgtttaagttgagtgattggaggcaaacaaaataccacagttttctataggatggttagacacaaccttggcattaaactcgttgcggttgccatagttaaattaaggaaaaagcgtggacatatactctagccgcaatagccgtctatttttaaaaaaaaaaaattatggaagaagtgtgaacatatactctggcgagagcaaaacattttctacaactcttgactaattttgtataatctgcaaaaatgttgtagtttttttttctctaattggtatagtttgccagtgtacacatattttcatcttagaattacttatgtaaactttttaacttaaatcatatgaaacatttatcttaaactacaaaatgaaacatttatcttaaactacaaaaatacaactaagagatttagtttgagtgtttgagggaaggaaaaagaactcatatttagaaaatacacaaaacgaaacgagatgagttattagtgtatgattaattaaacattaattatttttaaacttaaaattttggttaatttgtgttttctaacattttttttaaaaaaatacatcgtttaatagtttgggaagcgtgcgtgcgaagaagaagaaaaatcttctctctttatcaatttatcaaacgcagtatatgttgggaaagcaacggcattaaatagcaattccggatgaacgtatggagcacacaattttgcgagcaaagagccaacgtatttcataatcatctataacggtctataaggaataagtccacttcatatcccccatctttccatcgagtttaactcgtatccttaaaccgcaatactggaatcttaaccctcaaacttacaaagtcaggttaaattagatcatatggtagtatgtgtggccggttttgccgacataataacatcttaataagaaaaagaaaactgaaaataccattaggcccatatgtaagtggttaccttacattcttcctgtgattctcctctcatcttttctcttcccctcctctcctccatgtcggggagcttctcctgtcggtggtgagctttgcgacggtcagggtacttatcctggtggttgcggagggtgccgggtgtgaggtgtctagagaaagaaggagatcgtcatcgtgggtgccggcgtggcgggcctggacacggcggtcgccctgcaccgcctcggcgtggacgtgaccgtgctagagcaggcgcctgcgcccagattacggtcaaacccgttcagagcagtctgtccccaaaatcaagctaatcatggcagccacccacacaaacgccatcctctccacttcccctctcagagcaaggataataacatagccaactgctagctctatactaataccatgtcatttatggcaatcactaatataataggttggctgttaggttagctgtttgtttacatctattgaagatttagatatttaatattaaacatttagatatttaatattcgcatgtgcacctgatctcctcgtatctggttggaagaaagcattttttcctttgtgtgttgcgcttcagccgagtgatagatgaaatgcccgctccatctttttcttcccttctcactcctccacgtcggattttgctgacgggtaacatgctagcgccggctgattaggatctattaaacctgctctcaagtgctgccgcctcccgagtcccgaggtgttccacgtcgccgtcctgctcgtgtttgatctgctgacgacggtcgcgtcccatgtggtttcttctccggattcaatcgtgtccaggagtctaatttggtatttctctcttggtggttttcaattctcctgatacattcaatctatgtgttaggtgcagtagttatctcgttgattgctcaatgtttttctccctatcgtcctagcaattagcagattgatcttggttcctataattcgtcgcttggaggagaggagaagaaaagagaggagaggggaagcagaggaggaaggtgagaggaaaccacttatatgtgggcctcactattttaaaccgaccacacatactgctataagagtattatacctaatttaacccggttttgtaagcttggggttaagatttccgatattgcgctttaaactcgacgggaagatgagcgacgtaaagtagacttattttggtctatattttcacgggcccaagcatcccaggaagtgcctccttgtaaatgggcctggacctgttgaaaagacaagcgggccacgtggactggtacatgtaccttgtgcggccgtttccgagttgaaacaatgtccgccgctacaaccgggttcacttttttatttttcattcgaacgtgcacatcacggagatttgtctattgctccgatattgccgaccatgcaaaagcacaaactaacatgatgaatgatgggtgacccagcgtgaccgaccgctgtgatctcggttgctactaccatccaggctccagcacaccaccttcttttctttagggcccgtttgatacaactacaactctagcttcacctctcctagagttgaagctcatccaaacagtttcagctccaccaaaattaggagtggagctgggtagagctctctcacaaaatgaactactccagacccaactcctagagctaaatttaggagttggagctgtatcaaacaggcccgtagtagagtagctgtagctccggagcagctagtgcgctaccgcgctagctccaatcaccggcctaattaagtgccctcgtcatcaagtttctagtagcatgttcttggcaggtttcacgtcaagtttcgtcctttgtcgtttgatttgtgcttgacgacgttccaagatcacggaaacatcaaacatgcaggcagaggtagttcccatggtcactacgcggcgcctttgattgttttctgatgcctactactaccttgaaaaagcgacgaatttacgtgaactactccgtatatataccgattttacttgaaggttgaagcacgcatcgtagcgtaccgcgtacgttctctcgcatacataaaaaactgtactatttgctcgcgatgcacgtactaagttatgtgaattaaattaaagaggtataccatggtcagaattaactgtgccgtccagccagacgcatcggtactacagcagcaacggacgggtcaatttctggggacgtatgctcggccacctgtcgagcgccatcaaatggcaccaggacaatgcaacaatcgcatcaccggttaattaagctgttcagcacggtacagattgcaacatttcatactccacaagcatagaaaagcaaccagttaacaggacaatcacgagtatcactttaattaaccttgaaaattaaactatagctagaccaacatgcttttcaacgatctgtttaccaacctggggagatttttattatctctaaattcctctcctatctttacacacgggattgatacagcatcaaacacactaacacgccaccaaacaatccaaagggtttaacaaaaacacaaacccgtttttacgtaaaaaagcgactatatttggtggggttttatgaaagaaaaaggtgagagatcttataggcaaatttagcttctacattggcggcgacatcatagggctaggatggacccggcccggacgctgttgccccgctcctgtgggccctccacctccctgcgtgaggagggggccccacgtgtcagcttcccggcgcggcgggctttctccgtcctctccgccgccgcgtccgcctccatctgctcccgcctgcactcctcgctgcagaacggcgtgtcccctctgctcgatcggcacacgaccgcgtgagatgagatcccatggcgtttggcgaagaagaagaagaaacggagagggtgaaaagtagaggggagagatagagtgggcggcacctgtacatgaagatgtcgcggttgccggcgagccgcttccggcagaggaagcacgcgtcaaggaaatgcgtgtgccctcccctccccatctcctcgatcgatcggatcgccgcgcgcagccacaccacaccagcttctccgccgccgccgccgcgcgtcgacctgactactccggcgcgagatccggtggtgccgtagaataggccgtgcggccggctgactcctccggcgagatccggtgcggattcccctcgcttgcggcggaatcgcccgtggtttccctggattctctgatgcgtttctgcgtgttctcagcgtccaaaattcgtgatgcttggtggggaggcaagcgaaggatgcgcgggctattatatagtgggaggggtagagaggtgtcagtaagtgggaccggagtggagatcctgcgggtcccacctgtctgtgggctctggcaggattccgcgtggagaccgacgcgctggtgttgtggcacgggaggtgggccccacggtcgccgacccgctcgtccatctgccgccttccagcttgccccggcagtgctgtggagtgggccctctccggttggtggaaccaacaagtcagtggtagtaggagtagctaggaatggggtttcaggctttgcttctggatgaatcttctgacgatcaccgccggatcaaaacagccttgcagttcagtctaaacaaaataaagaatgcccgctccttgcagcacatgtacacaataaacacggagattttatataaactacagtttctctatttatttttcatgattcttaacaggatcggcaattattaagcccctgtcagatactcagatcttcaagatcttgcggccctggcagctctggaaaaatcttgagaaagtcacacggtacctttggttctttgaacaagaagaagaagggctgtagtttcgccggcgaccagtggtccgcaagtttcagcctggagaggcatgcatgatgcacgggtgtttagcccctctctctcaaacaccccccctattagttgggctactcacatcaacgacctggagcactgcaaggcctgcctcgtggcctggatcctccatgaaatgctgacagaagagctgagtcgtctcgtcccgtaatactggaccagtggaccatcgcatggcgggcgtttcttctgcagaaatcttctgaactttagaattaaggttgccatttctatcttacgggctcgcttattaattaagcgcacgtagtaccggttgcggtgtggctgacgccttacggcgggcaacaactgcacaagccgtttaacttcatcccaaaggaatccatcaagtgtggttggtcatcaggctgagtttgcagtttacaggtggcagtcaaaagaaagcgtaagagcacaaagattgactccgaatattggctgcccttatggattccgtcaaagttcgagccatgcctcagcgcattttcgttacggtaagtcggtaattaacatggttaattagtagcttctcacttgggaaactccttttatcccttaacagaatacctcctcgtttttatatattatttaaataatcataaaaaaatttaacatgataatcaatataacatatactcccaagtaaataagcaaattcacatttaacagtcgcaagtaaaaaaacaaatttcagcacgactagcgtgtcctactcgcactaaaatttattatttttttatttgtacaagatacatttgaatttgtatgttagtggagtaatatatcatatattgatctatcttgttaaaaattttaaaattttttgatgatttttcggatgacatgcataaaacgaaattatatccttgagaggtataaaagagtgatattgtggagagtaaaaatctaattacatcgcacttacttacatgttagagtcgagcaatgacatcttagctaaaagagtgatcttgtggagacgtgtgtgtcttagagcaggtacaatagcaggctattagccaactataaacatattttaatgagataaatgatgagagagaagagcagcgggctacagatctgtagccataagtaactattgtatgaattggctattagattagctatagatgaattggagctagtagtgggctgtactattagacttgctcttaggaaaccttggggagtcttggcttaaaaaataagctgatgtggagctatcacctaggaagttgcattatgtgagttgtgtcgttgttgtggtgtggttatttttggcgtctttgatgattatatatacactctcgagaaaccacgccacgagaccacttaacattggttttcccttccctctttcagcgcatgctgccaaaacgatgtcgggtgtaaagttgtgatgcctactgccaataggatgcttgtgtaaactaatttgctcatcatctaatatattcacacacaaccattttgcgtgctcgaaaaaaataccactttacaatgtaaatgcccttatgaaaggataaattaaaccgaacggtttgattccacaatccaaaactcttctaaaacacgaatattagggaaaaacctaatatcaaataattagaaggggcaaagtttcgaacccagatcggttaacccaccacattgtggagctagccggaagacccttggacgtctctcaaatccaaagctcttctctgttcgctttggataagttccgttatttttagcttaattatatctccatattatcatcaacctgattatatattcatgccaaacttataataataggatttattgaaaacaaattcttcaacattacttagataacttttttacaagctaattgttagttacaatacataacatctaatttatacctataaacaagtatttatatcaccaaccaacttttatccgcatttcaacttaaaaagagcatgccttaagacatgtaacaggttccaaaggtaatataaatatgcttagttgggtactattgtgcaactagacagccaacagatcgaacatcaacaaaggaaaatgaagacgagatggaatagagagggcgttacaatatacattagaaaagagctcataggcttcttttgacagcccggtctgaaccagtacgaagtaaatagaccaaacacgagagcaggacgcctggacgagcatgctgttctaaccaaacctgtatatatatatatgctcatcagcaagcataatgcacaaaaaaaactcttctataattacttcaccgttttccctaccacaaacgtgggaactcggggtcgtggtggtggttcctctcgatcgatccatggactcttcgaaatgtctagtacacacctgtacttgtatatgtagtatcaccccagttgaacgcgtgtgtgcatgcatgcgtaacatgcatgcgcgcgtgagtctccaatccggcaaagggcgcgcggcttggtgtggtgccgagctgagctctctcttgatctctacctctgcggctgcagctgacgctggggcgcgcgctctgatcggtggtggtgcgccgccgcctgcgccgtgggagagtactgctgcttcttcctgcggtgcctgttcctgtccatctcgatctgctccctcctgcactcctcgctgcagaacggcgtgtcccctctggcgaacgaacgacatggtttagctcgatttcatggtgtgtgtgcagccaggcggtggtatggttgagggatcatcacctgtacatgaagatgtcgccggcgaggcccttgcgacacagggtgcactcgtcgaggaagtggtgcgcctcctccacctccgcgtcctggacgcagaacacggacggggcgccctgcctcgccgcgccgcccctgccaacgttcaccgccttcgcgccgccgctgctgctggtggtggtgcccggccggatggcctgcgcgctgccgccgccggagaagaccgcggcgaagtcggggttgccgaaggcgtggaagtaggacgaggtgaagtccatcgatcgggtcgtcgatcggcgccgccgcgcgcacgtctcgccgcggcacacctacgcagtccggcctgccggatccggatcaggcaggcgagcgagcgaccgagcgacgacggcgatcgacctcggactctcggaggaggggcagaggtcgggcggaggtgagaggccgttgggaggcaggcttaatacttgcagggcaaagagcttaactggctaactgttttaccagctaatctctagcttaattttcttcgtctccaggggaaccactcgataaatgcgtgatgtctaatttggaaaagggaaaatggttacaaaacacagcaaaaaggtgacctgtgttgattccgttgcatgcatgcacctaaagataggttatcactaccgtgtggcacctatttttactgcatccatgaccctggtgacctggccaattaattcgccagagacgacgcatgagtaattgtctgcttgacaggcagcatttctacgatgtatattactccgtacgagattgcatcacgatttggccggtcgatcgccatgcaagtcgaggctacggccaatggaagttcgacatcacaaccattcgtgattccaaggtaccttacagatactctaggattaattaaatagacattcccgtcacgtcgacaagcgctccaagacaacacacaaaattgcccttcatttgtttcgttgtgacgaggttcatgataagctggaagcacgcaaaaacatttttatacggccatgatggcgagcgaggacaggaaaacggtggaatttctctgctgccgcgcgctaaaaaccaattgagccgcgcacctgatggtttcgtgcacgcagcttcctgaaatcaacgtacaacaactacgcagtgccctttcgttctacaggaggtatatatgcatgcgatgctcaccgtgtacacctgaaggctctcacatggtttggcacttcggttttgagtttggacgtggactgcgttgtcgcgagctagcagaggggacagcggccgtaacatggccagccagcacagcacagcacagcactgcactgcaccgcacagcagctagcgcaccacggcgatcgagttggtgccaaccgtgtgcgacgcgacacgtacgtgcgaacgcgcgcgtgctcgtgctgagctcggtctcggtctcgacggatcggtcgatctcacgtgtgcgccctgaacaaccagcagccgcagcctgcataccctgccttgcctttgcgcccaagtgggttcgtgctgggcttcaggcacaggggcgcgggcaataatttggcgtgcttagatgtcgtaacgtgtcaagaatctcagctcgcacgggaagagggctatcaagtgcacccttgcgttattgaatttggcctaggttgcctaaaaacgattcttttctctcttggagcgtgcactgtgagcacatgcatggttgcaacttgcatataccaaggcccagcaatgaaagattatctctctattatatactaaaagtccataaaacttcctacaaacattctcaagccgccacgtgggagtcctataaacaatcttaaaacgtcacgtgtcactttaataaacaactggacccactatttttaattagtattagaaaattgttttttcacctccctctcctatccccacgggctcacatccaagcagcccccgcacgtccatacgaacgtacaaacgtacgtaacgaaactacctacacactactcattggaaaaacaaataaaaaactattcattgaaaaaaaaaatgaaaaagaacatatatatgtatgcacatctgcacccacgcgcggttggaaaaggagcgatcaatccttacccctttattttcttcggttgttcactatctaaaattttataaaatatgtgatgtatcttatctataaaaaatattgcatccatattacctatatattttaattacaaaaagttatcatgtggacatatagtcttaataactatatatgtgtgttttaataactgacaactaagtaatctcctaagccgccaagtacattgttgaccaattaaatatggttgatcaattattttatactattcatttatcttagcaataaattatttatgtatgtgcatacgtattgtttttattttagataccttgatgatcataattataggccattaaacttcctataaatgcttctagacttctagcccgttacgtggcaccctataaacactttcgagt

SEQ ID NO: 61507 - DNA, 7234 bp, Oryza sativa
  unsure (1)..(7234): unsure at all n locations
tttggaatagggctcaacgttggcgttgtgatttcgttgatgattccgctattcgtaacaatggcgaatccagagcagaaatgaccctatgtcagaaacatatcacatactcgtatgcctatatttccaaaagataagggattatggaaggatgacatattcaagtcccaaaatacaaggtgtggtttgactcgtggtcttcaacatccaacttttgattgtcattttctgtcatggtaccaccttcatcctaatttgacattctctaagtagaaggcaccaataccaagaaaagtgtgaatgacttatattttaaatattggatgtcattgcaccattagaaattaatcttgttggttgcatgtaacacattcaatgatgcacattactcacattactctttgtacaaataaacaaaatgacacttgtttaatgatgatcattttggaaagaccccagaaaccttatgggatgatcaaagtgggatggagggatcatattattatccatattgaaaccaacttcacatgtaaaagaacatcaaaatatgaatccaacaagaccgtatttatatcagtaaacctacacattatatattattagactagtggttagaaaaatttataaaattcaaatcttatacgtgcgtaccttacagttcgagatgtcgaggtggagggagtaactatcttaggtcattattacacaagatgtaatgaagtcacttgtttatattgattcctagataatcatcataatctataccacttttttttcaaaaaaaaaaaagtaatggtggtagcagtgaccaccacgccatcaataacatgtgatttctcatatatacatcttaaagttttctaaaccattttaaaagaaggtaataatgaaaccatcttaaaagaaggtaataatggtgacagtaaatctgttatcaccgtcccatcaataacatgtgataacatgtggtttctcatatgtactccttgaagttaaataaagaaatgagtaataggagtaggttttgttttaactagagagagaagtgggtagctacatcaaaatttgaacggtaggatttgattttaggatgaatttaaggttttttttcaatctcttttcataattattaagataagtaaaagaattcataattttattattaaaaatcaaagaacaaaattattgtatatcgactaatatataatgatgtagccatatttattttctccacgtgaacatgtaatgccatatgattctcttttaatcccgtaacagtgtaaaagcattctgctaggcaagttttaatatagctaatgtataatatttaatcattgtcacaaatgtagcaacctacgacatgtaaaatataaccgaaactgtctaaactgtcactattattatttgatctattattatctgatgagtctacaaacaatctatcccgagaagataaataaatcttcatccttacccttaatttccttaaatctcaagtgcatgtgctacctacgtatcaaaatatatgatgttatatgagatgtacaaagtatgtatgtgcttttttttttagataatgatgtatgtgcttctttaaaaggaagtaatagtaataataagtgatgaatctacaaccactcctaccaccaactccctacctttttagaaagtaaaatgacacgtaggtctagacgatccacgtgttaaccagccccaccatcattttctacatacataatctcttatttttttatacatttgttattgacatgtaggcagtagcatgtggcctgtatgaggcgggggaggggggnggngangnggacgggnnnnnnngnnnacatgccgcncngngngacccnggggcctacatgtcaataataaatgtataaaagaataagagattatgtgtgtagaaaatgatggtaataacggcttaatgattatttatttaattaatgggataagtacattttactctccttaactcttcgttttgtctaaaatgcaccctcgatcttcaaaatcgggtatttaacacacttaaacttttaataccgttcacttcaccccccccccctcatacagggccacatgtcactgcctacacctcttcttctacctccatctcctctcccctttctcttctctctctatatatatccttcttcttgacagccaaacctccatgcgctagctgctgctgcgcctctctctctatatccttcttcttggacggccaaacctccatgcgctagtagcgcctctcctcagtcaccaccgacctcggtcactggttattcctcgccgacccccactactatagctcgtcggtgaccaccctgagctcgccctgtgtgttgcagctcacttcccagatatcgacgaggagagcggcgtcgcggtagacgcactgtagtggtagcccccttgagctcgacgaggagagcggcaacggcagcctccccgagttcactgaactggactaagagagcatagggcaactcaggctctccagcggcatcggcgagctcaccccaagtccccatgcacgtggatctggcaagctctggccctcttgcgtggttgatgcctcaggaccccaaatccacctcaaggaggcaagtcgatttgtcgtcgcccggatctacgtggatctaccgtcactccatcgtccttgtcagtggcgagagagcggagggagaaaggagaggggtgatgcgacgacaaatggggacggggacagatcgagcagctcactagtaaatcggtttccccatcaagttagttcgtcaccgactaccgcggcgtcgccaaccgtcaagtagatctcaagctctgtctccctctccgacgatctctaccccatccattattgagcggcaccacaaaggtcgtcgaggtggtggtgcccgatggatgagagaagaagtagaaaggagagggtggaagatgggtgtcccctacatgcccaaccttttttttatgtgtcaattggaccaccacgttagttgcatataggcaaagccagcatggtttgaaaaaaaaggttatttattggtattgatagttaggaggtgtaatatacccagttttatagtttgggggtgtgatttaaacaaagacaagagttgaggagggtgtgatttatcggcagtgtcatgttttttcggtgtcctctaaccaattacacaggttttgatgtactgtagtaaattttgtctttaaacaaatatatgagttgagaagggtaaaatggacttatcctttaattaaaatttgagtaaatttcacaaaacaacaggtattctgatcaaactatcgcaaaactatatatttaaggcgttatatcacaactacagatttaataccatatttatcacaaaactacatatttaaggttaagtatcacaaaactgtatatttaaatctttttttacggggaactgcatatttaaaattgaagttatcacaaaactatatcttttagagtttaaacccctagcaccattattatgctagagctataaacattattgttttatgaccaaattggttctaaacatatagttttgtgataatttagttaccaaacatacagttttgtgacaattcatcttaaacgtattctgcgataaatttagtgttaaatctgtagttttgtaatagtttagtatagtacatgtagctcttaaaattttgttgcaatcgcacgtgcagtaggctagtaccagcaaagcaatacggtgcgcatcacagcacagcacagggcaagggaccgcagaggcgcaaaccgtttgcttctaactaccgcggggccaacgaacttttcctctccttcccgcatcctctccacctctcgtcctccccctcccctccgctcatcgtgccctgctccgctgagcacgccgcagctccggatctgtggagccggggatcaggcaggcggaagcgaggtcgtgtcttggcacttctgtggctggttctttcgtagctctagagaattttggtggatagagcgcctcgatcggagaattcgggggggacgagatggatggtctgcctgcggagctgtgcatcaagatcttccacctcctggatcaccaatctctcgcctctgctccccaaggtgccctttttttgtctgctctttttactgccttgtttctcacgattcttagtgcatcattcttgccactgtcgcattcagacgtaagcgctagcaaattgcatcatggtgcctcttcttatcttatgctaatggttcgcagtttaacttaaatcatggccttaacaagtgctgttgcaaaattcagtgtgcaggaagtggaacacgttgacctccgacgacgagctgtggcgcaggctgttcaaggacaggtggggagcggatgctgcagcgttctacgcgccagagggctccaggtcatggaaggacgtcttcattgtgcaggatcgatgcgaccgatatgggctgtaagttgccatcgaattcactcgcctatcatcccgctcgagctgtacttcttatcttggcatgcctactgtcacggtgtcccctgatattcagacgtggcacacattctgtagtacactgcaacaatgtcactctgaagtactcctatatgaactctgaatactgtaagttacgcctcattgatctttccaggggtgtcaggattatcagagaaggaagcgattactacctgatttaccagggtgagatccagaggtacttggggtcgagacagcatgtgagctgcgatagcaaggacgctcctgcgcagagtagcgaggacgagcagcggcagatatccgatcggatcttgttcttccttggagacctggaggctgcatgcgcagatgccaaacgtgtgaaggtgcgacgaccgtgatatccaggaacagcgctgtatgacattgtagttgttatttttgcacatatttcgtgcacatatgttgtatgtaaaatcttcaatccattatccgtagcgtttcacattcatcttatgtatttcctcattttaaaagtaaaaagtttgtaaatctgcgctaatcgccttttacttttaggcttttagcaaagcacgtgtagcatcatctggtaatttttccgccgtaagtaaatgtaatagtcatttagctgcaaatgcatatatgcttaccacgacaaatggatatgtcccatcatcttttctaatctttataaaatgtaatcataaactcgtcgttcgagattaaaaaggcaactggcctctcctgtcagctaaggatgttttacgcaaggaacatgagtactcaaatgtcaattacgagtcaataataacatgaagttcaactggttaactgtgttactgcagctcatgggtgacagtgcgttactgattgaagcctccgtcgaacgttgagtcaacacttgatagcagctcttgccatttccaacgctccctcatacgtcttattgccgccaatgaagccgctcatatgaacaaagacacatcctggaatgccaatatcgtttgacagttcatcatctctcaagcccctccacttttccggcagaggctttcggctctcaaatctatccggagcaacgccaacagcttgtactctccaacttttgctcctctcatcctgcaattacgttatccaaatcagcatacgcagacatcaatacttttagcatgctactggccaacgctagaaagagagtttattctatgatcagaagttcagaactacaattttaagtgcataaacaagggcccttttccttctttcttagattgaataaaacggtgtttgacgagagtaagacaaaacaaggtggaaatcagcaagaccaccctaagggttaatgacaaaatggaggaaacatggcatagtataaatgattgcacttaaagtaaaatttactttcaaggctgtgaaacgtaaatccaaaagaaaactgagtctctgctagagcttcaagctacatgctacttctcgatttcagcttatgcaactagaactacatcaagatattcatatcataggctgagaaaggcaacactttcacctggtacaacacatacttcgtgaggggatcaatcttcagctcctcttcaagctcaaacagatgaagtttccactgcaatgataataagagattctcaaattacatgcttggaatgattcaatatgttagtcaattcagcagggtattcctgaaaaaagatcttactgggcagaatctatccaaaaccataatttcttcacttggatcaacctttcctcttgacaacaaacactccaagacaatagatctcgcaggtaaccatgacttaacatgaaagcgaacactctggaagtgaaggtgcaaaatattatcatatacaaagagatgaatggcgacacactaaaaacaaagttctcatgcagtaaactaacgtatcacatacagagactattatacctccataaattcacttccagcaagcatcattgcctgttgaaatgcagcattttccttctcaggtgactggtctggatcggtccagtctggattaagacgcccaacgcgtgaagacaagtgtgtgttgttcacatactttgggggttggtctgtgtcatattgattgattccgttgtcgactgcatcaagcgcctgtcacatgacaaaagttattgtttctctgggatcatgcagaaatattggggtagatgcataaacacataaattaataacagtgtataaaagatgtcttaagaaaaaatgatgtgaattgatgctttatagattgaagctttctactccttagtataacggttaaacttaaacaaaaaaaattacttgcattcaagtatatctgatgcctctacacccttctctgctaactttataattggcaccaaacgcagactggatagtaatcatattttgccacatacagtgcatgcagcctatcaagctaattcaaaagtagatcgtgaaaagcccatcaaggtaatgcaaaagtacggatgaaacattgaagcattaaccttgtagtaggcagtcgctaagctatgatatttgttagttggttccatgctcctaagataaaacaaaggatctaatatgtgcctagcaaatatttcttgctgtatgtctgctagtggatgtataatggagctgcaatttatcaactattctattccccttaagggcttgttcggataatcccaccaattaacccacgaacaaggggat

SEQ ID NO: 61508 - DNA, 731 bp, Oryza sativa
ttgacattttcagtcatagaatcttaccaaatagatagatttgttggacattttgacagatgttcatggactaagcctagtaagctacctacaatggataccaaagaatcttgtctggtaatttggtttgttaacattgaccaattcatgacattaaacggaaattatttttcaaaaaaaaaaaaagaacagtgatgaatcttgatcaatcaaatctaaagaatgggactggggagagattcaaccccacagtatttttttttagtacgagggaggaagtgagcacaccaaccgtgttcgcagctcactcaaatttgatataatgaaatcctgtttttgctaaatatctagtatgttagaaacatgttattggcaactttgaagtagaacaggtgtacaacttacagatatactgggttatctgggtcgtcttttttagtaaaaccagatttaattgttgaactaattttttgcttaggtgttggcctaaaatgctttcacagaattatatccatagcgattaacatcgtggtttgtcctggcaggaagctggaacagaaatcgaacccatgggtgacctcaacactgaagctgagaaaaaactaggccggcttgttaaggagaagtatgcaaattcagcctgtagttacttattcgcttcttttcaaaagaaaatgtggtttgacaacttgctacattgtctgtaggtatggaacagaatttttcatcct

SEQ ID NO: 61509 - DNA, 2782 bp, Oryza sativa
  unsure (1)..(2782): unsure at all n locations
gaaaccccaacttatcgtgtgtattcattcctatttgcaattcagattgcttttatcttgttcttgcttgtttcttcgatttgcttgtaggaatagggttgatcagcaccggcaagatcaatacccacggagaggtgtatcgatcgcaaaggcgcaacacaacaacgtcttgtacggttgtagtcgggtcgtcaacgtttctcccaaatcgtagttatcatcaactcaccgaaaaatcgggccaacaacagccttgagtgtcgagtggaactcagggttaatcacctattcctgcaagcaaatcgaagaaacaagcaagaacaagataaaagcaatctgaattgcaaataggaatgaatacacacgataagttggggtttcgaatacaagcagacggacgatctagccgacacgcgcgctacaaggaagtagcaatggctaaactttcatctaaacaaaacccaagcaaccctgaaggggtacctagctacttataggggtgggagaatgaccaaganggtcatagggtcgtgctccaccagattgtggtgcaccccacatgggccccacttgggccagggtcccaaacgaagttacaaggccaaaggcccatgacaggtgacgcagaaccttgtttcttaatatgcgaatggcttggatggaatttggcgatgaggctagatccgttggaaagaggactccgagagctttccatcaagtactcacgggccgaaaacggaggtcgtacgcagattcgggggccgtttgaattcagcagtgtagcaggtggccgaatttgattccagcacttggaggacttgatcttgatatcatcttgttcttccatgatgtgagcaatggttgtatctgtagtagccatggtcactgatggaaatcaggtggcacatgctttattgggggttaacgtcttactaatattttacatataaatagttgcttgtgcaaccctaaataattcttcatccatcatcattttctgtccatccaccgccactaccattgttgccaccacctccgccatccccatcatccaacctcaatctcacacattattagctttatcatcgccagccttttttctaccttctccatttctatttgagtttttctgaccatatcttgccatttttgcatcggcttggcttactatccttctacatgtatctatggcgagggtgatcacaattcacacacatcctcagttttcgccattgccgccgctgcaacatgagagatttggtcaatataattttagcaagtagatcactatccttttgtggttttgtttatttgggaaggtaggtatggtgtcacgccccaattttcgttcgggattgaaatcatcgacaaggcctcgatatcacacatgggtaccattcgtcctcgctagaagatgaatatcagaggacgaggatgaagaactagatgaagaacacatggtggcggttgtggtttcttgtttggttgtagagtagatgaatggaaggtctttgtacatggtgttggttgtgcgattctttcaactatgaacataggagatgctagcggcatgatgcttgatgcatagtagtactactgttctatctcgagagtgatacggcaacggtctctgtatagacaacactaaaactaggactaggagtagtatattagtatgcccttcgtccaaaaaaaatcacaggataaatcacataacaagtttagccttggattgcttaccaaaatttttggcaagagtggctaggctagtgtttggttgctaccatagagtattcctccatggactttgccaaaatcaatcaaaccaaaaaactggcaacgccaaaattttgggtacaaacccaataagttacaaaatttttggcagcaccaatattttggtatggttgagtttggcaaagagccaaacacaccgtatgatttaatatgacgtcttccctctttgaattgggttctaacacaatttgatttgtagctctaaactgaaaagtgtgtgtttggtgttttctgttcctatctatccagtcaactaagaacgtgcatattttgtaatgcagcaattggatggagcaatggaggacacaccaatcaaaaatagcatgccaatcgtagagatgcatgaggtacctgctgaggctgaacccacagttgaggacatgcaggaggcgctcttccagaagcagaaggaagaacagctccagctgcagctgtttcaacaggaagaggaactggaagaccaacagcctcaggtggttcgctctctttcatttaatttgatgcattcatttcttgatgatcatccaattctcatgcttcatcttaccatcaactggttgctgggggtctaatcgtgttatctctttttttagtaaaagctctctatatgttgaaatgatcacaactatcataataaacattttggttttttagttctaatatattgtgcatatttgtagttctagtaactatttttggtatcagagagtttcttttataatacattgtgatgtgtagttagtaaatacatatgtaatattgcataatcatcaaaattttatatttccattgcaccaaaattgacccctcttaaggtctgaaagttttcaaaacgaaaatcaaatgatccgaatcgaattgcctcaacttgataatctgcttccacccacccaactctgtgtgtgtcacacacacacacacaaaaacaaacaaacaatgtgcccacacaacaccgaacggcaacacgtgtcaacacatacaaaca

SEQ ID NO: 61510 - DNA, 7701 bp, Oryza sativa
gaccaccacatacaaccaccacagtcgtgccggctaaatatgaggaagaagaggaagaatggaggaggggaggagatagagaagggagaggatgaggtggaggaagtggggtctactgatatgtgggtcccactatttttaaatcttattatttgactgacatgtggacccacatattttgttttattttttaaattgttaaatttcgcttcatgtgccacatcaatgtcacgttagatgaagatcgagtcaaattagtcacgtagatgctatgtcagctgaaaccgtcatgggacttatattacattggttttgatagttgaagtacccgttgtatctggtattgtggtttaaggattaaaatcgaactcgctctcaggttaaaggacctattgtgaacttattccgatcctgagtatgttgcacgagaataactatattgggccttctctttctcggccggcgggatggcccgtctatccatccaccgttggatcatctgtcggctgcggctcgcgttgaaggcttttggcctactagcgttgtgtgctgttgctgccgtgtgccgcttgcagatgcgagagctgacagtttggctgcagtacgtgatgctaccttctctttttctcctcaaatgcctccatgtatggtcgattctcgttctacccctgtcggtctctacttcgtttccatgtcgattgcaacatctgaagtaatcgtttcgatgttcgttttggtctgcggtccatgtcaaatccaaatccgaaaagaaaaggtacaagagatggtatatctttatccgaacttttctccgtgcccttcttttgttcctcaccatgtgcaaaatgttcccgtatataaggccatactcggaacgggaatgccagaaggagaacgtgacacgtagctgaaaggctcgctcgcgagtggacgactggacggatcacggatgccatcaacgtgcgtttccggctcggaggcgttggcatacatgagtggagagctatggagcgacaggctcacatcgcgccacgacgccaggttacgcaccgttgctagttgctaccatcgccatcctccgtacgtacaacacggctcgttttaatttcgtaatctgcttgctgttcctgagctagcttccgcttcgttcgggttagccggtggccgcctcaaacgtaagcggagcgatcagatccattggcagcgcccggttaacaccgctcgacagaacgagagggagccaaacgcatggaggagcctctgcgcgttgcttctgacttcttcagctgttggggtcagcgtctaagcgagcacttgtccacgtgatatcgcacacctgggagggtcttgtaccacgcgcgcgcgggccacaggtcgcatacttgcatgccagcgaagcgagagattctttgctctgtttcgtcaacccgtggacaggtcacaggtggacgtgtgatgctgcggacgttgttctcagaaccaaaaagaggaacaccgaaacgaaacaaaagtatcaacaatagatgaacagtggaaatatgctaagtttgtttagttcgcgaaaagaaaatctttaggtgtcacatcagacatttgattggatgtctgatgaaattttcggacacgaatgaaaaaactaatttaatagctcgcctgaaaatcacgagacgaatttattaagtctaattaatccatcattagcacatgtggtttactgcagcacttatgactaatcatgaactaattggtctcaaaagattcgtattgtgattttcattcaaattgtgcaattagttttttattttatctatatttaatgctctatgcatgtgtcaaagatttgatgtgatgttttgaaaaaaaaattagaaggcctaatggaactcaccaatcacaagatcaaagcgacattttccacatacagccgccgtcgggcaccggggcagtacagcgagagaaaaaaaatccgtcgtatttttttcacgaaataaataacttgaggggaacaagttaaattgagtataccagagttgaaattaagagcggcacaaggaaattagaaaatcacgagaattaggatgtcatcggtcgcccacccatgtgctgcacaggcttatatatttgtactttaaaaggtttaatcatgccgtaaatatgttaggtgttttttttataacactcagttaaattataaaaaaatctagtacaacttgctaattactatatcacaaaagaaaaaagtacgaactacccccgaactagcgcggtcgtccgaattaccccctgaaccacaagaccggacattcttcaccccaactatgtaaaccggacgaattaccctcctcggctcaatccacggtggtttttatctacgtgtgtacgcgtggcagtccagtcagcattctatttataaaaaaaaaaagtgggacccacatgtcatactcttcctctctcttctctctctcaatctgtctcactcttcctttatctctctctctctctcacaggtgggttggcagcagcgggggacacggagcagcgggggacccacatgtcatactcttcctctctctcttcctttaccccccctctctctggacacagccacacatgaggcagctggtgggtgcggaggcgaccacgggcgggtggcggtcgaggagtcgaggccggcgacaggcgggggtggagaaggcagcgggtggcgggtgggcgtgaggctggcgacaggcgggggcggaggtggcagcgagcggcgggcaagcgcggcgaggagccaaggccggaggtggcggcatacggcggaagcaaggctcgacgttgatgccggggaggctgctccgccttgccgcctgcacgaacgaggtccacatccgtcgcgctcttcctcccgcccttgggcccggttcgctgtgctggcggcggcgcatcgccggtggacgaggataacgtgcgacagacggggaacgaggcgcggcgcgacggctctattaacaaccaaatttggtaatctgagtatcggagatgaagataagatcaaagcggaattcaagatggaaatcgttccggaaatatagcaaggatcggctaaagtccgaatcggctgagaccaggatcggcagagtccgagttggacaaggttagccgatcaagccgataccgacaatatgacgtggtacgcgttgtcgggttgagttaatgtgcttcatgaggattgccatgcatggatagagtcctgagaaggcaattgtatctattaattaggatattttatgtaattttcttagagatatatttgggcaaaagtctgccacaaagacttatggtatcttagagtttgttagagataagagtcgtgtccgatatggacatattttgtaatctcggttataaatagaccccgaaccccatgtaatacaacaacacacgttcaatacaatctcggtgcatcgccatccttttacttttgttttgtttcgacgagttcttgctttcgggtagagctgcattggtttcgatcttcaactagaggtaaaacttgttatggcggcttgcgttctcgggattagtgcttccatctttatgatactctaatcttgcttatgtaattcgtcgagttatcatatattctatataatctttggcaatattgttatctaacctccagtcggctaacatctgtcgctataaggcagccgattaggttaaataccaatgttgacttaaattatatagaatatccaccactctatgaaacatccaacggcttgattgtctagatattgtccttcttttcatacttatagctgcatcagttgagtttgaccttataagtcgtgattagaatctcaatatctagcctgcttttggttgccgattagggtagcatcggggtttcagccgattttatctgatttaactacttttattttatatgcttgattgacatgttaagtatgccttttatattaagatcttgttgcattcaagtatagtaggcttttgtttagtatattctacttgctttaatatcttaatatagagtaatatcggagtattagccggtacatgctagatctatctgatcggctatgctatgaacatatatagtcttgttgttaatatatatttcgataagtgatttatactgtctcgacatggcgaccgatctatcccaatcacttgattcaagtatatatcgacataaagattatatatcgttaatatctacagctgatcgggtagatttagttctttcttgttcattcatgattgccgatcgattcacatatgacatcggctcagagataaatgatacgtcatcggcaactagccgatcagctatcgtttatggatttaaccgcgttctctttgtttttatttcttgttgattgcaggatcaaatcaactggcatgctcacacacttaaaggcaagcttttggacctgcactggagttaagcagatctctcaggcctcgtgttttcacatcaacaggctcggaggaggagccgcggcccctgcgctcctacgacgagaaggaggagcccgccgcccacagcgcttgcccgctcgcccggtcgtcctccgcctccgtcgccggccgctgtcgtcctcacctcaccgccgccacgctcctccaccacctccgactccgtctccgcgccaacgtccacgctgtccgcgccgtcctcgccgaccacccgtccccgcgccgtcctcgccgaccgcccgcgcccaccgcccgtggccccgtcctcgccgtgcgcgctgtgcgaaagagagaatagagagaggggaagaaagtatgacaggtgggtcccacgttttttattaaataaaatgctgactggactgccacgcgtacgctacgtagaccaaaaccaccgtggattgggtcgaggagggtaattcgtccggtttgcatagttgggggtaaagaatgttcggttttgttgttcaggggggtaattcggacgaccgcgatagtttgtggaggtaattcttactttttcctttcagaaataaattaataaaacactaaatctagagtgatatggattaatatttattatactttacaattattaaatataggaaaactgaagagttcataatatttacaattgcatattgtatctaacgtgagttatcaatatgatctacaattacgataatacgaactatctaatcaacaactagatttttctaattagcgtgggagctccactcgagtgcaaaaataataaaggtataaataaattttgtaataaacatgagaaattttgaacgatacgtatcatttagatgatacacatggaagaaatgtagcattttagtaacccgtggacggtccctttttaaagcaagaaatcgttaaaaacaccgggtaagcgcctataggagaacgatgaagtcattaggaccgaacatggatggggcaagttcctcgattttgtgataacttctacttctttataaaatgtgtaattttacgatactttgcctcaatacttcatttgataaattagtcgctaactatatagttttgtgataaaaacatcttaaatatatagttcttccgatagctaaacaagttttgatgctaccaatgtattggtggagatttctattgtttggcaagttttaaaatcaacccaatcaaacaagtactatttcgtgtaggataagatttgacaccaaaccaaaatagtcctaacacccgggtgcaactagagtaaatgctcccaccatttgtcttataatttacaatccactgatagaatttaaaaattaaatatttttaaatttaaagttgattataacttctcccgtcgtaatttacatctcgcattaattttttaatatctaaatacacatatactcccaccatattataatattataagttgttttgaatttttttcattcaaacttatttagatttgaccaagtttatataaagatttaataacatcttcgacctcaaattagtttcattaaatatatccttaaataaataatatgtttattttctattaaaaatattactatatttttataaatatagttaaacttaaaattattgattataaagaaaatcaaatgatttaaaaataaaatagatggagtacatattaataataggccaacggataacaaccctgaccaggcagccggcctgtcaccgggtgggtcccagggagaatgtgaactaatactaggtgggaccgaccaggccggtggcacagtggggtagtgttgaccgctctacacccttcgttccataaaaaactaatttctagaaataaatctagataaaatatttgtccagattcattctcagatattatcttttttttcttttcttggccggagagagtactcggcaaagcttccgggagtgtgggttcccaggagggaagtatgggcccacgaatgttgttttggctacaatgaacttgttggcagttggctgaggccttgttggttgccttggggaagcaatttcgttcgaaacattcggatttgttcggatgtttgtctgttggattttctgcaactattgtttcccaagctaattaggaccactacttatcccatactgtggattactacatttgtcccaaaatagttataattctaaattatttactatataataagattttaaaagaaaaaaaaaatgatgtccctcattaaattgtgtatagataaaagtgagagagtaattatttagcatatattaagattttagaagaaagaccaaatggtgtatagataagaattgctgagtgagagaaagaaattagaatgataagtgattgttgagataattagtacactattgtgataattattttgagacaaaattaaataaaaaatacaattattatgtgcctgagatagtactatttaactcatgtttagtagtagtatcttgctaccttgctttattctcttttctcatctaataggttgacatatcaagttttaatctatgtgatatattatttaatgctacgaaaatcattgtatgagaaatactgggaccacttgaccagagagcacgttttaattataggacgtgattggtttgacagtcctctaaaataaacttcgactaactctttttaattaaacttcttttaacttcaattaagtttataaaaggactgtttaacacatttttcgcgaacgtaaaaagattgcacgtcaatatattagaagaaaaagaatttttgttacacaacgtaataagcaagaccggtttatgccagggaagggagaaaaaaacaaaacaaaagttgcagcaaggaaaaggagaaaattttactacgacggctaaatgcaactccgatcagcaggaagggggcagagccacactacactcacatgaaatcccaaagactttttaccacaataaaaaatgttcaagactagatttaacgaaactaatttggtattcaaggcataggtacatttttctataaatattgtcaagcttaaacaagttataaaaaaatttataatatgaaacgaacagggtagcttcccatgcatacgtgctcaggctaaactatgatactctagaatttatttttgaaaactatttatttatgcttacataagagtaaattttagaaaaactacaactttagtgataaaactatcagtatactacaacattagcgacatgttt

SEQ ID NO: 61511 - DNA, 8077 bp, Oryza sativa
ccccgccacaccacaaatatacaccgttgcgatgatgcatatatgcatatacacgaggaagatggccaaaggaggggagagggctactcccagactcacagtctctctctcttgcgcgcgcacacacactgctctcctagacttaacccaaaccatgtatgtcgccacctactggtccaatggaccacggcaccgtccggtagaggctgcccaaaaataaagaagcagggaggggaggcttaaggattgttttgccagcatctgtgctttatccaataatccagtttgcctttgggtgcatatgcatggtagagctaggtagtagtagtacttgtattattctcctctccccatatctttgacaaattccagttgccgggcatactgctcatgcatgattaatgtttttcctttccctttttttctctttttgtttttttgcgtagctaggctcgatctactgcacggttccaacatatattgctgcaggtacttcttgtgacttgtttagtaaaaagaattgcgtaaatatcatttgtttcattgtaactaattttatcattgaaggtatatatatttgcgcaaactatctaaataagatacatggttaaatatatgaccaaaagtcaataggatcgtatatttaaaaacagaagtagtaataaagaaggctaactttgcacgacaaagaaaattgcaaaatgatccccatttatagaaaaatccattgagcttgtgctctcaagcttactaataatgtaatcaacaaaacctgtgaattaattaagtcatgcaatagattggcactggtagatatttcaagagtaatattcagcaagggaccacatgcatatgatgcacagaattgaaatgacatctcaatgtacttgtgcatcagcaagggaccatatgatgtttgccctagctagttcacaaatcctgtgtctattcccggtcgtttctttattttttttatttgatgcattttaagtgggaaattcattttaatattttttcctcatgttttcttcgtgttcccacatcacaccatcgtcctagaaaccgtcccaacctttgacatcctttaagccacccactggtcatggtggaggcaattaacaggaggccagacatcctctgccggccaatggccaccttctttcaatctccaccagttggataagagttcgcaccacctctagcagcaatggtcgtccgaggtcgtcaacacatcattgcaggggagccgttggcttcctcaagtagccccatgagcacactgtcactatgatccactgtgccagatcctaccggcagagacgagaatgcgatcagggtggtggtcaagctaggaggataagtcggtagacacggggatatgggtagcgtggtaccaacaatggagcgtggtatgcgtatgctaccgtgctcatcacttgggggacgacaccgccccgatgaactggataccccaggtgcatttctgtcttttcatttgcacatgtgccttctgcgccctcatccattcaaaaaaatataaaataatggggagggcgatctctaccatgaaatcaattactacatctcaaagtctccctccaaaagttaaatatattgtgaggtgctaactaaaattaaccacacaatgatgatgtactttagcaaaatttgctagaaagaacggtatagctcttggcaacaaggatcattaaatctctcataaaaataatattcattttctttccgttaatttcttttttatcatctctctccagacaattcattttttttacaacagcaccggagagaaagtttaaatgaattacactgcaaatgatatccaaattaactatccatatcgtctataatcagttaactgaaacaacatatgatgatttgttagcatgcccattatatataagactttgcaatgtcacgactagataaaccatggaaaatccacaacttaaaacattctaacttgtagttagaacatttattaacattacccgagctaccatcatgttagatagaatcctttatataccactgaaaatcagtctgatcccttatataccactgaaaattggttcatcccctatatgccattggtccaaaattgcgcaccctatcatgcaacttccatcagttgactgtgttgaccgttaactctaaagtaaaaaagacacatttgcccttcttgagttgttaggcatgtcctatactcagaaaggcaaatacgtcttttttacttgagagttaacagtcaacccacagacaacagacgagagtggcataagagagtgcgcaaatttggtccaatgacatataaggacatagccaattttcagtggcatataagagattctctcgtcatgttacagtgtgcaccaacaagattgaacttgtcaagttaaaattatttttaactagtgttttaaaacatttttaagaaaacttttatacgtgtacattctccctagcaaaagaacttgtgaccgagatttttcattaaaattttattctgattgttagcgtagtgatggggatgtatatatggtttaaccctgtggacctatgttcgatttttgacatgcccacactttatttttgattatttgagatgcactttcaagtgtgtagttgtaggtgtgtatggttttaacccagatgtaggtcccgctcaattctcaacaagttcactctccgtccttaattattcttgtccgggtagcttttttttataatggcgaggtacattaattcaaaaaatgcaaaccactattatattacttgtgtacaatgataggcatttttcgcaagctctactttattggactatagctcatatggtactcatcaactcaggttttcagtgatttacaagttgtatgcaggtctttttcattctttgttgtagaacatgcatgtgatcgaacaggctctttcagagaggagagagagagagagagagggagagaggggggggggggagagctggctgagatgacctatcctatggaagacactgaacatcctaggtaaggagccactgacaagcagccagagagctacgtgtcgcccgtcctgtggcccgccttcatgtcgctggaaaccatcaaactgaagccgtcggtttcctccttgtcctttgctcgccggccgatccgtccgtctctctcctctctcctcgccctcaatcaatggccagctccggcatctccggatcgatggacggggagagcgctggcgagtgcgaggatgctatgcatgcacgctgtgtcgttggcgcgcattcacctcggggtccccgcacgcgcgggggggttgcaacaacgcattacgcatcgcctcgcgcgagcgagagacggccggcgagcgagcgaacgcgccgtacgtaccccgggttttcctcgccgatccatcgtacgccgcgcgcccgcgcgctaacctagctatactagctccgccccgccgcgccggcgcctcagtctcctcctgactcctgtcacgtccggcccgcgccgcgccgcgcgcccgtccgcgcgtagtacagttgatgtacataggcaagggaattaaagcgcgttcgatctggctggccgcgacggacgattccctccagcgccagaacgggaaaaacactcaactactcaagtagccctccctcccctgtggcatcaatgcggcgcatatctttcgcttagatctcccctgcatcactcacacatccaccactgactgggccggcttggctggctagccacgccacgccaccatacacaaaccgacccacggcacaggttcgatcaccaccccgaaagtgtcaatattccttctcgaaacgcagggagagcatgctccagtcgtacgtttccattgccggccatgctagcaagaaaagctttgtggtggctacgccacggagggaaggagagatcagacattagatcgttgcacaaactgggaaaggctagatcgcagagagagagagagggagagatcgcccaacgatcggttgccattaatttgctgggtgtagtagtgacatctcacagcgtcgatcgtctgatggtgttatcagataaaaagtatccaaaatgatcggcgattatacatgcaagatctagcaagctggggcaatttaatctgtagatcgaactggccttgagccccagaggcaatttaagttggtcgtcctatccgtatgtctcgtatatacataccacctccgtctcataaaaattgaatttctaccttttaacttctgtaccataaaaattgtatttctactaatatgggacccagtaaactaattacattttcttgtaatcttccttccttctatcccatctctaacccattatctcaacatttcttttaatcaagtttatatatggaatatgtgcatgtattgtatttattaaataaggttattgtagtcatttgcctatcctcctagtatgtccttaattctttagaaatttattttttatgggacagaggtagtacgtcgtatggacctcaggataggtgttacacgtacaggtgacttacttgcagggtcatcatggacataagcatccttgcttttggtagtggaagatgttcatgcagctagctctactggcagctagcgcatgtactcatacgtaccagctggttggctagctgaggtacgtatgtgacgggaagggccaaatcccacattttcagggcaggttttgcgcaacatggcaggtgtacgtgatatattctcctcaggctgtgactttctatagactgtatatagcagtataggctgtagatatatacgcataccaggtccctttgtgttaagtactcctagctagctatgcagatcgatgccgaccagctacactccgtaaagaaagtcttgatttgattgaggtaaagtcatggcactagaatactggatagcgatacgtagatagtatatccgtatacatgcctcgatctatatactagtctctccatttcagattataattcgttttgaatttggtcaaagtcaaacaacttcaactttgataaagtttgtagacaaatatagtaacatttacaataaattagtttcattaaatctataactgaatatattttctttatatgtttgtcttgggttaaaaatgttactattttttcttttataaacttgatcaaacttaggttgtgtttagttcacactgaagtttggaagtttggttgaaattggaacgatgtgactgaaaagttgtgtgtattaaaggtttaatgtgatggaaagttagaaatttggaaaaaaaaactttggaactaaacagggccttagagcaatttgaatttagccaaagtcaaaaataacttataatctaaaagggagggagtacattattgctctccagctatcctgatcttttctctttttgtttttgcaaggatattatatatttccttgcgctttagattacaaaaggtgtgctaggtggtctcgtcatgtatatcagagtactgaacccttaaaaccgggaacccagagcagcggcagttcttgcccttctttcacgaacaagattttacgaatacagataattttcaacgtgaagtagtgttgtagacttgtagcttagccttgtcctagtgaacgattgagtacttgttctttatacaattttctcccatttgttagtactccctcgtactacgaaaagttcttttaattaagtgattctcaggcagtttgatacttcggagaaatgacttatgtgccactcatttattactggagaaatgttaataataaactcttcgtggacaaatttgtggactccaaataaacactttgtagcataaaacttaaaataaactctttggtaaatagaggaagcaggtttgacccatgaccaagaaaaaaaaaaccttttattaaagtaagagcatattcatccgttcccacttcccagatatctcatatatatattttatatatacactccctccatcccaaaaaaaggcaaaccctggctatgtatcagcatgtacagatatatgtccagatatatatatatatattcatattgaaaatgtgggtgcaccagcagttttctattttcccatatccaaaaaatatataccaatgaatcaccccaactccttccgaatgaagggggagttgcaattcccccaataccatagttgatcctccgctacacctaaccgccaacgctagctcagccggccatcgaagacaccatgaggatcgcctggaggcgttgctcggcccccgatgaccattgtccacgacaggcgtgctgctcggtacttgccaaaaatctaccctagagctccacccgagttcatctaccgccttgagctcttacgaccgccgccactcaaagcttaccatgctatcagaggtctctctatctcgtgtgcgtgtgtcacatgggacccattaatattagggatatgatattagggagctataaaagcacatcgctaaaatttcttattatagtagtattgggacatcccaataacctgtttatagagatggaatattaggagactgctggaaatgctattaccaacaatttaccttacatgtcacctagctagttacttatctcaattagagacaatttgtaaccacatgtaaattgaagttcgttagtttaccattaaccactaaatcctagtcctacagctgccactaagagccgtcagattaatctaccatcgcatcatagccatgcatatcttatccctttgcaagggatcaatccaaatctaagaaaatctccttttctgcaggaaaatctaagaaaagtctgtccctatatatgtcccaattattttcaaaagcactataccatctaaagtgttgagttggcttgtcaaaattaggttaccacacatcacagtattccctttgttccacaccagaaatcattttcggttttgttctaatcatcaatttaagtttaactaagtgtagaaaaataataacacctacaaaaccaaactagttttattgaatccagcaccaaatttattttaacattatatttgttttgtgttaaaaatgttactaattttattttataaacttgctaaaacttaaaaaaaataactataattgagtaaaacaaattgagctgtggttcgcttaaaaaaaattatcagtggtcaagtgatgtcgtacaacacatatagggtggtcatccttccgggggcgcgtgccatcaacgccaagccatcaaccccgccagtcgccaacttcagatcggcagatcccgcaataataatgacactgttcgtagatgaatgcgatcactgaacacacgtactgttttttttctgtggtgttccatgacgagtttcatgtgtgcgctgggctagctcggtgattgctcgttgggtcacacatcacacaaccgattgcttttgctggaggcacagttcgtggaaggaaatgcgttgaatcgagagaactatttcgactaaaagctgtgctttgccggaattggcatggttactgtttgggccaggagaccagttactgcaatttcctcgcaacatcgatcaatgtgagccagcttttgacggggccttgaagttatcacatcatgagggaacaagttcactttagctcccttaacttgacattgagtttgattctcatccttgatccacataactatatacaacgggtccctgaactatcacaaccggtgcaatataggtctcatggcggtttcagctgacgtaacgcctacgtggctaatttgactcagtttcatctgacgtgacattgacgtggcacatgaagcaaaatttaacgatttaaaaatgaagcaaaatttaacataggcgcccacatggcaattaaataataagattaaaaaataatgtgacctacatgtcagtgggccccacttcctcccctcatcctttctcttctctatctcctctcctcccattctccttctcccatcttcccctttctttcccagattcggtcggcatggttgtgcctggtggtggtcatggccgccggtggctgttgtgtggatga

SEQ ID NO: 61512 - DNA, 15418 bp, Oryza sativa
gtcatctattaaaaaacggagggagtagctgatctattgtattagttggttttttattaactgtaaaatgatatagatattattggagccagcagctgactacactattaatccaatccttctaagagctttctcttaggacaaaattatttttaatagtccttttgcatttttttccataaacacccaaacaattactagttttccaaggaagatcgaatggaacattactcgatcagttttcatctttacttgtttcttcttcttttttgagataagtttttcatctttacttaccatgtcgttatgtatgttatcgtaggcatcaacgatgtgtcgcacagaaaaaagaaggagaggcccagggcacgcctgcctgggcatcatgccaagagacgccaagcccggtcttggccgggctggcaacgacggtgttttgagcgtcgctttccctcatgagggcattgacgtgatgccccattgcctctaaggggtttgccgggtgaaaacccagtctcgattctcctttcagacctcgacgtgtttccgtcacggtagcggtgtttccgtcgctcctctccctaaggacatcatctaggagactcctagacgaaacccctagatctcagtcctcttgtgtcgacgccctagattatacaagttggccatgtcggaggtcctagagggagaacggttccatcttctctctcaccctctctccctcaatcatggatacagtacagttcagtgttagttggtagggttgggttttgggcctcctggttgcagtccctttgttggcctagcggcggctggttcggtgctagccttctactaatactgtgtcggtgatatgggcctgggggtacctggactaaggggaaggaagcctttcccttcgctacgcgcccgggtggcccggacccctcccccctccccgggggatcgggcactcggccaatgagtagccaaaaagcggctgcgcattcctggggggctcggggtacctcgtcgtacccctcgggcccaagggactgagtcacccccgaggcccttgctcggctaccacgtggcggccacatggaggcttgagcgggcgagggcaccgcctgccagccgcatttatgggcggcgctccaagcgccctcccccctcacatttaatgcgacgtggcaggttgcacaccgcccgccgatagaagtgcgccaggcgaccgtttcttgaccggtctgcgacccggcgatggatggatgggatagtcagcagcgcacccacgccccaccttgtgtcaggcggcgtgggggctggtatgccccgtcccatcatctgtagagaataggcgtgcaggtcggtactccccacgcgcgtgagcccacgaagtcatcaagaagttattgtggaatgacgggggatgtcccctatgtcagacggaggatttcggtgggggccacctgaaagcagccgcatgaatcgcttccgatccaaggcacggaatgcctttcgctaccagcatgtgggcccctctctcaggaggagagcgtaggagcagtgcatgtggtatccccttcatcaataaaaggaggaccttgccctacgagcaaggggatgactcttgatagatcggattctaggaaaaggccagcgaagccctagctagttctcccaggatccgagttctctgtaaccattcggaaatcaatgcacacacaggagtagggtattacgctccatagcggcccgaacctggataatccctttctctcgtttccttcaccatccaccttgaaaacttgatttccactgacatactccctcacacaagaacgcgctcttcagctcttgcacccggtcccccggccgaactcacaaaggggggggggggtctcatggcctcctgctagagaggatcaccccttgacagactgtgtgttggagctatcggtgagcggatggtggattttttctttgtttttctggttacgacacttcaggattgtaatcttgtaattttttcctggtggattttttctttgttttcctggatacgacacttcaggattgtaatcttgtaattttttcctgctctatctacatgaacttcgcactgtctggttgtgggtcgttaaaaaaaagttgtggtcggctagtggcatggcgtgacggtgagcgaggtcgatgtgtatcctgggtcatgtatttcaatagatttggggatcaaactatttcagttcctggttatgtgctgtcgaattataaccttgcttttgtcacgtcccaaaatgaccttaaaatatatcctgtaaattatgcctagaataattaaaatccgtgtgaaagcctccaacaattaaaatgtgcaaagtaaaagtcaaataaggcttaggggatttttttatatttcctaaaggcctaaaatgtgtaaataaattttagtggaattttcagagcacaaataataattattaagaaataaaccaagttgaaaaaggttttataaaaagaaaaaccctaaaaaccctccctccctctcttgggccggctcggcccactctcctccccctctctcctcttcccccgcggcccactcggcccctccccgcgcgcgcgccgctgacgggcgggcccgcccgccaccctcgctgatgggtggggcccacccgtcatctccttcctcctgccgctcccgccgcctcgcccgcgcctagcgccgccgcaaccgccgaatccgccgcaccccgccgtccccgcgtgcaataaagtgaggggaaatactccccgtgatcccctctccctttccccccatttttccctctctctctcgcattcaaacggccggatttgctcccgcaaatctcgccggcgccattgatggcggccggacctcccggccggtttccttcctctcccggccgccctctcccccttccaatcctatttaaaccctccccgcgcctccctcgcccgtttccgccccttgccgcaccgtctcctcgccggaatcgagctcgcgccgtcgccctctctctcctccgtcgctgacgaccttcggccggctctctccgctcgccgggaccgtttcccgccccggcgtcgcctcctccggcttcgccgcaccgtcgccgtccccgtccaccccctcgtcgagctcgccgaccgccgaagcgccgccgtccccgtcgacccgagccgcgccgccgccttcctcctctccggccgcctttttcgtcgtcgccgtcgacctagggtgagccgtggaccgccacctcgtttccccctttcccttccctctctcggccgccgctccgccgtgcctatggccgccgccgacgaccataggggcgcgggcgcgccgcctcccgccggccgcgccgacgtggccgccttcgggcgcgccgagcggctgccgcgtggggcccggccgtcagccgcccgcgccctcgggtgcggctgacgcttggggcccacggcgccggccggtgtgagcctgggtgcacccggtccaccgtggaccgtgaggctgccgcgtgggccccactcccgtggactcggtccgcgcgccctctcccctcggctgacgcaataaaccatttttaaattaaaatttaaatgaagaaattcgtaaatattcatttaaagagcatataaacttcaaatggccataacttggccatttgaactcggaattggaccgttcaagtctctaattttcccttaagaagtcaagaacccatttttgtgctttgttcctgcttgttatatggagtttattagagtaaaagcctttttcctttctgctagtcgtgtagacgctgcagcttcggaagatccgctctacgtggaggttgaagccgacgtgtgggaaagcgagcaaggcaagtcacatcatccttgaacatattgaatcccagtttataaaattattttgatttaaattattgcattatcgctttatttaaattcccgcgttatcattgttttatttagccatgcctatttgcctttgttatgaccttattattattgctattgttattattaccttgttcaccctagaataaacaaaaccccagctagtgggtactctatttatggtaccactagtatgaatttaagtagatgcttcgctgcttaattaggcaacattaggtggttttacaactctagactttgggaatattcatatcacctggacactatggaatggttggattattgtggaattggactcacacctccccctctattcaaaatcctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacatctctagggcaaatgaaggctacacgagctgcggcccggtagtcgagatgtcatggcacagggctggtgtcctgctgctaggggctcagtcctgcctacctgtcccggaggttctggccgtaggtggggttgggtcggtactcttgtctatggctaggatgggttggaaactatgtcatgtcttccgtccgtatgccgtggtggtatgtggcacgtggttacacgtgaggaagacatatcttgtgggtaaagatgtacacctctgatcagagtataacctattcgaatagccgcgccctcggttatgggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcatgtgggttcatggccttgattaataatcttgtatagctctaggatcgtgtttaccaaatcgctttgggcaactaagtgacttttaaatactgtttactgcaaaacttaacccctatattataactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcatgcgcctgtggtcatcgccctagtcttctgctgtttttcgtttgtctcttgtgtgctgggccttcgccgcccatgtaataaattatctagttacgcttccgcttgttaaactctgtattgtatcaacttttggtgtaacttgcctcctgggacaaggaataatacacgcacgtaaggaacgcccgttgggttatttccggtcgtgacagctttttatgtacttagaaattaaattgttaattcatgagttatcgtgtatttttgagagttaatattttgtatgtcgtgtttaaatgtggattactaagagcctgtttggttggtgccctcacctccgtgcctgagaaatttgtaagcctgagtggcattcaagtttgtaatgtaggctacctggtcaggcagcttgagcctgtgcttgtttggttgtcacttgtgcctgagaaaaaaaattcaattagatgtttgattattatgccgctaagtcaagtattaatatccgacacaaatttttgcatttaattgcatctgacctacaaccaaattcatctagtgcaacagatccctacacaaatcaatcataaaacaaagaaaggaaaaaataatctaaaaacaagggggaacaaacaagggaaaaaggaaaaaaaagaaagcaaagattgcacccagattgtaaagtcgatctgcttactcaaccacgggcggaagaaatccttgcctgacgacacgatgcctccgcacgacggcggcactgctttgcgtagacaccaggatcaacaaggaaatcatcaagaagagaaaaaagagagaagaacaggagcaaagagatccccagatccatgtcgcatccatcagaatagaattgcaaaatccatgcatccatcatagaagagcatctgcatgtgaagcatgacgcagcactccggaggggtcttcgtgtggctgcgatggcttcgtgcgacggcaacggcggcggcctcggcagcttcgtgtgaagttatcacggcggggatgaggggattatggtgctaatgtgtagcgcgctgctgcgtctgaagcctaggcgaccgattttggtcgtctggctcaggctaattccgcgcctgagttacatcaggccaggcgaggtggaaggagccttagggtagcaaccaaacactcacaaattagtcttaggcatgtctccagccaggcaacttgttgtcagggcagcaaccaaacaagctctaaactactcaagcaaagcaaaagtggcaacatgatgcaatacaaggattacatgtgcaaattatatatatatatatatatatatatatatatatatatagatacaatccctagggtgttagatcacattgtcatcaaagagctcctcgacgtatcatggagaaggaagtatgcatacgtttgtttgcttactaaaaacaaagggcctaaggatcgccaaccagcgccaatgatggttgtgtgtgtttacgtggatagatcaaaaaccacttttgtgctaggggaagaactcgattatccgtgcacttacggataaaaacaaaaagcgtaaggatcttttacatcaaccgataggttgcatggataaaaacataaagcgtaaggatcctttacaccagccgataaggtgctagcttagagatgtgtgtgtgttggaggaccacaacctcctctaggataagggaaggaacaaataggagatgaatgatttaagactaccaccccgttcatactcataaaatagaaaaaaattgccccaaaaagaaaagaaaaggcccttgttcattatgaaattatttatgacagaaaaaatggtgtgaggcaggcggacccaaaagtgaggcatggcgctgcatttgatagcagaggcatgagttccggaggtgggggttctctttcggttaccctatttgggttgtcgagttttggagtttggaggggtgaagaggaaactttccgttttaggcgccgtcttcctccgctctttgcaatgccccggcagcgtcccaagaagggggagcgccggatcgacgccgccatcgaccacttcacccccatgggctacgccaccgccgacgtccgtgccgtcgtcaaggaactcctccaggtcgtcagctcaatccctcctccctcctgatctctccgtcaccacaggcccggggtttctttcctcttttctttttttgttcgattgttcttgggaccaagaaccgcggaaatggtgatcaaaattccacatttgctgtgttcttggaggtgtccagatgcaacaaattaaagctcgcgcctttccttgcttctaggccctgttgatcgatcgacaagctagcttagcattcttggtgatttctgttcgtgtgtcgtggtgtgagcaggtgtacggggggaacgacgggtggccgttcctggaggaagactcgtaccgcgtcgtgcaggaggcgctcttcgagaagcaggagcaggaggatcaccaacagcagcctcaccctcatccacaggtgctgctgctgctttacttccttctactattcatctctctcttgatgatcatcctattcattcatgtcctctatttccacttctggctgtcaactatttttatatttgctactacttacgactaccaaagaatttcttcttttttaatacattacaatgtccgcgtactcatcaatacatatatgcaacaatccacattcatcaaaaaactttatttttctgctctaccaatagtaacattatatccagcaagttcatcttcaattcttaacattatccaactattcctgttctaaaaaaccggtatatcctgttgcaatttctgaaaaaaaaaaggcaaggggaatccaacctaattagtgctttgcacccaaatttccaataatatataggtggttttacaccttgttctaaatcggttttgtttagtagttttgatggtaacagtaatactatgacatgggcacaatgtatctgtttgattcaagggttgattggatccatgccattataaatatgtcgattcagaaaaatgccacgaccactatgatcctacagccactacaatttatctatttgtagttgtgctaccgaaattctacaaaattggaactgtacaatcgctgtcacgttttccatccatctcttcctttttttttccgttttctttccttctttctcccatcgtcttcccgcaccgatgagtggcgggaccggtaagcgacagggtgtgaggcgggaccgcagcagggcatgaggcggcaagggcggatatagtcataggtgatgcagcagtcccactccttgcacgctcgagcatggtggcgacgaactcggtatgcagcttcacgtcgaagagggagccgaagtagatgagcgcaagtagatcctcaacagaggaattagcgccggaggaggaaggaaggcgcgacggtggatggggaaggggcggggtgggaggagagctcctcggcgagtgcggcggcgagcggggtgcgcatccactcgtcaatgagcatgacgacaacgggcttggatcagagcacctcctcatgctccttgttcagcttcctcccgttggtgagcgattcctccatttggaggatctttttgtgcttcttccacagtgcgtggagccgttttgagacaacactaaggattggcccgtcgatggcctcagccgccgcagccaccacggcaggggccgaggaggagctggtggaagaggtagccatgggtagggttttgggatttgagcttggagatggaacgacgagggtagggaagaagggcaatcggctgaggccatggggtccacgcggagctccatcgccggtggtgtcgcctcgcctcaactccatccagatctggtgagagggatagattctctcctaccctttccccttccctttttgccaccgccaccaccgaaccgccgaggtcccgccgtcgctcgtaggtcccaccgccactcgcggctcgtcagtgcaggaagaagacgggagaacgaaggaagaaaatggaaaataagaagagatggatgtaaaacgtgaaggcagtggcaccgttccaaatttgtaaaatttcagtggcacggctacgactagacgaattgtagtggtatttttctgaatcaacatatttgtagtggcatggatccaattaacccttgattcaatcattattacagtgaccaagttttagtagatgatttgaggtctcctagttattgaacatcatgaatttcacttcgaattctgggcctcgatgagcttgatctgtatttttttaaaaaaaaaattgcttcatagctgcacctgctgctgccatttttttgttctcagaacatgcccctttctctgttgcaacttgcaaacatagatcgttcaggctcttcattttccagacccacccttagtttttcagtcacccactgctgccaaagacatctagttctcagtgtgaagtgccttatttgataatttgagaactaatcattacgatttgatatgacgttcttccagttcgaattaggtgctgatacaactcgatttgtagctctagactgaaaattgcttgttccacggtttctgaaaattacaatcaatgcgtagtgtgcaattattaaaaggtattggcgtgtaatgcagcaattggaggaggcaccattggaagacaagagcatgtcaatcatagaggtgcacaatgtgatgcctgctgagactgaacaacaagtcgaggacgcggaccccatgcttgttgacctgcctgcagttgaagcaactctgccccttcctgaagccaaagtaacatatggcacaaggaggccctgttatgggtggatcgaagagtacgaaagtgaatccgataacgaggaacagcctgccagattgatttgtaagaggaagcgtccgagtagatgggatgttaaacccatcaactggtgagttctcgacatctgatatcagctgagcatacagtattgtaattcaagaggttatgaactaatttggacaagctccttagttgcctaatataacctcttattgcagttacaacttacaatttacaagcatgtcagtaaggtttataagcatctttagccacgtctgcagctagcatctgatcttaagtcctaactaggctgttaagatcctggattgtgattagatagttgtgacgagtgatgcatgataatttcggacaggcaaaatcacgtagcaatgtgctgctgaaataagtttgtggtgatcaatctgtgacactttagaagcactgcacacttttaatgctggctagtactattcagtaagacctgaactgtaggtgttccatttttttttcctatgggttggtattgtaaggtactgcctccgtttcaggttataagactttctagcattgcccacatttatatagatgttaatgaatctaggcacacatatgtgactagattcattaacatatatacgaatgtgggcaatgctagaaagttttataatatgaaacggaggaagtagttgtttcaaaatttcatagatagatgtgatgtgcagtttgtgtggaagaaatactactgatctttcactgtgcgtgttccattgttttgtcttcccacttgtgtggggtttaattttataaattagagctgagaactaacctttgccaatccctttgtaagcttgtatggattgtgaacgaaccaaatgaaacttcagtcgcattcctattgtaaccactaatcgcctcttgttgtttctaacagattatctgaaaaggaggtgacaaggcaatgtggctgcacaggtggtatgcttaacccttgtttttgaggcattctggatgtgctgatttttcataagttttgtattgtacacagcagtaacagtggaagtattgatgcaatgtagagactttaggttatgcatggttgcatgccaattaatttgcatgatggtgtatgcagacagagacatgatggttgatgtatgcagaatctattcaagtactaatgtggatttttcattgatgccttcataaatcatactacctccgtttcaaaatataaggaattttggacggatgagacatttcctaaaactataaatctggacataaatcataatgttatttggttttcctggctggatgttgtttgcataacctagccgtggcacatgctttgagctgtgccttagacagaatgatctgttgaccgtaaagcataataccaatacagcaggagaagaatgattgttttcttaagcttgagatagttatgccatagaacaattttctgttttcttaaagctttataatttttctgtgcatttggtttgatggagtgtgaatgtgtgatagcacgaaagccctatttcacccaaacgcccgagcaaagatagcacgcgggttcggaacttgaatgacaaacatggatgctgaaattgccctctgaactctgaaccagaaaaacaaaaacttggacaattctttgaaatcagacaaggatttgagtcttgtgaaggcaacagtgattctttatgttgggccaaaacgcataaattccgttgccgggactcgaacccgggtctctcgggtgagagccgagtatcctaaccagctagactacaacggattatgacacaataattttgtgttagaataattcctcagaaattggcatcttttcacgttattaccgacaaatgactgtatcagtcgactgcaacaagaaaatagctaagattggcagaaacagactagcttagttttacatcgttagctcaatcgaccccgtgtctgtgttttattatactattgtcaaaaacatatgaacattgttagctcactattcgcagcgaaaatgcggatcaaacataaagtagcggtttctagtatgttttaataaatagttatgcacacttgaacaggttggcacatgttaccaatgaaaaacacaaaacgttgctgtagatgctgaaattctaagcaacagtcgctgttggctgtttgccatcgaagttcagagtctttagatagacgtcgacacaaactgctctctatttagtcaaagcatcaacagcacagaatacacaattggccaaaatataggggcacaagttgctgtagtacatcaatagactcctaacacaaaccaaaccaatgtaatcttagtgttgtatcaacaaaaaagaaaaaaggacaagaaaataagcactgcccaagcacccaaaatctcaactttcatcatcattcttgcaactatacccatgcaagatcacaaaagcacaccagaaaggactttacaagacgccatccttcgacagatttttccttatatgcagaaggacaacaagtatgacatctcaccagttgatgagtgctgaaacatgaagcattgtgctcagtcagtgctttcgcgaagaacggccactccctccctcgctcactcgctaaattttcatctctaacattcacactcactatataggcacaagaaatttacatccaaagacagtcaccctatgaacatatactttttttttttcgatcccgtggctaagtaaaatcgaagcacgaaggagatctcctggagcttttagctgcattgttacccttgtggaggtagttagctgtgtaaaccgtgtcagtccatgtggagacgaagaaaaaaaagaaaagaaaagcctttttcacatcactctttgaggtctatgaggaagaagctggggtctgggtcgagtccttgtcatcgtttcgtcactgtgtcgaatcatctcggacaatttccagggcttttgccacttccacttgaactgcagtagccactggtggtggcttcttttccatctccaaagttttcctgattgccctgctattgaaaccttcttgccaacaggcaactgtgccataggaaccatctgcattgtacgtcaccaattttaaatacgagagagggagatagaacaaagagtatttcaggggggtagagataccttaagatgttgtttgttgaatgcaggaacccctttgctggggctatttacaattccagcagagtacttcagctgcttctgtgcaggcaccgcaactggtgacaatggtgtgttggagtcatcagcagagtgcttcactgaaccatttccgtttccctgtaagatgcataaaatttccattaagaactatcacgatatttgttgaatatcttgtactcttgtgactatcagttagggattcaagtgactcaatgtttttttgtcagttccatctactataccctatgatatgttttcttcttttcgccctttcaagcagggcgtacgagagaatttgaacatgggtaatggagatgttaaataccctcctcaccaccagatatttgttttagatgtttaggtaatcctttcatcattcaacatttttttctactgaggggtaattgctgtgagctcatagaaaccatactggagatgtagtggcagttacagctgcctgctctctttgcttaagctgcttttccgtttcccttctacgtgattcgctgtgtcgaaggatggtcacaagctctgtcatttgctccttcatttccttgatctccatctctttctcccttacttggcatctgatatttcaacagtgaaggttagttccatacttttgtacaaatgatcatttttacagagtatcataaaaacggctttgcattgttcttccattcacattgttgtcatgctttcaggaagaaataaagttgccctttgagttcagaattttttttttgttattcctattttcaaatcagtaccacactcttttattcgaatcagtgccatattcttagcaaaataacacttacagattttcaactatttagaaagaaaaagtgagatttttagctctttagtaaaaataatttgtttccaggttctgcaaattgagaagtcctacaaggatggatgctaccatactattaaataatgaagccaaaagaataaataccaaccttgcatctgcagcaacgttaaatatatactgcagtaaactctttgcctctgccattgaacgcaactgattccaccgaccacgcccagagaatgcacgctctctttcttcagcttctgagagttgagaagccatagcaacgagagtatttgaagatattgtcaccatgctttcaagtgatgctatcctagcttgtcttgcatttggtgacaaagtatttgccctgagaaacaaaatgcagcaatacaagcataaatatttggatgtgctgattgcacattttgagaaaatatgagaaatataaaatacggacccaaatataacaaccagattacagacaaggacatattaaacggtgctcttatatttcttaaacagtttgtgataatatatggattaaagatactgtccagcttaaaggtacctgaactacaaaatagaactatggggataacagttacctagagtttccattcttccctctgggcggactagctgcaccagacatgacatcttcttgttttaaaatggcaagctcctcaccaagtgcagcacgcctttaaaaccatttaaattagtcatcataatcatgcattacatgaggaatgatctctataatttacatttgggaaggaaataaaatgaatcacatacaattgactttgcttttcatattcgtttcgaacttcatgaacatgcaccatgacttccaaatcttgctctagccatttttgcaatgatttctcagtcatctgcattacaaaaaaaagtattctcaaggatatttccaaataagcaactgatctttttctttaagtatggaaaataacttacatgagagccaggagaagtaccattcatgcctgatgtgtttggaagaaagcaaaaaaaaaaaaaaagaaaaagaaggaagagctgttagattgggagtattaattataatgcgaaaaatggtcgcaatgcggagagagatacctgagttgtcacgtcctgatgatttccgagcctctagtaactctttcagccttttggtagccatcgcagcttcttcagtcttcctctgcaaaacctgcataaagatgcaaaactttgatatttaatattttataaatagacatgataatatgagggaaaaacttacacgtaattatatagctaagtaagatatgaactttgacgaaaactatgtcagggcagctagttacacataaagtg

SEQ ID NO: 61513 - DNA, 1454 bp, Oryza sativa
tcaaaatgatcaagccaagatgaggaagaagatagaacaagagaagggggggggggaaataaggtgatggcatcagaactcaaagtatgaagacctcccgagcaaaaatagatctaattaaatttcttccagtatatatggaagtagaaaacacgaattaaatttgattcatgctgagaaacatggcatgagatccgaaggaagtggaaagctaggagaagggtgatgaagaacaatgaaattgatcagttcatagcatggggaggtgagggtaagaccaaaatggagcggtgctacgctgctacgccgattcttccagggtcatcacaaagtatgaaaatcaatgtgccggaaagatcttaataccagaaggggctcccctgatggatcaaaaaggaaagaacataccttcctttctagtttgcagccttcatgctaactctccactcagttctcacacacaacacaccctctctagtactggttttgagaaatttatcgttcgagctgtctctgacacacgcacaacccggaagatgggcaataataatccaaggaagacccggagaaactggaagaaagaggtcagcaggagtagggtttgtatagatccgctgaaaagatatcctcccatgctagttagggatccggcctcccggtttataagaacaccgcgccatgtccctatagtagtatgcacagacacacacagacagacggaataaaataattaacatggccaggtaagtatagtagctcggctacttggcacctgctaaaaataaatgaaaaagaaaacgagaaaccccagaggagcaggacgccgttgcagcagataaaagaaacaaaaaagaacaaaaaaaaagaagcaattgatcagagaaaacagcagatctgcaggttcaaattgatgctggtttgttggttgtgtgtgttgttgtgtctgtattaattatacccggcgctgccgaactcgtagagcttgccgcggctggagaagatgatgagcgcgacctcggcgtcgcagagaacggacagctcgtaggccttcttgaggaggccgttgcggcgcttggagaaggtgacctgcctgttgatcttgttctcgatgcgcttcagctcaactcttcccctccccatctcgcccgatcgatcgaacgattcctcagctcagcaccgatcagcaagcacaggctagctagctcctcctccaccaccaccaccactgcctctcttcttgcttgctaaagcctccaatgatgacgagaatataacgagccgcgcgagaagaggagaatattagtggagtcgagtccggagaaaggacattgggcactgtaccacagtagtacactagtactagtagtagctctttgtgaaactggtttcttgcttgctttgacacacatctctctttctatctctctctctctccctccatcacaattcacaca

SEQ ID NO: 61514 - DNA, 1597 bp, Oryza sativa
acaaaacttagatatttataactcaatgtaacattagtgctagaaactcaaactctaaattatgtaggttttgtgataattatattactaaatctttagatttgcaatagtttagttaaattatatgtagttttgagaaacttacttggaaaagaaaatgacaaaaatcaattttcaagtatggtcttttcaaaagctacccgccttactttaaatagggtaatgggagaggatgacaataactagagagaatcaaagccaataagattggagaacttaagtgatgattatatgttaaaggtggatgatagtgtaaccactctgcttctctagattgaggagatagcgaaattgatgatgggagaggggggaggggtatacggcctagatagatggataatctacttgaaaaggttgaaatgagttaggtgatggtgcgatggtactagagggattataagacgtagtcaatttttctgagcaattttgtattttatctccagatctaaagacgcgattgcatttcctacacattcattgctataatctgcatcgttatagttagcatgatccaaatacatgtcacaatgaaaattttttttcgctggtctttagagcaactagaaaattgtgcttttcttaaaatatgaatttaataatctattttttttacactaaatgtatttgttattggactactggttgatcaaaatctgtaaaatttacgttttaaaatcaggacgcaccacataaaaaaaatttcaaccgaggcagtatcgctctaaagccaacaacacggggactgatgtcaaaaacattataggcgctagtcgccatctgtgcccatttcgtcctgacgaaaaaagatttaggagaacaagaacttttgcaagtttttaaggagagcatcttggctttgtgggcgcctgggcaatcatggatcatggccgcctcatggttgtgctctcgcaaacccctcttctaaaccccagcggcacagtggcacacgacggtgcacgttgcaatcaattgcctttgcgtgtttacatgggaagggtgcacgaattcggtgagccatcctctctgtcgcgaagaggcatgtctaccggtggcacgcacggccgagcgcatgatttcggttcgctgagcggtctctttcgcggttaggcgagtgaattgacaccgagacacagcgatgtgcacggcagcacggggaatggggtagaatttgccgcggcagtaagagattggttcgagttggctgttgctgtcgggcaagatttgggtcgcgttacgcagctacgctcgagccgcagcgtgaccagcgtggctggaaaagggttctcgtagacgattggagttcgagaatcaatgcgaaaagcaaacggtgccgaatgtaccaagaatgggtcgacagccatttggccgaaccgctgaagggagatgcatgacaggggaggcggaacaaatgaacaaaaacgttcacggagcaggtatgatagtagtaacacgacactgtttgatggatgattcaatgagtgtggagattatgaataccccatatctacatcacagttgtaatttagtcgaatatacg

SEQ ID NO: 61515 - DNA, 647 bp, Oryza sativa
tagtgagtgctccactggctccacagcatgttttaatggttccggttctagtatggacacgttaacaacagatggaaagtccgcctcataatcatctcgatctgtcaagaaatccaattccaattccaaaaagttacggcgggactcatgattgcttgttggaactaccattcttggacattgaacctgagcatctgcgagggctgtccttactagattaaagtttggtctgaagtttgtcatggaccagttctcgctgagtctgccaggtttctggagtgtgttagagtaactcataacacagtgggactcacaggcagacttcgatctccaaacagatgaaagaacagccatgaaatgtttctggagaagcaattcattgttaggaagctcgctgattacattgagcaacatctgagtttgatcctggaaaataagtcatagaaaatcaagttgtgcacacaataagttgaatataaatagtagatttgtttaaagcacacatatacaaaaaaaaacaggcacagtatagatatattcacatgcctggcctcttaactggattaaagcacaagattgcagattgcaactggcaattggcagaggtatgacttgcttattagtcagatagaggaccaaccccagca

SEQ ID NO: 61516 - DNA, 1729 bp, Oryza sativa
ttagttttgtttaagtgccattaagttttaaaaccgcctattcaccccccctctagtcggcctccttgatcctacagagggaggtttcgctgacgtgtcacctatgtggtggtgctgatttggtctctgtcctacgtagtgcttatgtggtattagaattaaaaaaaatgtgagactcatttatcattcacataaggaatgttgtgggacccatatatcatcctctctttctcaatcccttcttcctcctccctccctctcccttctctctctttctctttctctcccccttggtcgtctacagggacagctagagcagcggtggcggtgggcggggcccagagtggcgacagcatgtcccgtgggtggtgccgctggccacattcgaggaagccggagacgagacgccgccgagaactcatgcccacaagatataaacggaaagaaaccctactccagccgacgcgccccagtctcctctctctctctctctctcagctcttatcggctccgatgacctaagcgcacacctcctatcgccgccgccgatgacgacaatgagagagatgccgaggcgctgctgctcgcacagcaggagttggacaaggcggcatcagcaccacgatgatgaaatgcgagagcggtggtgaacgaggacgtcgtcgatatgatggcaccatgggccacgacgagacgagaggaagaggaggaggaggaggtggtggtggtggtggagaaggaggggcgagcacaagcgacttctacgtggcggctccagtcggagactaatgaggtgagtggctccctgatgaggatcatctgcgtgagttcttggtcaccgaggttttcgcgaggtcaccaccaccgccgttctcatcttaggtgacaacaactcccagtggaactgatggtcttttgttcgatggtgatggtcaggggggagcagcttcctcgccgtcgttaccccagccggtgtaagtggctcctcatcccacggtgaggatgtccttctcggccgtcaccgacgacaacttgatgttagccattccttttgtgaatgataaatgtgtcccatatttttttaaattctaataccacatgagcgtcatgtcaataccatgtaggacgaagactacattatcatggttcggattaagacatatcttatatcctacgacttatggaatatacgaatacagtataccttcgtgtatacggtataactccgtatacgataaggaaaataacaagaaattatggaaattatcatcacgggcaagtgaatagcagagtcctattcagaaaggattgggtttatactatatcgtgtgtggtccatagtatccgagttctacttgaagactaaggtgattcacggtataaaaggcataccccctgaggggtctggaggagggaatcagagagccagcaccaccaccatagtctacaatccggaggacgtgaagcctattcgccaggagatctcgacgaaaccatcttgtcgatctcaccagtaatctccaaaccatgttttttgaaattctttttggccagagggttggtaattggaatccaagcaattttgaaataaattgtgtagcgagatttataattttggatatggattatgtggataaagatgcatgtagaatccaacccatatttttaaaaggttttgcacagagggttggtaattcggatacaaaccaattttaaatgaattgtgtaa

SEQ ID NO: 61517 - DNA, 2700 bp, Oryza sativa
atgattgattgagttttaattattacgaacttgaaaaatatattaatatgatattttagagcaactttcatatagaaaattttcgcacaaaacacatcgtttagtagtttaaaaaacgtgccacgaaaatcttaatttttcatccaactcttattaaagaaaagaacgggaccagtcaattcagtcagcttatcttgggccgtttgtttgtttacttcgaacacagtcaataattaaataacaaagtactaagaacgaggagggattaagatcatctagcttctctctaacgtggattactcattactgatatatggccgggttccttatgtagcgggtccacacgtcaacaattgaaaatcagagagaagtaattgagtcgcacttaatttaaaaaagttatactcgaaatttacaccgaaagttcagaaatatgagtgtagctgactcgaaatagatatatgccctgttccttccacatttagaactgtggaaggataaagaggcaaatttggaatattccacacattagttttgcaacgactagctaggagcttctgtataggacaaatgatcccagtcctacaaaatcataaagacattccagttgatacacaatcatgcatcatgatcaagtggatcaataaattatatatgcaaaatggaccagttcagctctcggttcagtgacgtactagtataaccataaaggttcaatttgcaaacattgaaaaacccaataccggaccagaaaaacagagacataccaaatgaaccgtttatcattataccactgtacacaggtgtattatctctatgacatgatttacttacatgcagtatctaatcatcgcagtaattacatgaacctcccaatgatcatgccaggtgccaggccgggccaaccaaccagctgcttgcctgcttctaattaattgttcctaccgtctaatcatcgatatattccaccgcattccgacacgtaccactctcctccagctggataatcctcggcagaaaaagaaaaaggaaacgaaagggaaagagagctttgtctccgttgattaacagcagcagtaagctagcttaggctgtgaaatggcgcgactgccctcccacccaaccgatcccgtgtcgcgtcgcggtcgcgcgggccaaatattgattcaccaaacgacgcccgtgaggcgggtggcgaggcggcccagtcgcccgcgcgggccggcggcggggcgcgcgcgcggcagcagggtggagcggcacagcgggcacgtcaaccggccgaggtcgatccaccggtcgatgcagccgcggtggaacgcgtgcgcgcagttgcccagccgccgcaccacgtcatccgcctccagcctctccaggcacacgatgcaccccgccaccgcctcgtcgtcgtcgcagccatgacagccgtgctccgaggccgcgagcagctgggcgaactcgaggggcgggaggcggtccttcacctcgtcgggcagcggggcgtcgacggcagccgggcggcccgatcgctccgggtggtggcagatcccgacgacgaagagcatcagctggagggcctccctgatggcggcgaggagcttggccaaggcgatgagcggcttggggatcgccatgcagtagcacaccagagggaaccccatgatcgccgctgtatcgagcttgctacgcacagttggcaatactactatacaccgagtcgccgaacgccgatggatgcacggaagcagagactgcggcgaaagagagtcgtggaaagcaaagggggaggatggtgacgagtgacgactagtcgttacgagcgcgcgcgcttatatagagcgccagcggtgatgggcgccggtcggcggtcgcggcctcgcgggcggtgtggtgaggtgatcgataccgagacgttttcacgtggtttttggtggataacgcgcgtgcggcgtgcggaaggaaccagaggcgcgcttgccgtacgttttaaccgcgtggcgtggcaagctgacgcgtaacgggacaacgtcgcgggttgttttgagttcgtttgagtttgaccggggtggtgcccccgccgccctggtacgtgcgcacggactacgggcgtgggggcacatgggaaacgcacgccgaaacttgatttgggcgagggcgagtgggcgtggggtccccggcgcggcaaagacggatgacgggctcgctggtcagacggaaaattcgtaggtgcttctactccatactgttgcttgtgttgtttactcctactaataatacacttgtacaacttgctatgcggttttcgacttttctcgcctcaccagagtacagcacggaagtggagtcatgttttgctttttttttccccgatgctcactgcgtgacggagtccaccaggcactagtggttcagagcgagactcaagggtactatacggagtaattcgcaaccgtatgtccatgttcaattcatacagttgacaggcgctatccgagatgaagacgatcgaagaacaagtcagcgcttgacggttgtaaaccacattggctagtcctagtgtggacgagagaggacacgtccgttagttgcattgatggagccactagcacatggatagagatggacggttgggattgggacacagatagcagtgacgaacttggtaacgttatggggaataggttttgcagggctgcagga

SEQ ID NO: 61518 - DNA, 1362 bp, Oryza sativa
tcagccttctaatcctcgttgtgtagcaatctttcacatgcttgacacacatgaaggtatgatcagcatctaatttgttttatttttctgatttagtatcaccatccaatatgtgacttcaattcttggattttctattaatatttttttagagtaatcactttgacgattcatgaaattgtgaggcgcggttataatctagcacacaaatttgtaaaatatttatttttatatacaaactatatagtgcgtgtgaaccatagccaaaacaactcatggttacaagaaaatttgtgacgatatataacatatataacatattggacttttgatcgacatccccttttcaatgaaaccacaacatgtatgcaatgtttatctccagaacttcattccagctagtactgtttagttattgaataatgacaatgacatgacaatcagaagcatgaagatgatctcgtttttttcttgtaacggtatgggtgcaaactaattgtactattgaataaaggaatctgatcgaatttgccataacccaataattaatcaagtaggatgtcatgtgcactcatcaattgattggtacgtacatatgcattcaatattatacagaattttttccttcagtttctgtagattgctgaagctgtagcctttatctcacaagggaaggtggctcaacaggcacgcagggccatctgatcatggccgaaaatgattggtgttgctgatattgatgaatgtactttcgttcaaggtgagagaagaacgttggaagaatccagttaatggcgcaagtacatactagtagtagatttaattcaaactgctggtctagttaaatacgtactatattcatatttatttaggtgatattttatttaaacatataatagacgcaaatacaaaaacactcgtatacacttatatatttgtccttatgaacactcatgcacaccgtgcttctaactatgagtgtatatcataagaatgataaagttatcgtaggagcctcgttgttgacaagtacattgctaacaacttaaagaacaattaaccgtaaatacgaacaaccatatgtactaagtgtgatacttaaactcgatacacaggttcattataaaggaccttagcaggtaagctagactatttgctttttaaaggttaaatttgatgccaatgtgctttcaaggctgtgttcttttctcctgaagatgccccgtttgtttcttctgcaagggtaggataaaattttggattctcgtggcacgctttttaaactactaaacgatgtgttttgtgcgaaaactttctatatgaaagttgctctaaaatatcatattactccattttttaagt

SEQ ID NO: 61519 - DNA, 1090 bp, Oryza sativa
aatcggctggcgaagtggggcgccaacgtggggtggtggaggggttaaccggcgccgattttcgcggggagagtggggggaaaaggtgaaggaggtggaggggatcgatttcacgcgctcgtggggcggggtggagcgcagaagccgcggcgtcgtgggacgaaaccggcggccatggtggcagtgggcgacgggaggttgggaaagaagatgacaggtggggcctcgggtcccacctatcagggagagagagagaggggaaaacgggcgagggaggtaaagcagacttgagggagagagagagccgagcgggccgagggaggaggccggcccgagggggagagaaaaggggcgcgcgggccgcgggagagaaggaagacttgggccgaaaatggcccaaagagaggaagggggattttaattgtttttctttttatttagttggttaaaatgaacttggtgcttttaaaattatttcttgagctccgaaaattcacggaaaattctagagagtacattagggcacaaagaatattacagaatattcccggccaatgatttttaaaggaaattttaatttcctccataattccacttgattaaattggtttaacttttatttaatttctagaaaatgcattattaaatgattttttttaatcccgaacgaaaatcggggcgttacagaaactgacaagctgtgatgccatattgtgctaactaggcaatgttctgtgctttttgtgtattttggcagactctaagccaactatgcctatctgtgaactttatataatttggcagactctaagccaactttgcctatttgtttagtttctgtaatttggcagactgcttgccaactatgctgtgatgtgtgcttgttctggcagactgtaagccagctaagctatgtggattgttatcatctaaattgagtaactttgctcaaatggtgtgtcataacctaatctgatatgagatggcatttactgagctgatctgatgttatgaactgactcttatcaatttgttatgctaaaattatgtgcaaagttaccaatactcagtcactgttcagccaaccact

SEQ ID NO: 61520 - DNA, 16488 bp, Oryza sativa
ccggcgtgggcgtgcgcgcgaacaggcagaacagcttcagcatgaacagcgcgtgaccgtctgataccaccaaccccggctggttgatccttcacacgcggccgcatcaaactgatgattcttagtccggcttcgtgttgatcttcctgattaattttgttcgtgtgtttttaattattttttgttaatctctatttgttgcagttgcatgccatgcatgcaggctttttttctttcatcgaatcattcagtgttcttgtgtttgtaatctcttgttcttcttcgtgatctcggagatatataaatatatatatagcgattttaactgttattcgttttgcctctcataactgtcagtcatgagagattaatcagcatcagcaataaaattaaagagaccattcatcagagagagaaaaaggagaatgatccataaatgtctatcaagtatatataggggaaagcatagaaaataaacaggagaatgctgtgaataatctgtgatatatatatggtacaaactgcgacactgtgagtgactgagtacagcaatggccggatctcgcctacacagccaacaaatagtagtagtacatgaagactactctctcaaatgacaaatctcaatgccaatttgttgtgacgtcatattgtatcatactattatatgtgttgtgcttattaaaacaccaaaaaaaaaagagctattcctttcatcccaaaataaattaaactagtactaagttaacttattatggaacggaggtagcagtgggcagctgggcatggcctcaactcttctgcaatacggacccttaagcaaatagagcccacatgtcagccacagtaatgcagagaatctcgttccagtggacacacattgacacatactacgtacaacacgtatgtggttttatgtatactactactcccgtatacgtacgtgtatacactagcagtatgcaaaaaaaatactactacgctagatactgatcatatgctcatttgcgaagaaacttccacggccccctggctgctcccatcctgcagaaattcataaaacattcagtaattagatcagtcatgctgcagttaaacttaaaattgcttccaaattatcgagaacaaaatttaaaattcaggctgattttattcagactgcaaaatcacgaacacagtttgcacaagaatgcacatcttagagtgttaatcaattacctccaggtgctagcaaatgctctgacgctcatgtagatggccaaggcgatccagatcccgacgaacccgccgtgcgacgagagaagaaccaagcacgggatcgtcaccgccgctacgccgacctgcaattgaatcgatgcatcgccgcattgtcagttacatggtgtccattttaactttttaaggtttaatcgattcaaaaagtttaattaaggcaaaggttaatgtgttcgtgccatgaagtatgcaccaaaggcgtagtcgaaggcgccagagttgacgccgtccaagacaaaggccagcgtgtttatcgtctgcgtgccggcgacgaactgatcgatttagagacaatcgtcagatatgttcatgagacaattttttacttaatctctgaagataaatctgttcctgcttatgatgaacatctcaccggaacgcctctgtggatggtgctgatgacgccggcgtcgctggtgaaaacgccggcgccgaaccacatgccggcggcgaggaaggccgtcagcccaacgccaaggacaacggcgagctgcagcacgcgggcggtggtcaccgccaccttgtagtgatccttctttgcaaacgcgctggcaagcaaggcctgagattgatcgatcaatttaagccaaattaatcaagcagccatgcatatcatcggaatgtagctaagctaggtagctagctagctagctcacctggccggcgacagcgaggccgtcggcgaggagcgatgaggcgagccagacttgggcgcagatctggaacgccgccatggctgtcgcgccgtggcgcgccgcgagcgacgccgccagcgtcacgcagaacgttacggccaccaccctcgccagcagcagaaaccctgcagcatcacatattcagatcaatcaccactagcttcctcacctctgagatttgctccgataaaaaaaaaatatctcgagataccggtactcatggtatcaaatcgttttcgatcgttggatactccaaaatgattgagtaccgtaaggtaccgtcgtagcgataccgcgagataatttttgttggacccaaacaaatctattcacctttacttcttctactgatctacttggaagggaaaaaaaaagaaaaaacagacactgcacttcactgtccaaaaatgccgtgccatttttctgcttaccgcatccgaggaaacgacgaaacttgagtgattttagactggacgggatgacatcgaccttcctcacgagcttgcacagcattatcagcgtgatcaggtacctgaaatattaggacatatcacacggttaattttgggggaaattagtgttaacattagtggatataacggtctgacaagtgacaagagtgatcgatccttactgagaaatgacatgggcaatggctgcaccgaccacaccaaaacggcaggtgaatatcaggatcggatccagtgcgatgttcgctaggtcgccggtcactgtagaaaacgtaatgataaatcagtcattaatttcattgttagtggtagctaattaatacgagtaggatgttttatacttaccagttgcatataagggtgtcttggtgtccttgaatcctctgaaaacaccttgcattgccagagacagcagcacggccggagcacccagagatctcactaccaggtatcgcagtgcagggatcatcattggtgaaccctgtcattaatcgacacagtaattcaaacaccggatgctaatacagcaataacgaataatcaaaagtaaaagaataaccatttttttcctgtagaaaactgaaaaaaaatgcaggttattttcggggacgcactggattcaccagtggcctttgcatcttaaagagggtgatgagaaagctgtgaagattgggtaccaaaaattgaaagttaccattatgaaattctactcaaaatctagatagagttggagagtattgaattccaagtattgaattgttaattgaaatcttttgttgtgaggcttgttctagatgtgtttgtcgtctatttgtcttctatggtggtgtttgcttttgaacttgtttgtaaccgcgattgtttggtgatgtaatattgtggctatgtatatccttcgaaatgtagaggccggattttatttaaaacatcataaaaaaagaaatctgaaaacgagcagaaatgagtatatatatatatactgaccggcttgacgcccatgatgcgcagcagcggcttgccggcggcaacgaggaatacggcctggagcagaccgaggaacgcgcctacgatcagcgctgacgtcacggacggcacgaatctcctcctgcatttgccgacgccgacgccggcggcggcggccttcttgtcgtcagtagtgcgcaccgccgccgtcgagacctcggcgccattggtttcagctgaatccacacccaccacctgctgcttctccggatccgcgacggcggcggcactggcaccgtggcctttggcgtcgtggccgtcgtcgttgtcgtcgtcggctccggcggcgcccttgctgaggatggcgtcctcctcggcgacgaaggaggtggtgacgctgacgagcgggtagatgcacaccttcatgaccttgttgaacaccgcgatggcgacgcccacggcggcgatctccacggacccgatccggccgatgaacgccgtgtcgatcagcgacgccagcgggtcggccgtcagcgccagcgacgccggcacggcgatgcgcagcacctccgcgccgagctcgtccagcctcagcgcgctcctcgcgttcagcacgaacagatgcagccccgtcctcctcgccccgcccagcaacgatgtcgccgtcggcggcaagtggtcgccattatcgccgccgccgccgccggcagcatcagcattctcggtcgccggtggcgccgccaccgccaccatctgtttctgctgctgctgctcggtcaccggcatgtcgccggaagcagcagctgtcactgtcgctgtcagctggtgatccgcctccatggattcgggagctgatgaactcctcgccatgcaggtgttgcttagctcgtcgatctgcatgtagcataatgagtgccaaattaacaaggactaattatcatcagcaacttgctaatccgaatgaccgtacgcgcagcttacgtgcttgtgctgattaaggatgaaacagcgtgcttagtatcattaataatgtggatgcaaattaacaaggtagagaaagactaaccagggattaatttgagcaagatcacctagaggaaagcagcggttttggagccgtggtgggtggtggccaattggttcactcagctcggcttaaatagatccaaaaatcaggggagtctgtacgtgttcgtgcctgcactagatgtaacccgaccggccgtacgaaattacgaatggagtttgtatctgtggacagtggacacaaggagtggccagcagcaggcagcaagggaagcttgtatggtaatactcccaacctagtgccggatggaagcggatcctttgacctaactgtgtagttgtcactgatatatgaattaatcctactttgttgtggtttatatatcagtaattcaactgcacaacaagtaggtaagaggatctctttccgtgtcggataagatttatcttattagtattgtcggtgacatgggaccggggatatcttgactagaggtttggggcagccgcggtcacccacgtggcctgaccccctcgggggggtcgggcccgagggtgatgaggccgcccctccctctatctccccgaggggtcgggccgctcccgtttcgtccccgagggctggggcgccccgaccccctgagggtttggcgccacgtgtgtgggttagatgagcacagcggcgctcacctaaccgcgtttattgcgggttggacgagcgtctcacgccgcatttaatgcagcgtagcacatgcttatctagtccgtgatcggtcgcagtgtgtgaccggtcacagaccggtcagatcgcgggttagggggcaacaggcggcctgacacacgcctcgccccgtcccgtcggaatgatgagagcctccaggcactcgtccctagccggagccggcgtggggactcctggagttggcacgtcagccccggctagatacattccaggcttcatcgcaaccattgcaaggaagtcattgtatgaagaagggcagacgtgtagcatgctaaactgacacgtggtggacaagaatgaccggtctgtgactggtctgacgccggtcgcgtcatcagcaaacaaccgtgcttccacgttgcacctgcttccggcggagtggaggttggtatgacccatcccatcggagggccattcggacggcagccattgcaaatctccgcccattaatgagggaggacagggttatcccggtgtcagacgaaggtacaagccaagttttggtcaaagtaggatgggtccccacccaaaagaagggtaggtagaaatggtgtatgtggtatccccttgagatataaaaggaggaccatgcctaccaagagggggggactgacggactgacggacggggggaaaagaaaaagaggggactgggaaaaagagtagggagagggtctctagagttcgaactctcttgctctccagctctttgtaactccttcatacacagatccaccagaacacaggagtagggtattacgcttctcagcggcccgaacctgtctacatcgcccgtgtcttgtgcatttactctctcgcgaaccattccacagatcaagggcttagaacctcacttagcgcccccggccgaaccggcaaaggggggcccgcgcggtctcccggtgaggagccccacgctccgtcaagtattaagaatctaaacaggttttatgttccagtagtaggttattatattttgttacgaaaagagtatagtataaggaagctaaatcattcgcatgtgagaccgtaacaaataggactactcatatgcgagtgactcgggcttaattcaaatcagcacaatttggtttagcttttcaacgacacataaagtgagataagacattagcatataattaattataataaactttaaagataaatttatttaaagaaatttatatataaacagtttttgaaaaaaaaaacataatactatttaacaatttgtatagtgtgctaacggaaaatgagaaaattgtagtttagagttgaagaaaataaaatatctcaattgtatgtgcagcaacgagggaggatgatgtgctcaatgtcttttgacaattaatgattagatttaaatactgaagtttcgtattctatttgttttaaaatataaatgattttgattgtatatgacacatcataatactataaaattaaataaaaaacatatttagaatcacattactaagttaaaatcacttatatttttgaaccaagagagtgacgtattgcaaaaatgccgagcagcgcagtcgccatcggcggcaactggtcaccgtcattgccgccgctgccgccggcagcatcagcattctcggtcgccgccgcctttgctaaagcagtacaccgccgccaccaccaccatctgctgttgctactgctactgctcggtcaccggcatatcgccaaaagcagcagctgtcacgcagtggcggagccaggatttcagcaaagggtattcaaagttgaaaaaaaatcttacagaactcaaaaaattggactagcaaaatttaaagtataaataatagcataacaacatagtggcaatgacatgtttaaaggtacaaacagtagcacaaaagtaaagatatctaaattataaatggtttgaatgaattacatgacaaatgaaataaattgtgcaaatcctttgtatctaattttgtgaaatcctttggataaaattgtgcaagcttaaccaagttttccttgtcataagcagcaaatgaatcaataggattgaaggacgccatgcaaagaagcaactttgtgtttacctcatcaaatctatcattaaactctcgaagttgtctatcaatgatgcttataaacataaaacatgtcaacatggaagcgagggaaattcttgacctttttgaataatcttttagatcttccaaccggcttgtagaagccatccatatcaacaactttgatgccatgcttcacacaaaaagaagtggcatatctttcagaaaagattaccattcatcttcatcatcctcacgcaatagctgcaattgcatctttgtattaattagttcaattgcattaccaatatcttgatccctcagctgctcagcgtcggcagtcgccgtcgaggcctcaggtgtgaggcgacgaccggacgacgcctcggccgctcggcggcggcagcggacggcctgggcggctgggcttcggcgatggcgatgctgcgtcgaatcagggacagggagtcagggagatgaggccggtggtgacgcgctaagctgccgagcgctgagccctcgatgcgccatcggccgtcgcgacgtcgcccgtcgttgcggagtggaggcgtggattgggaggagtgagaactggactggggacaccgggacagggagccagcagccagggagatgaggccggtggcgacgcgccgtcgccgagctgccgagcgccgagccctcaatgcgccgtcgcccgtcggcgggagtggaggcatggattgggatttgggaggagtgtggacttgggactagggtttagtctctttttgggccagtagcagtgggcttattcgctggggcaatgtggggaggaatttacgggctgctgctaataagtgggctttttttcatttgagctatacatgctgcactttcctctaactttttacgtatatatgcataacatacctatatataattttttttggtaaaattctatgggtattcacgtgaatacccatgaatcacatgggatccgcccctgctgtcacggttagtcatggattccggagctgatcgaactcctcgccatatgcaggtttgctagctcgtcgacctgcatgcagcataatctgagaattaattatttgacttaagtactgaagtttatcttaccgtattgcaaaaatgtactttccttgagaatacagaacaaaaaaaacatttctatttacttcttttttttgttagtaataaaatggttcggtctgcaaaaactgataaaatacggcaccatcctcacctctagatttaaggtggtacttcaagttttcactgttgtttctggaaaaaaagatttaattcactatttctacgcttacaagacaagtaactacttagaggacggttgagtaaaatttctcttgcattgcctagacaaaataaaaagctataggacggtgcatttacaattcgcaatcgttagataagttgactgctaaatacgagcatatactcaacaaggtagaaaaggaggagacaagcgagtacttggtccttcatgatccgacaatctagtacatcaagtaaatttgaagcaaaacggtagcaaattttaaaccccctttcggctggtcccaacatcgcaagtttgcaactcgacataaagtgcctcacactatttagagcttttgtaaagctttctcccatacataaataaagctagctatatgcgaatttcaaggtgagtgaactagggcaaaatgcatgtacgtacgtactcaacgatggtgcgttgcattattgcagagggacgcagatgaatgaactgaaatcgtagggacttgtgcgatctgctcgtgggccggccggccgtggccgtcatgacgcgtgtcatgcatggtgtgtcgtctaggttgattgattggatcgtaaaattcggatgcatgtatgtacgcatatgcgtgcggagacgaaaggtagaccggtgcggacgtgcggtctctgccttttgacgataagcaaagcgatccagggttaggctgagatgaaaagccagcgaccaaaaagaaaaaaaaataatgatccgaagggagagacttctctcaaaatattttttttaaaaaaattatgagtatgttgaaaattgagtacggaatctaaaaattaaaactacacatctttttatcactgtactattaaagtacataaaaaaaaaacagcgatccgtgcatacgcatatatatggctgacgaaaaagatcagtttctgcggattttcgagacacacggcttggaatcgatcgatttcaaggagagattttcttttctggacaaattcaaatccagaacagtaaattttgatcaaaacttataaaaacatggtccaaatttaggccttaacgtttgtacaaaccttgtaacctgtggtcaaaatttcatttataaaaactaattttgattattttctttttatcgtactccttccgtctctaaatataagtgattttggttggatgtgacacattctagtacaacgaatctgaacataaagcctgtctaggttcgttgtactaggatatgtcacatccaactaaaatgtcttatatttaaagaccgaaggagtagttttttagcattatcctctaaatcgctaagaatgaatatataaaatttttgtttataaattatattatatgtttccaataaaagttactctctccatttcatattataaattattttgtttttttactagttaactttccaagttatagaaaattttagttgtgtgtcctcaaaacaaatatattgttgaaatatattcaatgctagtgttttagaagctactattttgtatacacttaactaaactgtaaaaatgtttagcaaggaaaaaatattataatatgtaatggaagtagtatgattttttaaacaactctgatccacttttaccatccgggttcatggtccggtgcaaggttttatcatggttatcacgtaccgtaatcttttttagttttataaatcacggtatattcacggtaacaggaaggttatcaccgtaaccactaaaccatggttgtcgcccaaaccacctccctgagatgcaaaagtgagcagagcagggcacggcgaccagctgcagctatactgtgactgtgaccagtccactagtggacggagctagagacgacgatcaaaccaaccatgggtgacgtactagtaccagtattaatattactgcagatttgcatagttaatttgtgagatagatacggcggtcgggaggagtatacgtagcagcagctttaccggcgacgacgggaggggaggcaaagctttaccggcgaccgatacgtacggagaggagccacgtggcgagcacgaggagatggaatgccatgctagctacagcaaatctatctatcgcgatgatctagacgattcgattcgatgatgcttccaggtagtctcgctccctagcagcagcaggatcaggcgacgcgttgctgaaccgcgctgagatagcgcctggctcagatcaccgcgccatcagctcaaccaaaagctagagagagaatcataccattgttttttttaattaatatactactccatcagtgagatcaatgaggcggccggcaggtgcttcaggacgaagttaaggttagtacgtagggcaatcacaactcatagtgtctataagcagtgtttatggtgccatgtcaataaaacatcataataaaaactgcactctataacccatgatttcttaaagtggaccattaataaatacatcatctctcttttctaccaattatatttattcttcatctattatgaagacactattctctcctaatgcaaagcttgatagtgtctagtgcataggttctcgtgttgaagctgtgtcttgcatgagacccagtttcttcctctcttcactctctctcttaattaatatagtgccacataagttaaaagtcctacatgtcaatatagttaattccatagacaccatcataggtggagggttgggactgcccttaggtaattcaaaagaaaaaacactctactaattaacataccaagcgaatctagaatgtaaattgagaggtgctactgtaaaaatgtaatatgattaatgcaaataaagatatatcaacaaaagtgttttccaataaaaaccagatgcgcatatgatcaaaagaactttctcatttatggctatattaaaatgttcaaaaatatcagtgaatatattgttttgtatactcgaagtaagctatgttttatcagtttggtagtagaagcagtgaggcagcctgcaaccttgctatccggggaatttcttcactaataattacttcctccattttatattataaaattttctagtattacacatattcatatacatgttaattgatctagacatatcattaacatctatatgaatatggacaatgctaaaaagtcttagaatatgaaacggatagagtaattagattagttaatgactaattagagacaggaatggatccgctactgctaccaatttctctccttgcttgatcgaggaacggaattcaggcagcagatcagcgcgtcgcagcgccaggaaacgcagacgataatcacagacatgcataatacaaaatcacaatgcactatacagtaagtaagattttaacgttcgttcggggatgtagctcagatggtagagcgctcgcttagcatgcgagaggtacggggatcgataccccgcatctccactataacctccaattttctcttttgcttcgagtcgagggattagtgtcttttttttttatttgttgggctttttcacacactcgtttgttttccaagcccatcatgctgatctgctacacgttgtacttctgggccggatactgctcggcccaccatgccttgcaaccgcagtcccaaacagaagtgggccgtcacgtccaaaattccctaatcaaaagccacccgggttctcctctgttcggtcgggaaaggaataagttcaccggaggtccctcaaattgacaccgagattttttaaggtccctaaactagaataccagaaatgtgtacccctaaaattactaaatctgtccgtagaaggtccctcagcagtattgactcagtttttgcccggttagcaataacatgtttctctaaatccgaacaaatgaaaactctatgcaccaaatatattcctctatcattatatttgctaaagatatgaaaaatagcattagttggacatggcaaatcagacttagcaaataatttctccttcaaattatcgagctcacaaaaatcatcaaactgaacatagcccaaagtatttaaagaagatagcaatttacgttcctcaacttcattagcaatgtgaacagcatgcttaaaatcagcacacaaagaaatactagaaatagcatgttcattcactagttgtgtcatggatataagtgaagcattatcacacaactcttctttatcataaggaacagcgagtaaatcaacttgtgacaaagaaattccagcatttggttccactaacggttgcactactttagcatgaaaagtggacaaatttacttcgttaacaacgcactcaccttgattaatttcagtaccatttactttacctttgatgtcctcttcagatgatggaggtgcctcgactttgagtgtgaacaatgggattggcggctctttcatgtctctctcctccttttcatgattatgcacttcctgcaaatgattagtaatagaagacaaaaacatagcatgttgcttcttcatgtcctactctattttactttcagcattgcaagcaagttataacaaatgagaaagagatgtatatctttgacaatcaagcatgtcctgaatttccttgttaagcccacgtaaaaacctcaattctttagcttcttcgcattcatctaaaccacaacgtaataaacaagcttgcatatcatgatagtatgaagtaacagttatggtatcttgttttaaacattgcagtttgttgagcagaatatcagcataatacatgggaacataaacatctctaaaatatcgtttcagatctttccaagattgtggtattttgttatgcctacaaagatgtttctaatcattagaagcatgtttaactaaaacactagaggcacacataaccttttgtttctcagacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatgttgcgtatccctgccattgttagtagaaaataagaaacatacacaaaaatatgtgcatccctattaactactaggtagtgtaggttcaaatttcacacacactcaagcttttaactgagctcttacaaattcttaccaaagcaagcggaatggtgacgtacaccgactcaaccaagcaccccaatggaggttggatgtatcgatgccttagcaaacacttgctgtacggctgcagtcaaatctgtatagctctgggtaggctaaagtatgtagcaaaggaatagcaaatgctcaaatcagagaatgcaaagttgaatgatcgttcaaagtcaagtaacgtactggtcctaggctagaacgtactagaaacgcgagcctagacacaaacgataccacaagatagcactaggaacaactcatgcacaactttgatatatgaagttcagctcaaacataacagtattttctcttttatttctttcttctttcttcttttcttttttttctttccttttcttttctgtttttttgtgcggcttttttttcttttcttttttatgcacctttttgcctttttttttctcactttttcttgattttttttaacaaaaactgactcaaggaccttaatgtaaggttacagggactcaaacataaatataaaatttacagggactcaaatgtaaaagtctaaacccaaaattaaaattatacaaaaatggaatgctgaatttatgccggttccgtttttccaaacagatctcgaaaccgacaccaaacaaaaattcaccaaggtgtttgacacaactcggaaccgtgaaagggagggagggagtcggactcggccaaaggggcgagtgggagtcagccaggaggtggagtggatggtagccgataattaggatttggtgtatgggataaaaaggaaactgatttttaactaatccaatctattatatctttccaaaacaaacttgactacttccaaaatcagatatggtaattcaccttcctcctctcatgcacgacacaagcacggccaaaacagaagcacggcagtcagcaaacccaagatgcaactcaacaactccaaatccaaccggtagaaacttttgaaaactacaaaaatagaatcgtggcagcaagccgattccgttttcgtaggtcccgacgataacagagacacggaggcgacgacgactctggtataaaacgtgaccagaactcgaaactctaaacgaactagacgctaagaccaacaacacgacgagacgatgcaacacaaaattcaacaaagcaaaaactgaaaagaacaatgcaatggcacaatatggctaggtaaatgatacggattttttttgtatggctattttctggttatcggaagataaaaactcaccgagtaacgaaagctctgataccacctgatgaaccctgagttcctctcaacactcaaggttgttgttggcccaatctttcagtgagttgtgataactacgatttgggagaaacgttgacgatccaactacaaccgtacgagacattgtgatgcgccttagcaatcgatagacctctccgtgggttgttgatcttgccggtgcagatcaaccctattcctgcaagcaaatcgaagaaacaagtaagaccaagataaaagcaatctgatattgcaaataggaatttaatacaaatgataagttggggttccgcagaacaagcagacgggcgatctagctgacacgcgcgctgcaagcaagtagcaatggctaaattttaatctatcaaaacccaagaaaccctgaaggggtacctagctatataaataggggtggggggacgacctaggggtgcctagggtcgtactccacctgtttggggcgcaccccacatgggccccacctaggccggggtcccaaatgaagttacaagcccataggcccattataggtgacgcaacaccttgtgcctgtgattccagccacacgagatggaattcggagatgaggctggatccgttggaaagagggctccaaaagctttccatcaagtactcacgggccgaaaacggaggtcgtatgcagattcggtggccgtttgaagtcagcagtgtagcaggtggccgaataggattccggcacttgcaggactcgaacttgatatcttgttgttcatccatgatgtgagcaacggatgtatccgtagtagccatggtcacatcaaggtccctcggcagtattgactcagtttttgcccggttttgctgacgtgtcgcgctgtgggacccactgatcagtccaccgttggggagttaatagacggggttaatggaggggagcgcagctagccagacctccattctctctcctttgctcgaaccctagctgagcggcgaccaggaggcgacttgaaggcgacggcgggtttgtcggcggcggcgagctggccgtggcgccggcgacaagcatcgttttcgtccaaatgcgcggcggattccaccccggttagtaccttgttggctcggcattgcatgctattgtagctggtactatgttgattttgggggaagatttaaaatgtggtagattcgttttttgtctgggattcggtgtagaggtcaagtagtatattgtcccatatgctttaggtgtagtaatgtttttgtatacccatgtgaatctgggtggtccttttttaattggtgttaggtgttaactaggtattagggatatggatgtagtgtagttttaatagtagagtagtaaagtgcttctttttttatttttttagagctggcagcatggaacccttgggcactctagcagttaggttccatttcaatggggaatttgtcaatagaggggagacaaaagttgtattgtggggggagagaagcaatgtcatccatagacagtg

SEQ ID NO: 61521 - DNA, 1202 bp, Oryza sativa
attatcgatgatgtggcttaacctggatgcttctttatagtgttaatgcttgtagggggtaccaactatataggaagaagggattgtctttgttgtcctcctttgacatgtcaataaaaacttcatttattacataaaatatggttaatgcatgccggtgttgaaattctactagtttaattcttctaaactttgccattctttagaatgcttttacgaaaagaacatccgatttagtagctgtgtcaagtaaaatattttaagtcactgcaaattagctttgggatacatcatcaaattaacacagttatgctaatctgtgtactttttattgaatgtaatctcacaatacgatgaaaatacctagctaggtttatactgtagctaatttcaatgtcaggacattgataattgcatattcatacaaaaatatatatagtaaaaaaacaagacccattttgaaaccaaaaccaacagcagaaattcatgaccagttcatgcagatatatatacctgggtttcagaaagtgcattgttggaatcttgagcattgtagcaacaatgttggtacctttctaaagtctttgttatgctgcacaaaaatgttatatgtaaatttctcatatatcaaattactacgacgtaaaaagtgcatagatgttatttatagaggcagaagcttatattataatgatatcaaaggtcactctatatttactatttcttttcgtccaacaaaatgatcatgttttttttggcaaaacatagtatgtaagaacgtaaaaaaaaaacatagaaatgttacttgtagagccagaagcttatattataactcttgatttatgacatagataatttttttcatccaacaaactgatcacatgtgttttgataaaacatgcagtcagctttcatcgttgaagtggctttgtgtgagatatcacgaagtgactttgtgttgcatttatagattgataaaattattggttacaataactaggttttactacctccgccctaaattagtggttgctttaactttttcttgtaacatttgaccattcatcttatttgaaaaattagtgcacttataaaaaaagataagtcatatttgacatacttttgataataaagtaaatcacaaacaaaataaataataatacgataatttttttaaataagataaataaccaaacgttaaa

SEQ ID NO: 61522 - DNA, 600 bp, Oryza sativa
cccaatggaaaggtaaaacatcacttgcagtaatctattgttggtcaatacagaaatattactttgaacttagcatggtattgccttatatatgttcaacaagtgtttatttgcatagctatgacgcagtggaactgaattctgtgcttgatcgcaggtacttgcagtgaagaagatagacagtgcgtcactttccttgtatgaagaagataactttcttgaggttgtgtcgagcatttcacgacttaggcacccaaacattgtgccgcttgcaggctattgtgttgaacatggacaaaggcttcttgtgtatgagcacattggaaatgggacactgcatgatatattgcattttttcgatgatacaagcaagatccttacatggaaccaccgcatgaggatagcactaggcaccgcgcgagctttagagtatgttattatttgagcactctagtgtttttcactctatgaaaaggttatgttaatcaagtataatgctacaatgcaatgccaacctttcttcagatacctgcatgaggtgtgcttgccccctgttgtacatagaaacttaaagtcagcgaatatcctgcttgatataga

SEQ ID NO: 61523 - DNA, 3738 bp, Oryza sativa
atccccggcaagtgaatagcagagtcctattcagaaaggattgggtttatactatatcgtgtgtggtccatagtatccgagttctacttgaagactaaggtgattcacggtataaaaggcataccccctgaggggtctggaggagggaatcagagagccagcaccaccaccatagtctacaatccggaggacgtgaagcctattcgccaggagatctcgacgaaaccatcttgtcgatctcaccagtaatctccaaaccatgttttttgaaattctttttggccagagggttggtaattggaatccaagcaattttgaaataaattgtgtagcgagatttataattttggatatggattatgtggataaagatgcatgtagaatccaacccatatttttaaaagtttttgcccagagggttggtaattcggatacaaaccaatttgaaatgaattgtgtaatgaaatttataattatgaatagtaaggaaaaaaagtcccatttatatatgttctcctgtttataatatgccgtagcattttttttcataggaatggaaaattgtctctttttttatcttcatttctataccaaatttgacctttatttgtggatatatagcatgtgtaacaacatatcaatgttatctaaaatccacataatctgtttatgcttttgtatcgcactcactttttcatgacgaatagattttcaggaatgtctaaattacttttttgtcgttgtatttgtgcaacactcatttttttatgtcacatgccggtgcgatgcaacggtacaatggttttcacttggttcgcttttttttttctatatttttttctcactatcatcagttttattaggagagcagcttgtttccgtggaaaagaaagtgtgcaatatataagagggtgggaggaggactactcccttttaagtagcagagataaatttccgaaatattaaaatatattagtcatcatttgtgtcacactcacctcttacggcaaaaaaaaaaaacatggaatgtataaagagaaaaccttttggtcgtccttttagccacactcacttttttacaatgattaaattcatgaaatatagctaatgcttttttttcgctgcgctcactttttttggtaaatagtttatttaatattaagaaacactcacttccctcttgctcctgctagtttggcagcacgggagtacgagacggatgtgacgtgtctttgtggtgacaagtagtggcattgagcggtatggctgacagtgatgactgacgacgaataagagtgttggcatcgggcgactgtggagcctataccaccaagtggacatggtggtgacgacgtgcagcgacagatcgggcggtgctggatggcagcgggggctaagcctctgcccctcactctgccaccggtggcgaactggcgacgatgtgttagtttgcggaggatggtggtggcccagttcagtgggtggcgatgcattagggacgtccggactgcacgacacatctgagatccgatgtggtggggatggtgcagcaacagatagcgtggactagttccacttctcccctcctgtcttgttgtgttgcaccgaacaagaaaaaatcgtcgatggagaacgaagcttagtcttctagttcttccttttgtgtttgtatgttttcctcggtattaaggtttagagtcaaagaactcgtgtatcttttggctgcgtatatcctcaatattgaggtatactcgctccgtcccaaaaagactcaattcctgggttttcgtgtcctacgtttgactgttcgtcttatatgatttttttaattagtattttcattgttgttaaatgataaaacataaataatactttatgtgtgacttatttttttaatttttttttcataattttttcaaataaaacggacagtcaaatgttggacacaaaaactcaggaattgagttattttgggacggagggagtacatgccagattaatgaaaatatattttctaaaaaaaaaaagaaacacgagcatatagtgtaccccttgtggtgctttatcatttaattatagcaaactaagtacagtcactgtgtagtcgtcctgcttcttgggacaactggtctgcagcgagctacaaaagcaagagcgcatgactatacttctgttggatgatttggaaggagaggaatgtgagagtgttccaacttccaagtagaatctcgtcaggcgccgggggtcgcagaattcatcaatcatcaatgagtagtggacatggaggatggcaggctgaggcgccggggtttacatttcgttttcgaagtgaaaatcattttcgtctggtttactgaaaaccgaagaccagcattttcatataaaaacttttttgtgaaccctgagcgagcttagatgcatagagcagtctctgtgtagtccccttgtgtggcatcgcgttgatgcatcttaggtttttccgttcttagcgtgctttgtttaggacaccgcttgcggtcccaagacgtttcaaacttgctgagcatctgtaaaatgtttttactccccccccccctccttaataaaatttattaagcttgcgtaattttgttcaagactcgttaattcaacttaatcgtcacgaacgcgcgtgccagagccatataacttattagtaccataaaaaaacaaatatagaaccaatatgacatattctaatactacgaatttagacatatgtatgtctagattcatagcatagaatgtgtcgcatcgtatactagattggttttttttagagatggagggagtacttgcatattattcacgtgaaaacgctacctaaaaatgtacccgcacatacccactccgtaaaaaaaaaaacccaacctaaaaagagatgtgatccatcctaatacaacgaatcaacagactaagagcctagattgagatttttttttgggacggagggagtactgcatatgtatcaatatactatactctactacttcttcctttccaaaatatgagggattttggagagtgtggcacatcataatactaagaatctgaatagagagtaagcccaaattcataatactataatgtgtcatatctcttcgaaatctcttactttctccgtcctaaaatataaggtattttacatggatgtgtgtacagatttattatgccaggatgttttacatccatttaaaatcctttatatcctaggaggatggagtacaatgttttaggacctagggagtaacaaacaagctacatgacatgacagttcagattcgaatgctctcaactgaatattccatcgaaaataaaaagaaggtttgcgcctgatcagtcgcgcgccggcgcaacaggggccggcagcaacggacggcgatgcgtttgtcccgtcccgtgcaaatgtgtgcagtggcagtgcaagcattttatcgatcgacgcgcgcatccaagtggtggtggtcgagctagcttgttggcggatgcgaacgtgagagaggcgggccgctcttgtctgcacagatgcatgcacgcgacgcgcacggcgtgttgttgccatgggggaggaggattgggtggttacggggaggattgcgcggtgacgcagcgcatccacaaatatacgtgcaatatatatttaagttctatttttataaggattttactactctacgttatttgttaatgtgcttagtcaatagacagcgtagagataaa

SEQ ID NO: 61524 - DNA, 730 bp, Oryza sativa
tcctgcgccccagtaaccattttagaaacaaactattgaaaataaggaaaccaaaagaagccttagcttttcgcaagtagttttgaacttagtatccttagggtcgtcctaaacgtcgggtttcgccctagggccaagcctgtgctctgataccatctcttgtcacgccccgaactataccgaccggaactagcccgcgacgctccaaattaacctgttagttgataccagtcccaagaaacagtgctggtatcacaggaagacagattatcacagcaacagaggtctctttattatagagtagaggtacagtcatgttgggctgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcatcagcaggatccacttcatcttcttcagcaactgggggggattatttatatagagcaagggtgagtacaggagtactcagcaagccatgggaaataagtgtttaatgcaggctacaaagaaagggctgctgtttttgcaattgattttatttgaactcttttctgaaaacaacttagtgagtgcttctcaaacgacacggatgagacagtgcgtctcgtccggtcggagtatgtgcaatgtatcagtctttagaattggccaa

SEQ ID NO: 61525 - DNA, 4264 bp, Oryza sativa
atgctgaggagcccattgtaattgatgttgatgaagaggaacacaatgagtatgaggctgaaatgaagttggatttggatgaagaatcagaggaagatggagatgaggataaggatggggatagaaaggttaaagtgaaagataaggacaaagctattgtggacaaagggaagggcaaagctgttgtgggtgctggtgaaggtaaagcaatggaagtggatgaaagtgctagtgataggaggattgtcatttatagggaaaggtcacctttgagggaaaatgcacctatgagggagaactcaccttatagggatacctcacccataaacactgtcctgccttctgacagtgaggatgatagtgattatgtaggaggagatgattgcccttctgaggatgatgaagaggctagggagatagaaagacactacaaagagttgaagaggaatatgagagctggaaaggttcatgagctagatgaagttgtgtttgaggggtttaaaagtcagtcagctagaactgctggaggtccagaagatggcaatgacaccccatatgcagatagtgatgatgaagactcctatgatgaggttggcagtgatggtgagcttgtcagaagaaagggcaagtttccaaggtttcagaagcagccaggggttcctgtttttgagctaggaatgaagttcagctctaagcatcagttcaagaagaccattataaaatatgccctggctgaaaggaaagtgattaattttattaaagatgatcgtgtgattgggctagctgtccttgggtgtgtttgctgtctaagactacaagaagtgatagttggcaaattgccacttatgacagtatgcatgcatgcccaccaaggagggacagtagacatgtttcatctgttaggatagcaaaaaaatatggcaagttcattgttgctaaccctggttggccactatcccatatgaaagcaacagttcaagaagagatgtttgctgatgcatcaatttccaagcttaagagggccaaaagacttgtgatgcagaaggcatttgatgtgaccaagggccagtaccagaagctttacaattatcaacaagaactgcttaggaccaaccctgggagcactgtggtgatcaacagagtgataggtattgaaccacctgtgttcaaaagaatttacatttgccttgatggatgcaagaaagggtttatggctggttgcaggaaggtaatagggcttgatggttgctttttcaagggatctacaaatggagagctattgtgtgctatagggagggatgccaataatcagatgtacccaatagcttgggcagtggtctataaagagaacaatgaagaatgggattggttttgtgacttgctgtgcagtgatctgaaggttggtgatggaagtggatgggtcttcatctctgacgagcagaaggtaatgctcatgatccactgtttgcttttatgttctgtcatttctgtcattacagaatgcatacctaatgtcttgtgcatgttactgtcaaatgcagggaataattaaagctgtctctaagtgggctctagaagctgaacacaggaactgtgccaggcatatctatgccaattggaagaggcacttcaatgataaagagtttcaaaaaaaaaattctggaagtgtgccaaagcatcatgcagaatgcttttcaacttggcaagagcaaagctagcccaactgacccctgctggagctcaagcaatattgaacacacacccagagcattagagtagggcttggttcaggttaggatctaattgtgactctgttgataacaacatttgtgaatctttcaacaaatggattcttgaggctagattctttcctatcataacaatgcttgaaaccattagaaggaaagtaatggttaggatccatgaccaaagaaaatgttctgatagatggagtactgtcatttgccctggtatacttaagaaacttaatgtgtacattgctgaatctgcattctgccatgctgtatgcaatggggctgacagttttgaagtcaagcataatgagcataggttcacagttaacctagatatgaaggagtgctcatgcagatattggcaattgtcaggtttgccatgtcctcattgaattgcttgcatctactataggaccaacacactagatgggtgggttgctccatgctattcagtggaatctttcaaaaaaaacctatgcccattgcctgcagccagtagagggcatgactagttggccagatgatcctagagagcctctcaatgccccaggatacataaagatgccagggaggtctaagactgaaaggagaagggagcctaatgagccagctaaacctaccaaagcttccaaatttggcacaattatgaggtgcagatcatgcaagcaacctggtcacaacagcaagggctgtcacaagcacagtggggcaggtggtagcacatctgctccaggaaatacagtcactgcaaataacaacttagtgttgtcaagcacacctagcagcattgcacaaagcaggaaaaggaagtcagctgagctcagtactagcacatctgcttgccacactaggaagagaacaactcctacaaaaaaggtatgtcagccagtccttattcaattaaacttttgaaattaacattcatttgctaacaacactttgtttcttttccttctagtcagcaaacacaaacatttcacttgtgaaggttgcagccagtgctagggtggcaactgaaaaaggtggttcagccagtgtgaaccttcaggccatagtgccacactctcaatgttcttcttctgcttcagtgaggatcacttctgggaaagcaagtgtttatgtgcaagctcaagaaccagccactaccaatcccaagaaaacacctgtaggtccactgatgctgattcccctatgggaaactgtcacgcccagaaatttaacccaaatttccagactattttgcgttttaaatccctgtccaggaccagccagggtacacaaaacgacaagtaatatacagttccaaacgtaaataaagcgtaaaatacttacggaagaggcacttagtcctcacaccgaaacagaacgacagcagcgaaaaaaggcgatcctagcggggcttcagctctactccacaggcaaaactcaactggggtctgagccttggtcctctaactccatcttcagctcagaagcactacacttctgaaaatggggaataaaagcaagactgagtacaaccaccgtactcagcaagccacaccaacgatgcagtcccctctcgtgcctaggtgaatccggaagcgacagaggccgtcgcagggcccgccctgctccatcacgcccacccttgcctggatgcgtcgactagaggaaagctacactacaagcccagccgttgcccacgctggcttgtggtaagtacgataagttcttctagggcatcccgcgaaccggtccttaactgccatgggtgcaaccagcaaaaccatgcacccatagcccaccattcagtcgtattttagttggataattacgaccacgaagcatggccagatgtctcgagcacgcagctcaacaagatactagaatgtctaatactgcaattatcccatcgactgagctagtggtaattaagcatggctaagcatatagttctagctaggtcacataagtaacatgagctagtcgatttattacccaatgttgacaaaggacatatatcaagtaaacatgacacaagcgagcagataggtaaaaccctgaccccatgtaattagcaaaatatgcatatttatttgcaaacagtaaaacatttgtaaattgggatcaacatgctcaaggggaatgtgtgacttgtcttgcttcttcaaacaatcttccgaactcttatccttgcgaccgtgatcttccgaaacgacggattctacacgcaggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttccagaattattaacgaattattgtgcaattgttaattattttatcaaaggaaaaggctcctgctggcgtcatcaaagggtagcggggccgacaggcgggccccacacgacagcgggcaagggag

SEQ ID NO: 61526 - DNA, 1081 bp, Oryza sativa
  unsure (1)..(1081): unsure at all n locations
aagaaggccacactaggaggctaggagaggcatcgccttaagtcggtggtgataatggacgatgacggaagatgacgatgtagtagtttggagcaaggcatacttgggctaggggagggtgggtaaggtggcactaggtgcccgggggatgtggcgcttgagttagcgatgatgatggactacaacaacggtggcgctgggacaaggcgagctagaggaagtgcgtgtgagtcacgtcttctcgcaaaggtgataaaggagagagaaagagaggatcagcatgggacccatgaatggccattgattatggctggcaattttgaacatcaaagggaggcatttggccaactggttggcaagtattttggaggttgattttttgatatttgctaaaatttagcttggagagccatctagtgagtctcttagtgttgctctaaggatttaatcaaggaacctacaataattctatagtgtaatgaaatctcaataccttgacgaataagatttacacacgttgggggtcttgtgctacacctaagataaaaacttgaatcaagtatttcccctccactagcatgatctctgctgagtggtttggatcttgacacttcactatataaagcatcgcttgtcgacccagactaaccataatactccctcttgccgcttcccccttcttccttcattgcctcccctatttcgtgcgatgccttcaaactccaccatatataccgacgagtcctatcggcttccttcgttactgccaatcctctctctagccctcatacttttcataggagactagcgacaataagattgttatgcccttgttacacatgtttaagtcgtttgtgctcgtcacctcaacctcccctgcctctagggggtggtggcgagggttgctagtgaagttgggcgtggtactatcatggaaaccaaatntttttccaactcgacgaaggtgagaaggggcacaaatcttcatgcacatggaaggtaactgttaatagcaagattttgttcttaaaaaactatatgtgtataggaaacgaaaacattagttgtgttagtgtcaagc

SEQ ID NO: 61527 - DNA, 835 bp, Oryza sativa
  unsure (1)..(835): unsure at all n locations
cgacagtcgcgtctgttgtgcgcgaatcgtgtttacgcctttcctcccttttcgtccagccgctgnnnntggattgacttnctacattnaatgctttttcctctctnnnnntnnnccccgcgtgngttttgttgacnaccntctnnnnnnnnnnnnnnnnnnnnnnnnnnnnnnnnnnnnnnnnnnnnnnnnnnnnnnnntttacattgagaacaaagctttgcgtaccctcgcaaaataatagctttaccaattacgacaggatatttactccatgaaaataatcaggtattcccaccgattcagttcaaaacttctgaaaaaaatgtaaatgtagatcatgccacactaatctatttgagcaaaaacttgtagaagattggaaaattatgtctttgttgtatcacacacataatatcatattttgtataaattacttgtcagcatatatatattttttagaattttctaaattccacaagtgcaaattagcagaagttgcaaacaaaactccaccaaaattttgaacatgatgagatcagacttcaattggaaaattcatcatgtgactcctgacagtgttcctgtgcaggtgcagctcctctggagagtggtcagaaagatgaatgagaatgctgactcaatagaatccctagcaaatggtgctgagaaaagggttgaatctctgagttcagaagtcaaaaaggtattatgtaactgatcagttgaatctttaatagagtaatatctactttccttcagacaaggtcggaaatttgttaagttattttatccttcttcgtcatcagataaacagaatcatgctctgtaggat

SEQ ID NO: 61528 - DNA, 651 bp, Oryza sativa
ctcaagcgattcagctactttctccagggccaaacacctgatatcaccaagctcttgtctgcatgtagggcaacggttgtgcaccctagctttgcaggtggaacacagagtgtgtccattttggcactgcaatgaaattcaaagagatgagaatcatatccaaagatcagaagttcagaactacataatgagactcttcaggtttacaccactagatcaatctgacacaacgaattgggaaagggagtgtatggttagaattgcttattgaaattcagcccatgtattctctaaggatcttcgaatgatccatttttaggttaattaagttctatacttctacccaacatatatacttcacaagtaccgtcgtcttccttcccttttataacttgtgctaaaagggaaaactcaccatggctaaatgttaaaggtactactattttttataaattctgctaaagataaaccgaatgacctgaaggcatgattattttggcagctcattccagattataatagatattagccatctaattctaacagttgatcattcgcaagattcaacattcctgcttcttcttaggcatcgactatatgtcaaaaaggagctctataattactagaaaaataatgcaggaattgaacaat

SEQ ID NO: 61529 - DNA, 1078 bp, Oryza sativa
ttaaatggtcactttatgtgttaactgtgaattttatccaggtctataaagtactatagatgttaatatatttctctataaacttgatcgaatgagagaagttttgacttaggacaaaactaaaagaccttgaattatggaaaggagggggtatttctagcttatgtttcttttttctgttaatgctcattaacatctggtagcccctataataatcaagggttaattggatctatgccattataagaatcatgtatttaccatgatatcaagaatatatgttctttttgtacttgcagaattataatcttgcttttgttgttgctccacaggctataataattgattgtgatgaagatgatacggatgacgtgatggaggttgttcctttgaaagtaagggcagtgctgctttagttagcgggtggaattttgtcactcgagaagacatccccttgttttgtgcatgttgttcaaaaagtcataaaaaattgaaaacataagatagatcaatatgtaaaatatctcttcacaaacatgcaagttcaaattcgacctatacaagtagaaaaacaaaaacaataaatttgattacaaatagtgtgttttgttctatcgtgtcacatattgatctataatgtcaaatcttcttaaacttttttatgatgttttgggcgacatgcacaaaacaaggggatgtctcctcaagggacaaatagacttttccctttatatgattatctgtttacaatggtgtaagtttatatgatataaactacatgtgctctatttagagcatccctgtcaatgatgctacatcattgatagcactctatgtagcaacaatattttcaattgcacaaactcacaatatctgtcctccttgttatctcataacttcatttattaattctcatctcaaaaacaacttattgattaagtgttctgatttttcttggatttcttactgtgcaagatgctgatgccaaaggaggtggaaaatgagcaaagaacggttcctggcattcctcaaacatgcaatacccagaacactagcaatggacgcactaacaccactg

SEQ ID NO: 61530 - DNA, 655 bp, Oryza sativa
cctctcctaaagaggtgggcctggaaatgatacgtgtggtattgggcctgaagcccagaaaacacccaggaaggcccaaacaaaatcgctgaccaaacaccgatcactcaatctggaccgctcaaagacaatcgaacggcggcacaccgccaccgcggccgttccccgtgcctagcgccgtccaccggccgccggcgcgcagcagaacaccagccggcggtggcgacgacagccacggcggcggtgcgtggctggacgaggcgagcgtgccggcgccgccggccggcggcgagcctgggaaatcaaatgtcagctgccatgcgagtgtgactgacagtttctgttcgtgcaactgatggaattcagaggagagaagagacagcgttttttttatcttgatgacttttaaattctatgaagattccacgagaaccaaatgaaatgagaacaaatttagtaagtattggtggttcgttaggttggtgatagtatatgcagagtttcagcacaagacaagaatcaactgaacaggaacactataggaccattatattgatcataatgcagtgtttcctggacctagcaatcggcagggacaagttcttttgtttattaatttaaatatgttaggatgttggatataagcggttccatg

SEQ ID NO: 61531 - DNA, 630 bp, Oryza sativa
gcgtagacgaagaatcctgaaaaatcttccaagatcagggaccccaacgtcctcctattcttttcgggtctgcaaactgttttccaattggaccaagcagctgccagataaagtgtgatctgggtctttcacctttccaaaaaaaagaaccttcgaaagcggtcgatcctcttgaaaacccatttgggcatgtgcagagatgaaaggtggtgaattggcatggagctaaggaccgtttttaccaacgtctcgcgccccgaagaagtgaagaatcgacctttccaagtgggaagcctttcccctattttttcaatgagggggagaaaatcaattttctttaattttcgataatgaagtggaaggccaagatatttgcaggggaaagatttaacgatgccggggaaagcttgcagcaaagaagcaaggtctacctcttcacacctaatagggaaaatctctgtcttggcaccgtttgtatgcagaccggacactggcgaaaacaattaacagctaggtaaaaatgttaagctcagaaatgttcggctttgcaaacactgcaacgtcatcggcatataacgagcatcgaaatctgacccgatttctatcaatcggggaaagtatggaggtatt

SEQ ID NO: 61532 - DNA, 606 bp, Oryza sativa
  unsure (1)..(606): unsure at all n locations
aggatggggnacgtagaacgtacggccccgccacatgagaagaaaccatcccgcacccttatcgtagattgcaccaatcatacgttttttatggtgtcctagcacaacatgaattagggtgagggcccttcattgtaatgaggatgagcataatatatccctgaaatgtgcatcaaggtgatcatctcatggatattatgattacagattcaaaaaataatgggcgaatcatgaaggatgaactgcaaaattcacgaatatatggtcaagggcataaggatactaaaaatagacacagcgctctgtatacccaggtgaatacgagaaggatatcataagtggaacatgccatgagaaactaccaagtctataacaccacattaatattacttcttgaacatgcatgtgattaaccgcgcactatcatgttaaaatagaaacctgacattgcaatacatttacctaaaaaagtacatcaagcctaaattcaaattaagactcatgaatgtgctatcatatgagagaaataactttgatgtggacgaatattgcaaatacaaacggtctatatacatgtgcacatggatctagaatgagatcatatga

SEQ ID NO: 61533 - DNA, 698 bp, Oryza sativa
aggtttctgcacttcctaggttgatcgtaacattgttgttactagtctcactagtgttatgcagggggtatgattagtttataatttctaggtgttcctgtcaagcttaagaatatcgaatatgcgcttatattttataatctaaagttttactggtattggttgtcgtaggcctttagcatgtgtagatagtgattgattgaagaatgcaaaagttcagacgacttccacctgttctgctgcagcttgtttgatcactatcatgcatccctgttggctttcgtatggattgcgtttgccctctgaaactaggaagcttaatgtgtgttacgctgttactgtttgagtagttggataatgaatcccatggtagcactatttgcactccggtttagacatagtgattaaaatggaatttctccaaaactagatctggcccattgcaataagtagaattcacattgaacattaaaactttgcagctaagtttgactatgggacatgtctaatgtatcttctaccctttatctgctttaccatgcaggtggcactttcagattgcctatgctagttcatttcacgctgcatatccaaaatggtgaagctgacaatgatagcacgtgtctctgccaccttccgttagtggagggattagatgatggtcgggatctgaaggatgctgacttctacaatgatga

SEQ ID NO: 61534 - DNA, 1061 bp, Oryza sativa
tctattcatcatcagccatgccaaaatttaaattttaaagcttaattttgaagatgaatttgaagtttcttcatcaaagtttattttttagcattggcatttaagtcgctaagaacatatatataaaaattttcccaacaatttactgtattattattttgctaatatgccatatggcatattatccgtattatccttaggttctgcgaagacaaatggttgggaaatgtaaccctgcgagaacagtactcgttcctctacaacattgtcaggcacaaacatgcaactatcgaagatgtctttcaaaatggatatcccaattttcatggagaagggatcaaattggatcgaagttagtcacatggaacaccttatcaccacacatcgctaatattggtttaatttaggagcaagatgagtttccatggaagatgacccctaatggacagctccatatggagtctcattatcatctctagtttatagtgacatctcgaatataaatagacgcccttggaaactaaatatgccattgaaggttaagattttcctttggtaccttcatcgtaaagttgtgttaacccaagacaatctagctaaacataattagcaaggcgatcaaaactgttgtttatgtaataataaggatacaattaaacacattttctttgaatgcctcttagcccatttagtttggtccatcatttttgtggcgtcaagaattactccacccgatagtgtttcacaagtggtcactagttggctttcgggttttcaaaaagatatgtaaccatatgtcctgttaggggcgactgccacatgctagttgctttggttacgtaagaactatatagtttttgatagaaaagttatttatcacacatgcatgtcatatttgtaactatccattggatgcacacctaggttattcttaaaaagccgagctcgtgggatttggttattgcgacgtgtctacacttggagcgggtggtcaatgagtgttttaactagggacataggtggtgatctagtcttaggatgatggtccttgatgcttcttg

SEQ ID NO: 61535 - DNA, 13473 bp, Oryza sativa
tattcggattagtttcctagtaggagtcctattaggtgtctttctattatcccctatatatactcttgtaagccgtacgggaaggggtgacgttcctattatgattcccctacgtttgtaatcatctcctctatagtgatcattgctggtcggcgcccgtggtttttcccgcaagggttttccacgtaaaattcgtgtctccgttgtgcatatatttttataacaagtggtataatagcattggagattcgatcaacaactatcccatcgtcgttctgcaattcggcgagattatccaccagcgcacgttcatcatcggcgacggcaggcgcgtgtcgtcgctcgtctcgtcgattcgtctcgtcttcgtcgtgctgcctacgcacgcgagaaaaaacaggaggagcagcagccggtctccacaccacacgtcgggggaggagaaaaagcagcagaaaccaatctaattgcgcacggatcccaaagtgaagaaaaagtagggcaagtcagtcagagccatcatcgccctgttctgtgaattcaatttcacgttgagaattgctatggccacctaagcttgtgtaccaggagattccctgatctacgctacgtgcacacataaagtgcacccagaggttcgtgattttgctaggtttaccctaatttcttactagcaaattttaggattaattcctatggcgagtttgaagtatgatctaccgctcctggaccgagacacaagattctcactttggcaagtgaagatgcgagccgttcttgcacagcaagacctcgatgatacgctttctggatttgacaagaggactcaggattggtccaacgatgagaagaaaagggatcgtaaggctatgtcatatattcatcttcatctatctaacaatattttgaaggaggtgcttaaggaggagacagccgctgggctgtggttgaaactggaacagatatgcatgactaaggatctgaccagtaagatgcacctgaagcaaaagttatttttgcataagttgcaagatgatgggtctgtaatggaccatctctccactttcaaggaaattgttgctgaccttgagtctatggaggtaaagtatgatgaaaaggatttaggccttattctattgtgttcattgcctagctcatatgcaaacttcacggatactatactttatagtcgtgatactctaactttgaaagaagtttacgatgctttgcatgccaaagaaaagatgaagaagatggtaccctctgaaggttcaaattcacaagcagaaggcttggttgttcggggcaggcaacaggagaagaacacaaagaaccaatcaagagataaaagctcaagtagctaccgtgggagatcaaagtctagaggcaggtataagtcatgcaaatactgcaagagagatggacatgatatctctgagtgttggaagctacaggacaaagacaagagaactggaaagtatataccaaaaggtaagaaagaagaggaaggtaaagccacagttgttactaatgagaagtctgatgcagaattgcttgttgcttatgctggttgtgcacaaactagtgaccagtggattcttgatactgcatgcacctatcacatgtgccctaatagggattggtttgccacctatgaagctgtgcaaggtggtactgttttgatgggtgatgatacaccatgcgaggttgcaggtattggaacagttcagatcaagatgtttgatggctgtatcagaacattgtcagatgtgcggcatattccaaatttgaagagaagtctcatctctttatgtactcttgatcacaaagggtacaaatattcctgtggagacggaattttgaagataactaaaggctctcttgttgtgatgaaagctgatattaaatatgctaacctgtaccatctgcgaggtacaactatattaggtaatgttgcagcagtttctgattcattatctaattccgatgctactaatctttggcatatgcgtcttgggcatatgagtgaaattggtttggcagaattgagcaagcgaggattgctagatggacaaagcatcgggaagctcaaattttgtgagcattgcatctttggcaagcataagagggtgaagttcaacacatctacacatactactgaaggtattcttgattatgtgcattctgatttatgggggcctgctcgtaagacatcttttggaggtgctcgttacatgatgactatcgttgatgattattcgcgaaaagtttggccttatttcttgaagcacaaatatcaagcttttgatgtgtttaaagagtggaaaactatggttgaaagaaaaactgaaaggaaggtgaaaatccttcgtactgacaatgggatggagttctgttctaagatattttaatcatattgcaagtctgaaggcattgtgcgtcactacaccgttcctcacacacctcaacaaaacggcgtagctgagcatatgaacagaacaattatatcaaaggcccgttgtatgttgtctaatgcaggtttgcctaaacagttttgggcggaagccgtttccactgcttgttatcttataaatcgatcacctagctatgccattgataagaagactccaattgaggtatggtctggttccccagcaaattattcagacttaagagtatttggttgtactgcttatgctcatgttgataatgataaattggagcctagagctattaagtgcatttttcttggttatccgtctgctgtgaaaggctataagttatggtgtcctgaaactaaaaaggttgtgattagtcgaaacattgtcttccatgaatcagttatgttacatgacaaaccttctactaatgttcctgttgagagtcaggagaaagcaagtgtggaggtggagcacttgatcagttcagggcatgcaccagaaaaagaagatgttgctattaaccaagatgaacctgttattgaagattcaaattcttctactgttcagcagtctccaaaacgttctattgcaaaagataggcccaaaagaaatattaaaccttctcaaagatatattgaagaagcaaacatagttgcttatactttgagtgtggcagaagaaattgaaggtaatgcagaaccttctacatattctgaggctattgtttctgatgattgcaatagatggataactgctatgcatgatgagatggagtcacttgaaaagaatcatacttgggaattggtgaagttgccaaaggagaagaaacctatccgttgcaagtggatcttcaaaagaaaggaaggtatgtctccaagtgatgaggcaagatacaaagcaaggctagttgctaaaggttatagccagattccaggtattgatttcaatgatgtcttttcccctgttgtgaagcatagttcaattcgcactttactcagtattgttgcaatgcatgattatgaactagagcaaatggatgttaagactgcatttttacatggggagttagaagaggacatttatatggagcaacctgaaggttttgttgttcctggaaaagagaacctagtctgtaggttgaagaaatctctttatgggttgaagcagtcacctagacagtggtataagagatttgactctttcatgctttctcagaagtttagaagatccaattatgatagctgtgtttatctcaaagttgttgattgttcagctatatatttgtttctttatgttgatgatatgttgattgctgcaaaagacaaatcagagatagcaaagttgaaggcacaattgagtagtgaatttgagatgaaggatttgggtgcagcgaagaaaattctcggtatggaaattactagagaaagacattctggcaagttatatcttagttagaaaggttatattgaaaaagttcttcgtcgtttcaatatgcatgatgcaaaaccagtgagtactcctttagctgcacatttcagattatcttcatattaatgtccacagtcagattatgatgttgagtacatgtctagagttccatattcaagtgcagttggttcacttatgtatgccatggtatgttctcgtcctgacttatcacatgcattgagtgttgtcagtagatacatggctaatcctagcaaagagcattggaaagctgttcaatggattttcagatacctacgtggtacatctagtgcttgtttacagtttgggagatctagagatggacttgttggttatgtggattcagattttgctggagatttagataggcgaagatcactcacaggttatgttttcactattggaggatgtgctgttagttggaaggcaagtttgcaagcaacggttgccttatctactactgaagcaaagtatatggctatttctgaagcttgtaaagaagctatttggcttagaggtttgtacactgagctttgtgaagttacgtcttgcattaatatattttgtgatagtcaaagtgcaatatgccttacaaaggatcagatgttccatgagagaacaaagcacattgatgtgagatatcactttattcgaggtgtgattgttgaaggtgatgtcaaggtatgcaagataagtactcatgataacctagctgatatgatgacaaagccagttcctgctactaagtttgagctttgctcaagcttggttggtgttacagtatagtcctagagactatttggcgcgcggtgattttacctacatgaggtattttttggtgattgatgtttttatgctacaagaggaaattcgtctcaaggtggagattgttaaatatgtgattcgaattttgggcccacaatatattcggattagtttcctagtaggagtcctattaggtgtctttctattatcccctatatatactcttgtaagccgtatgggaaggggtgacgttcccattgtgattcccctacgtttgtaatcatctcctctatagtgatcattgccggtcggcgcccgtggtttttcccgcaagggttttccacgtaaaattcgtgtctccgtttcgcatctattttcataacagtagctaaatccaatagctgaatcacagcctaaggatatacagtatatgaattacgaaaggctgggttatctgtcctgtgtgtttgcaatttctaaaagcttttgtttttttgaggtgcatatgttggtcatgagcagaccactgataaagttacatgggtttctattctagttaaggatctctccttcgtgactttggtgtacataacaagctaccaacggtccctaaaataagttctcgcaaaaaagaaaaaactagctagcaacgataaaacggtagtaagtcatgcatttttccagatgctatcactgatgtgttggagtttaatctttcttaattacataagatattagcccctatatatgatcacctctgcttaatgcaaaaattgatctaactgatgatcttgtttttgaaagccattaagcatgtatttggttttgctgtttttccttttgcctttctcctcctccttctgttcttgtagttagtagaggaagctggggcggcggcttcaaggacgctgcaaggggtgcctgctttttgtttatgaaaaaaaaacctcccagagataccttatgaaccccttgcagtgtctaatcgatcgagcgattggatttagattttaggggtagagagaactcaagggttatagagaactcaaacgtcacttatgcttctcctcttctttcttttatatgtgatgctggtgggggtcacgagtttattttcaattaaaatttaaatccgatttttaccgataaaaaaaagatattatctcttatttgtttcttgttagctagctagtgtcacgcccggaatttctatccaaaattccaaacgcttacatgtgtgtaaaccctcgtccaggaatcagccgaggcacacaataacaaattgataatagagtgcaattattactctaattgataagcgaatataaagtcattacagaggtagatagttcctctcaaacaataaagatctaagcagcggaaaataaaataaagagcgcaggcgactccatcccacaagcagcttgaccagggctacgcctaaccctccacaccttcagcatcactgtagaactcctcctctgatgaatgattgcaaggtgagtatatgacatactcaacaagccacgcagcaaatatgcaagtgcaggggataacaaaggatggcataaatagtctcatttgcataaatggcattcaataaatacttcagaatttagaaaaacagtaaagtatctaagtaaacaatattattccaacactatacaacatacccgttgcataggcccaaccattctgaacaaccattcccggctgcacagttctatctccaaaccaggaatataccattccaaaccaggagctaaacaagttattaccaattacagcatcatttattatggtgtgaggcatgagactaatcacgaaagacattgttagacccgcccataaccgcgggcacggctattcgaatagttttactctggccagaggtgtaccactgtacccacaagacacaacctcaacatcatgtcaactatgcgtcgcgatacttaacaagtacccgaatagagattgtgacaatacccttcgcataacacaattcaaagcagcgcaccattcctggatcataatcacccccttataaaacaaggcatggactccccagcgacccccgtgggcttatctccgccacttctcagtctggtgccccaaaatgaaccacactatacaaaaggtaaaaccgttgcccacgctggcttgtgattggcacggttaatgtttcacgaccgaaaatcgtgaaccggtccttaattgtcatcagcacgaccatcaaaaccatgtgctcacaacccaccattaccatgttttagttggcatcttaattaatcaacatatcatgattaaccatcatgagctaccattaagtcatcattaagtaataaatcattaattatcccattcatatgagctagtgtctctaagcatggctaagcatcctaattactttagctaaaaccatataatgttctagctaatccaattattaaccaggtgacaaagtataggcaatcaatataaaaaggctataacaaaggaaataggtcattcccacccggcgacattcaaaaataaatgcattatttgaatagaaacaataggtttaaacgggatcaacatgctcaaaggattgtctgggatctgtgtgacttgccttgctggccttggaacactttaaagtcttctcctgcaaattcggactctccgggaacgtcgcaatctaagcataaaagagcaaaatcaccaaaacagtacataaacaatcataaacagcacatgttgatatttttaaatgtagatctcaattttagaaaaatttagagacttgaaccaactaaatccgagctaagatgaattagttatgaatttttaaagattaaaccggattaaatcatttatatagattttaattggattatcacgcaataaagaattatttttgaaaaggaaaaatgatttattgcatcagcgggctcgggttcacggtggaccgggtgcacggaaacggtctacggaacgaacggctaggatctaatctagacaaaacggacggccgagatcgacctaatccaccacgggtctacggctgacgtggcgctgacgtcgacgatgacgtcatcacaggcggcggctcggcatctcacgctcaccgacgaacgacggcgcggcggcgcaaacggagggcatctacgcgtagagggcgacgcagcgaactcacagagggctcggacgatgacggacggcaaccgacggcgacggcggcgaggtcgaagcggcggaggtgttcgggtcgacgacgacagcgatgctccggcgatcctcgacagaaacggaggacaggactaggacggcgatgacttggcgaacccgacggcggccttcccgagcgacgacgatgaccagagcggcggcggcgcacggctggacttgcggcggcgacgacggcgcagacgctaacgcggctagagctctaccggcgatggaaggctaaggcgaaggtggcggcggacggaggaggtctcgggggtccttttataggggctagggggcgacgtctaggcccacggcggccggcagcgacgatggaaagtttagggttggagggagaaaacaaatccgaatcgagatcaaatccggcgatttccaaacgaaaatagccaaagtttttgtaggggaaaagatagaggaggtcaaggggatcatttcccctctaccaatttgatcggatcgggaaaggggcgacggaatttggaagggcggcggcggcttgcgcgcggctagggcgcggctggcggcgagaggttgaagacggccctgacaagtgggccccacctatcagcaagagagaggagggagagcgtggcggactgggccggcttgggccgggcgcgcacaggccggggagagagagacttgggccgtctttcggcccaaagccaaaagaggacttttaaaacctttttccttttaaattattcatgaaatgaaattttatttattaaaaatactttcttggctcaaataaatcccagaaaaatctaggaactatagaatcaagagaagtatttaataaaattttatctagcccacttttatgttggaatttattacttaaaattagatcttttcttctaggcttttaaaatcatttttaataattctatttaaacaacaatttatacatttgggatttttaggctgtgacagctaggaacggactagggagattttatcattttcctaactaaccgatagtagccaacagtttctatcattacgtgactgaataatagcgcgcaatttgaattgaaatagcatcatcatcagacaaattttgtcttttgctgtgccataactagcgcttaagcaatacaaggaatacgattacttacttttaagctttccttgagcatgatcataacgacgaaattaagcactctaatgctattcgggcattaagccatttacaactttacaaaaagtcttccaggtgattcaagtttcgtgtgttaaaattaagtaattccttcatatatgcttaaaatgtttggcatgttttgtctgttcaagattgtacagtaggagtttttgccggccggtcggcctaattttacaattatactagctagtatctttcagaaaataacatagataaggcaactagctagtatcttctaataacaactggtttatcagaagatagactaggtcatcaggacattaactttaacttagttgtatcaaaactttcaggacattgcacccttagctttagttgtatccaaactttcaagaccatacataaggtcatcagaaactttcaagaccaaacatgaggtcatcagagatcaaactagctagtcaaacagaagtaaagttcacaaactacttactgacgagccagggttatttctcttgctgagggaggaacctcgcaacaagctccatgagaacagacgggcaactgattttcagatgctcataatcatcactggccatcatcctctcaagattggagcgagaagcaaggaactcaaagcaagcttccttgagtccatagcaactgtgctgctcagctagggccaaagtggtagccaccatgttggagtcaatgtgctttgatagcttctcctcgcatattagcttcagcctcccgacattgtaccgatctgctgccacaactaggtgctgagccatcacaatattttgagcagtctcaggcagtgagtcagtgtagatgaaatgcaacaatgctctgaacaccccagcttctatatcttcaattttgatggtcctacgggctttagcactcatggcgccaaagaactcagctctgaagacagatgaacgagcagcgagtatgcacttgtgcgctgagaatatatcctgaccaacgttgaacgtcacgtccgtactatccatgttcttcaagaggaggtctcccagatgctggtgcaggtcactaggaggaaccaccacaaactgcttttgtgtggtttctttgctacagatatccttcatgacagtcaaatcgcacatgatggagaatgaatcgttgctcaaatgtactgagcgttccaaatcagttttcttcatgaacttagagtggccccaatctgaacctttttccgtgaaggtgtgtaaagggtacaatttgctgtataattgcactgatctaccattcttgtctagcaatgcaaagctgaaggttgccttcacgcccccggcgcaagcaaaatcaatggtcagaaaaaccgacaggtaatccttactctctgtgttaactccattggggaagtatgtgatgaaccagctatgacctccaacactgaatgggatagatgaaacatacttgccattctccatcagctccttggtccttaagtatccatcaatcttgattacatgcgaccctcttgcaacttcagcaaccgtgacagaggaggtgttgttgcaatggtttgccattctggaggtgagctatcagctatggtgtttacagcagcagcagttcagttgtacctatgtcagaatataagtaagtaaagaattttgagtagtttactgaataaaaaagtccctcaacaagaggcgggcccaccgtgattcaaaggtattcaaatgtactatctactaagtggcatgttgtacgaccatgaaaatccacccgtaagaagttacttatacttaatatatgtacaatgaatagtatttaaaaatagtaatatttatcaagagagttcacggtagataaaaccaagcaggaagctgctaattcattacgttgattcctcacatgaataattaactggaattgattaatggcaatgtatatgtaaaggtagtaacaacacaacactataaaatacttctctctagcacaatatatatattcagataacataataaactattattacgatatattaagttcctgttaaaggtatgttcttctataaatggaatataaacagtatagtcatgtcttaagagtacaataaataaattaactattataaagttaaataaattttaaacaacttttaaaaattcatatatagaaaatttatataaaaattgcaacgtttagtaagtagcatatgacgctaaatagaatgtgatattcatagcaattgaatgtagtagaattcgcctattctttcgatataagagatgaatccattatccacccaacgattggtgtttacggcagcagttcagtttgtacctatgtcgagtatatgcaggtaattaaagaattttgagtacttagtaccaaataaaaaagaatcccctcaacaaacaaagtacagatcgagcaacttttcttgaaccagatgcatgatgttctcatcaaactatcacgagcatagaaaatcgaaggatatctgaagccaagatgcctgttctttagacatagcaatctgaattctgaaagaccaagcatatatagtacgattcctacaaagcaagacattcgagaatgtatgttacctttcttaaatattgttctggcgtgccaccgcgcgccgcccgccggcgccgggcttcgagcagatggctgaaaagcactgcagtaacaacgtgcgacgtggggagaggggggcgacggcgacggcgacggctgcggcggagtgaaggttggcttggctgtgcccttccgtatcctctgccgtttgccctccgtactaaccatagagataatctcaaccctttattttaaagggttgattagtaatatagtactacagattagttgtagattagattgaaatattgcagcgtgaatgcgtggtggctgcgacgccgatcaccactaggaggatctttgatgccatacaccaaaatttatctgctaatactaatatgtttgatcaatccaagttcttggttcttgcgttgttgttgtgcgtgtaagtgttttatatgatgttaccaggccaaggtgcgatttgattcatagttaagtgtggttattcttatcgccttaattaggtcgattagccaccaggaattaaggttcgttgatatgtagttcttttttcgttgcttctaataatggcaaatgaaccaagtgcagcaagggttagtgagtgtaaaggacgattatgccctccacgaataattttcctggacaaaaatacactccacaattctactaccattaattaagtgtggtggtagttagaagtagatctaaactcttcaatcaaataagatcaacagtatatattactttctaccataggtacagtgcatagtagggagcaccggagtgggactcctgtatatatggttctctttgctgttgagaaatcgttgatcttacctttccaataaatggcgaggataatcaagacttgttgatttctttcttctggtagtacttttcctttatagaacaattgtgcatttaccatttcatcccatttcaaaacacggttctctagggcaatgttgtatgttgtataaaggcatacaacacttcaatatcatggggctatagtgggacagaggaagataaatcggcaaagaagtttcgtggtttggcttccttatcacagttggtgcagacagtggcgaatctagaaaatcgattcattggtgtcataacgtgtctatcggtgtcataatactaattatgcttagatcatggtgttataacatatggataagcaatttcgctatagattttgctgtaagttatcggtgtcgcctgacaccggcctttctactgtagatccgtccatgggtgcagaacaccatttcctttccttttctggtatctttattggatctccagaactttaaacaaatcaacaaaacttagaacttgaaatcaaaacttcatgtccaaaatccaaagcgttcatctaacaaccaaaaaccctttatttcaacccaaaatctaccttcttataattctcaaaattataacacaaactatcaaaagtttcaacccaaatcttcaagtttctactcatgaaccaaactttcaacacaaagtcacaaaactttcaagcaaagtattcacaactaatacggcggaggatggcggtgcagagtttctattctcccggatctaagaaaatctaaccaatttacaattacagcattttagtatatttcagaaaataacataaataatctacagataggataacatagtaaaaatatatcattccacacatagaaatactcagtagagaaaatggtaagaagaaccaccagttgattcaatattggaaagactaggtagattgaaggtcgtagacaaaactagacatgaggataaattcaacatggttgtcccacaacattcaggatattgcatccttag

SEQ ID NO: 61536 - DNA, 3173 bp, Oryza sativa
tggatcatttacctctttaagacagatcatcattcactctttccagcatattgaagacgtacaaatgagacagaataacctgatgtcctctgactatctgcatcagcaccatcattctgatcttgttgtgccccatcttgatccgttctggacagcaatgcaacaatactgtcaagcaatttgccccaagtttgggctgctgcaccatccaacagcagtgcagattcacagatcaacttcgttgatgcaactgatgtcagcttaacttcaacagtccctttgatgaatttaagattgggaatccaaaagcgctgaaggattgtcatgaaaatatttggctgaattgcatcgacagaactgacaagaacacctggtccatatttaaccaccaccaaggacatgaagaccacaagagaattcacaaacttcactgcctgccttgtctgtagtcgagtaaacaaagcactccatatctcatttatgtgaggattcatgatgtcaaaactcacattttccacaagtgtgttaagcatgtagaaggcagaatcttcagtactgctccgcgaaaggagactgcggaatatcactaagatattcggtagcctgccctcttggttaagctcatttggaattttccgaaggaatgctctcagcaaccgaaccaaggcagggacacacggtggacggtcccaggtagcattactgagcaggacaccaaacagctgcatgtagttctgcgagagaggtggtcggctcaaattgacaagttgtgcaaatatctggaaagcatatggccagaactctgagatgtcctcaaccaatatcctctgaagcaccgggaagaggcttgcctcaaacacaggaagtagtgctgggtcctgctcaccagcccgaccaatcactgctgccagggcttcaaacaagtaatggttaaaatcagggttcttggggttattgcacacttccataagaatacccacaaggcgagcagtaatctcatgaacaatttgcccagcaatattagcaatcccaagcactctcatcaggcacttcatcagataggggttctcatatgattcaggaaaacttagtgccttggacaggttctgaacaatcggctgggcatatgggttgatatcagcagcaacatagcgtggagccctggtaatcacatttgcacttggtactggtaccatatccttgatgatcagaaggttctcaataaaggtcgcagcatatgaatggacaacatttgactcgtgtatcaggaaccttattacacttggaagcagtgccagtgcagtggctttggggatttgatccttgaattccttcaagaacctcagcacagttgccttcagcattggttcagattcccaatcaggggcctgcagctcaggcacgatcacagatgtaaagaagctctccatatcaaccaccggtgtcccacctcctgtggcaccaggcttctgcataagagaaataacaaggtatattgcagcatccttctctttccagttgttcgtccgatcagctgcatatgcagccaacatctgctggacctgtgctgacacaagtgcagccacctgctcccggtagtttgccgcaagcccccgcagcaaccggcatgcagcccgcctcagtgtatccgcatcactcccctcggcatcacgcctaacatattccacccagttcccctcaaacagctcctcatcatcatcccgtaaccgcaggttaggaattacaacactatcgcatatctgcttcattgcatcagggctcccaaacagcgcgtggtgcacgctctcagcaaccgttgtcaaaaatcttattgcggtcaccgcaagctgcccgcgggatggtgagacagatggtgccatgaggaggccccagaccgcctcaacgaactccttcagatatcccctgaactcctcttcatacttctccatgtacagctgcaagttgtcacacacggcggcgcggagcgcatccggggcgccgtctgcctctatcgctggcgggtaggaggtggtgaggaacgcacggaactccgtcatccactcacgcatgtggtcctcgaagaactcgggcaggtcgatggagttgagcgaatagaagatctcgcagcataggcgaaggcactcaaacaccgggcgggattcaggcggggtgaccgtgggtgcggcagcctgaaggcggcgggaggtggagaggaagacctcgagtagggcagcggcgaagttctcgaggcagtacttgaggtcgaggcggatggtgttgctgtcgaaggcattgcggaagcgggagaagagggaggccgcggcggcgaggagggagttggtcgccgggatgtccccggcggagagggcggtgccgagggaggagacgatggaagggaggagcgactcccacctggcagggaagtcggaggccgcggcggcggcgagggcctcggagagctgcgcctggatgaggggcggcgcggtgaggaggagctggaggaggttcgccttgatgatggcccagtcggagggcgggaggtggtcggcgtcgtcgtcgccgccgccgtcgggggagggcttgggccagcggcggcggaggaggttcttgaactggacggaggcggcgagccgcgactgcgggtcgtggcgcggggaggaggcgaggccgaggagcgcgagcccgaaccccggcgagcacttggccgactcgatgctctgctcggcggcgcggcgcgcggcggcgtccggggagagcgactgcgcgaaccaccccgacagggtgtcgagcgtctccggcgccacctccattcccgccgccgcggcgatctagcagaaggcggctagggtttcgtggagatcgggagtggaggtagggtttttgaaatttctcgtggggaaggagagagagaggagagagaagaagaagaagaaaatgcttttgcttggtcggtcgatgcgaggaagagatggggaaagaggagagagctgagccgttggatttggccgcccttcttggagaaggaaaaaggctgggcctgtgggcccctgggatcctgggcccagcccaccaagcttgctagcccatctcagtgaggtcttgtgagttgtgacggctcaccgccactcgttggggacgcaccatcggaggcagcatcggcacggggattgatg

SEQ ID NO: 61537 - DNA, 936 bp, Oryza sativa
caactaatatgaaattaatatttcaataaattgtgaattaatattggacatgtgataaatcgtgactgctgtttattcatggaagtcttaagggagtctactcatttgctttctagaattgtgacactttacttttctcaaaattatacatcaacagtccgttgtttcctagaatgatcgatgggcaattgcaatttattttcaaaaaccgtaaaattgtattgcttagttccagcaactccacttcaaatttccttaccttcattgctctttgaggagaaaagggggggaatttgtgctcaagtagtcaacaactaagttggtccttttgcgatcaatttgacacagtaatgcttagaacatgtctacatcctttatttgttaaacatatgaattcctgccatacccccaaattatgttcaccaatgcacgtgagggatatgggaatctctcatgcgttactatgtcctatctatgtcatatcactggtggactgttaagcataacaaacacctgatctgcattaccagtttaccacttcacctgttttcacgtctgtgacaaggctttccttcaatggttttcaggcccttattcgcaagtatgcccttgttgccattgtgattggaatagtactgatgctcttttgggtcaagaacaagatatggtgactgagagtaacagtcaggcctcctgttacggtgctggaacttgagttctccgtgcaccccgaatcgattctggctcaacagatgctttgatggcttatcccgcatctgcccattcaagcgagtagtagtgtagctcttcttccgtgctttttgttttttgtttttttgttttttgcctattcctcccaacaaagatcatccaaactaaacccattgtagtataaaccctcgtcatcgacccagcctatcctgatggatgaagaag

SEQ ID NO: 61538 - DNA, 9829 bp, Oryza sativa
agggatttataacaatcaaaccgcttgtgctgcccatgaaggaccctttaggaacccccactcgagaaaaaaacttcatgtgcaaaatccaaagcgttcatttaacaaccaaaaaccctttattttaacccaaagggtacctttttataattctcaaaattatggcacaaactattaaaaggttcacccaaatctttaaggttctactcatgaaccaaacttttaacacaaagtcacaaaactttcaagccaagtattcacaactaatacgggggagggtgggggtgcaaagtttctattttcccggatctaagaaaatctaaccaatttacaattacagcattttagtatatttcagaaaataacataaataatctacagataggataacatagtaaaaatatatcattccacacatagaaatactcagtagagaaaatggtaagaagaaccaccagttgattcaatattggaaagactaggtagattgaaggtcgtagacaaaactagacatgaggataaattcaacatggttgtcccacaacattcaggatattgcatccttagtgatcgaagtatctagtccaacagaagttgtactaaatttcaccagctacttactgaagatccatggttatttcccttgcagcttccatttccggagagatgaatctcgcaataagttccttgagaacaaatgggcaactaaccttcaaatgctcataaccttcactggccttcatcctctcaagattggcatcagaactaaggaacttgaagcatgcttccttcaatccgtggcagctatgctgctcagctagagccaaagtggtagccaccatgttggagtcaatgtgctttgacagcttctcctcgcaaatcagcttcagcctctctacattgtaccgatctgctgcgacaagcaagtgctgagtcatcacaacatctaaagccgtctcaggcagagcgtcagtgtagatgaaatgcagtagtgatctaaacacaccagcttccatatcttcaattttgatggtcctatgggctttggcactcatggcgccaaagaactcagccttgaagacagatgaacgagcagcgagtatgcacttgtgcgctgagaatatgtcctgaccaatgtcgaatgtcacgtccgttccatccatgttcttcaggaagaggtcgatcagatgctagtgcaggtcacctggaggaaccaccacaaactgcttttgtgtggtttctttgctacagatatccttcatgacaattacatcgatcttgatggagaatgagtcgtccataagatgtactaagccttctaatttaatcagttttcttcaagaacttggagtagccgaaatctgaactttttcccgtgaaggtgtgtaaagggtgcgattggctgtatgattgcaatgatttaccattcttgtcgagcaacgcaaagctgaagtttgccttcatggccatggcgcaagcagaaccaagagtcaggaaaaccgacaggtaatctgtcacatcctgattttcgtttcaggatttataaattatctaataaattattaatagaatttatattaaatgttctttaatttacaagtgaagttaaatgtgggaaataaaaatttcctaaatttaaagcatggatggatttaattttcattaaattctccatgattaattatactctctgaaattttctcggattttttggagctcaattcctaaatgatacaaagaacagttcaataattatttaatcattaatgatctaattataattatgttaagtgcttttcttgtttaaaaatccttaaattataaaatgttgtttaattggaattattagaaatgatcttaaaagcctagaagagaagatctaattttaaataataaattccaatataaaaatgggctagataaaattttcttaaatactttgcttgattctatagttcctagatttttctgggatttatttgagccaaggaagtatttttaataaatgaaattgcatttcatgaataattataattgaaaaaggttttaaaattctcttttggctttgggccgaaagtcggcccaaaaccctctctctctcctccccggcccaagccggcccgcaaccgagccgccgctctcctctctctttctctcccgctgacaggtgggccccacctgtcggactcgtcgtcctcctcgcgccgtcgcccggccgaaccctagccaagttgcgccgccgtctccttccaaatccggctgcccctttccgtttccgatgaaatcaatagaggggaaatgatccccgggatcccctctatcttttctcttatggaatcgtcggctaatttcgtttggaaatccgtggattcgagttcgattcggatcgatctctctcctccgaaccctaatctttccttctcgtcgccggtcgccatggaccttcgccgcagcctccttgcccctttataaggacccccaagcccgccgctacccgtcgccaccctcgccttagtctctcgcagccggtagagctctagcgccgtgccgcctcgcgccgccgttgtcgccgccgctccagccgtgcgccgccgtcgctccagtcgtcgtcgtcgcttggggaggtcaccgccgtggtcgccgtcgcgtcgccatcctcgtccgcccctccgccgttgctgtcgaccgccggaacaccgctgtcgtcgtcaagccgatcgtcgccgccgctcttcctcgacgccgtcgccgtccgttgatcttccgccgccgctttggtcactggtgagttcgccgtgccgtccgctacccgttggtgctctccgttcgcgccgccgcgccgtcgttcgccggcgagcatgcgccgctcgagccgtcgccggtgatgacgtcatcgccgaagtcgtcgttgtcgtctctcgtagtccggccgtggaccggtcgatctcggccgtccgttttggatggaaagatctagaccgtccgttccgtagaccgttcctgtgcacccggtccaccgtgaaccctagccgctgacgcaataattcccttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgttttggtgttttgcttctttctgtttagattccgacgtttccggagagtttgttttcgcaggagaagaatttgaagagttccaaggccagcaaggcaagtcacacagatacaaacaatcctttgagcatgttgatcctatatttaaattctctatttatttcaattgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaatttgataatggtgggttgtgagcacatggttttgagagtcgtgctcatgacaattaaggaccggttcacgattttcggttgtgaaacattaaccgtgccaaccacaagccagcgtgggcaacggctttaccttttgtatagcatggttcattgcggagtaccagactgagaagtggcggagataagcccacgggggtcgctggggagtccatgccttgttttataacggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggtcataggcgggtctaacaatgtctttcgtgattagtctcacacttctcaccataataaatgatgatataattggtaataatttatttagcttctggtttggagatagatctgtgcagccgggtatggttgttcaggatggttgggcctgtgcagtatgggtgtgctgttcagtgttgattaatattgatgattaattactctattgttttataattctcaaatgtttgctaaatgctgcttttgcaaatgagccctatattatgccatcctttggtatccatgtgcacttgcatatttgctgtgtggcttgctgagtatgtcatatgctcaccttgcaataatcaatcaaacctcagttgaagacaagttgcgaaggagaagacgttcggcttataccccagttgagctgcctgtgggagtggagctgaagccatcgctagaccgttaattccgctgctgtttttcttttattttgtaagtatgtaactttattattatgatgaatttgtatattaaattgtcagtttgtgtacctcggctgagtcctggacgaggattttatgcacaaataagttcggaaattactagtgaatttccgggcgtgacataatcctaactgtctgtgttgttcccattgggatagtatttgatgaaccaactatgacccccaacactgaatggaacagaagacacatacttgccattctccatcagcttcactctcgagtatccatcaatctagactacatgtgacccgctcacaacttccgcgacaatggcagatgacgtaatgttgtttgccattgtggagaggtgggcagtgggttatggtggaacactagcagatgaggaaatgttttgcggtgccactgtttatgtttagtaatgtagcggtgggaactgagaagttaaaccggtcgaaagatcgatacatttcctcgatcgaaattaatgatgagctgatgataggattagactatggactaagtgagtaaatcgagatgcatatcctcgatcgcatggcggatttcaagtttggctacacgaggagactccaactcgattgccaaggtatctgtgaattcgtttcgtttcttagttctctctttctgatgtattcaggccttatttggcaagcccggccatgattccctggccatcatatctctggggataggccgattatggcccagcccatgtgcaggacgccggtgatagcagcgatgccatgagcatatttcctggtttgaaattctgagcgcggctcaaaagaacaccaatagagatgataatatttcccggtttcaatacattatcaaattgaggaaattttaaaataaaaaacatcagaaaataaaaataagaaattgagaagacttgttttatctcattttatctgtactgtattttcgtatggtcgaaattcccctagcctaccctatcttcttcttcccagccaacaaggaattagattttataagtattaaacatagactattaacaaaacacattccataactctggactaatttgcgagacgaatctagtgagcctaattaatacatgattagcctatgtgatgctgcaataaatatatgctaattatggattaattaggcttaaaaaatttgtcatacgaattagctctcatttatgtaattagttttataagtaatttatgtttaatactccaaattagtatccaaacatccgatgtgacagggattaaagtttagtccttggatccaaacaccacctaaggatggtgcgataaagagagagcaaggactccggaccatcgaggatggggctggtggtttcctcctctccctcctctcccctctctctccctctctccctctctctctctctgcgcgccggtgatcccctcccacgacgcatcgtcaaccttgtgcttctccatctcggttgaggagtgccgaagatgctcctccccctggggtcgccgagctctagttggggagtgaatcggtagcctcgtgggcatgaagccatcgacgagcccaatcaccccaagcagactccccatcctactggcaagcccaagctactccttgccgatttcatgggcatcgctgacgaggaggaacaagatttgaaggaagagctcatcgacaacggtgctctcgccgcccgcacacagccattgtccgccaccgccggcgtcgcctcgccctgtcaccgcatgcggacagccatggctcaccactcgccatcactgcctttccctcttgccgtccgcacacatccatgcccgtccgccaccgtgggcatcacctcgccctctcgccgcccatagacagccatggctcgccacccaccgtctttgcttttccctcttgccgccctctttgccccacgcctccacgcacccatgcccggagagaagacaggagaggagaagcgaggtgggtagaagatagaagataggagaagagatggagaactgacgtgtgggtcccacatgcatattgggggcctcatcttttcgctcatgcttcagctaaaatttaaattttttaccttaaatttaaagttgatttttggattttttttatcgaagtttgtttttcatcctttgcttttagatagctaagaacatgtataaaagtgctattcacaaatgatttttcatttgcaaatataagcgaaataatccgtttctaggtatttttgttcatctaaaaatacggtagcaaaagaacaattaaaaacatgattgatgcatataaaatggtatggatacaattttagaggtatagcaatggcatagttacaaattacctttggcatttttataatgatatggatcaaattaacccaaatatcaaggaattgtattaactttatttatgttttccctaaatattcaagatatgcatggcatccttacagatggaattactcaaaagttaaaaagaaaaaagaaaactacctaagagccatagttatttgttttgctgctttcatttcatgaggaagcaatctcgcagcaagctcattaagaacagatgggcaactggttttcagatgctcgtaaccatcactttccaccatgctttcaatattagatggagaatcaattaggaacttgaagcaagcttccttgagttgatgacatctgtgctgctcagctagagccagattggttgccaccatgttggagtcaatgtgctctgatagcttctcctcgcataccagcttcagcctctcaacattgtaccgatctgccgcgacaagtagttactgagccatcaccacgtcttgcgacgtatcaggcagcaagtcagtgtatacgaaatgtaggaatgatctgaaaacgccagcttccatatcttcaattttgatattgctcctacggggcttcgctctcgtagcaccaaagaacattgcctcgaagacggatgatcgagcagcgagcacgcacttatgtgccgagaatctctcctggccaacgtcgaacgtcacgtctgctccatccatgttcttcagcaagtcgcccagatgctggtgcagatcacctggaggaacctccacagacggcttgggcatggccggggtttccttgctacaaatgggcttcatgaccgtgacatcgcaccggatggaaaatgagtcgtctctcagagattctgatgctttcaaatccttgctcttgataaacattgggtagccccaaccggtacctctaagtttgaaggttttgacagggctggcgatgctgttcagtagcaatggtcttccattcttgtccagcagtttgaagctgtaaattgccttgacgtccctggcaaaagagtccagaaacaggtacaacgacaggtattctctacactccgtagattgaccattgggatagtatctgatggtccaggtgtagccagcaacgctgaatggggtagatgacagacactcttcattcttgatcagcgccttggtttttgagtatccatcaatcttcattacgtgtgacccgctcacagcttcggcgacaatggcagaggagatagtgttgcaatcatttgccattatggaggggagctatcaactttggtggtggaacactgacatggaaattaaaaggttaatttgctgtgtttcttatagatgcccaaagttaaaaccgattacaagtatatattaaaatctaagtaaaatcacacgaaagattatccagggtagaaagtatttgcaccaaccgaaggatatttgaacaaggaatacagtataagttcagttaaagcttaacaaacagaaaatattcttacattatcagaacgagcatcgcaaatccaagcatatttgcagccaagatgcatgttctaaacatacgtattacccctccgtcactaaatatttgacgccgttgacttttttaaacatgtttgaccgttcgtcttattcaaaaaatttaagtaattattaattctttttctatcatttgattcaatgttaaatatagttttatgtaagcatatagttttacatatttcacagaagttcttgaataagacgaatggtcaaacatactttaaaaaagtcaatggcgtcaaatattcagtggcggagggagtacacagcaatctgaaactcaaagcatattaaagtttcaagagtgtgtacgtttgtcaattacctagttatatgtcaggacattggattaggagtggggaattcttcaggaaaattcagtaaagatggtggtcgccgcaagactcgaacgctgaagaaaaccctaattttactcctactcctaaagacaaagatatagtagattcatttcctgcttcattatgggctaatagccgctataagtagcatacaaatattattacacagctgtaaagctagagttaaacaaccacatgaaacagagcatcttcctctgtcccaaaaaagcaatgacaacgacaaaaacgactacagtggtcccattttgatcttcttttccccttagctctgatcttttctgaacttaactgaagtttccttcccaactctgaaactctgaacttaatctcccatttctcaactcctgtcttgacaattgcccccggttaagttggaccttgtcctcaaggttcaaaagaaggaaaagctgactgaatataagtcgcatcctcctaggtcgcatcagccggcgtcaagttctgccaaagaataaggcactgaattactggttcattgtttcttggaatcatgcgcctttgcaacacagcgactggttcagtcttaatctgtccctcaggacctactgctggcagattaggcataggaacaacatgctgtcctaaatgtttcttcaattgactcacatgaaacactggatggattcctactccttcaagtaattgcagcctgtaagcaaccttccccaccttttcaataaccttgaatagcccatagaatttagacctgagtttcagtgatcccctaatgccaaacgcagcttgtctatagggctgcaactttaagtacaccatgtctccaacctccaacactctttcagtcctattcaaatcggcataatgtttcattcttctctgagcttcacccatgctatccctcaatttctgcaaaatggctgctctttctttcagggtaacccttgcttcttcagatacattgcatggaattgaaaattcattcacttgtgggggtggatacccatacaaagcttgagtattctat

SEQ ID NO: 61539 - DNA, 1010 bp, Oryza sativa
tcatcaatcctttctttttcttgatttgcaaaccctttgcaggcaattttaaacattacgaattctgagtgcataacaaaaataaaaactacattattccactgtatgtaaacaaattagtgaaatgaatgaaataacaggggcggatccaacttgggacatgggggttcagttgaaccccccaaacttttgggggaacaacaaacaaactcaaactgttacttgtattaaggttaaggctctggaattaaaagaagagcttcttccagatctacaagagaagctagggtttacgcaagcaaattccagacagaagcactcccggtgggagggagagattaatcatcagaaagaggatgtggatgctcaccaggatcccttgctcgccggatggagatcggcgcccctcccctcccctgttcagccgcgaagggcgcaagaagcggaggagacgacgagacgggagattttttttttctcttttacgcgaagggaagggggaagagatactcgagtactccacctttagctcagatttactatgttacccattatgtgtagcaggccaaatgggcggcccggcccatcacggcaaggggcccgctgatggcacggcaactgtaatgggccgtacggtgccagatcttgggcagaacggcccaaggaggtgttgggccgtgtcgggccggcacggctactgttgcatggaccggtggcccacccactagcacgataacgttattcgtgagaaactacagtcgcaagttttctatagtaggtaacacaattaggcaaaattgtgttttttttagatattggaatagaatccagcctttggtcaatgagctacaaccaattattacaccaattcatacaaataaaatcgcatggcaaaaaagttataaaaacacggtcctaaaaggtcaggaacacacaccaagtactaaaaaccaacgcaagaaaagatcacaaaattattgaattctatttgtgaatcttcatccaaagtt

SEQ ID NO: 61540 - DNA, 677 bp, Oryza sativa
ttcttctagaacaatgaatatggataaaggcatcctcacgtttccgttacgtactcctttaaaaaaaacttagagaacaaaacgtttccgttacggactccctttctaaaaaaaaactcagagaacaattaatatggacaaagatatcccgttgagttttttttactaagcaccaaaatcgtagacggaacctttttcatcttttgtcgtggcgatgccacctgtgctgcttgcgtggccgaccggcctctgcccaacccacgccggccacatcaccacctcgtggctcgtggcgctgctccgcctccgcctccgccacacggccccgctcccgacgaatcagcgagaaacggtaaccaaaaccttcgcctccagcctcgcctcgctctcgcacaaatcaatcccgcaaaatccctcgaccctcgatccccccccttctccctctctctctctctctctctcccggtgatcgcgacgccaacccgcgctcgcgccgggtaaggatcctcctcgattccccgctcctcccatctcccgccctacctagctcacgatcggtcgccgccaccgccgccgagtggtcggtctgtgtggctcgcccgagctgcgcgttgtgatgatggcgatgcgcgtggttcgagttatagatgcactgggggctaacgcagaatttgctc

SEQ ID NO: 61541 - DNA, 1240 bp, Oryza sativa
ggtacagtagttcatcaggcttgcaagttcaggaatcttcagtttgctgattgcatatatctgaaggctgtttgcacaattttcttgctgataatgtttattcacgttggtaatctgtcttttttgcaagcagacacgcaaaaaaattcttattcgggatggggttttgtttcaccaaatgaatggcattcgtcacaactcttcatcttctctttgttttcccagcctggtgcacattctatcgtctcatctggcattgtctataagggtcaactaattagatgatgtcttgcaattcttttgtttgttcttcagcttgcattgggagtttaggtactaggaaacggttttctgcgtttagattgcttgctagtttcgatgtgtgttgggaaaaagagctcggaagcgagctgcatgctagcggtccatcatattcaggtgtagtttggccatcaccaatgtgcagtaaaagtttcacaatcacccaattaagcatgttgatgaagccactttgacaagcagcgaccaaacattgcgtacctgtgcaccgttcctaatttctgctgtctcttgtgtaaggaactaagccagcttagttggtcgatagctagtgtgggtgtacacctagaccaaaagttttatcaagttgaatttgggtgcctattttcttgttaaactagatgaatatcccgccgcgttgctgcgaaaaattacgttgcataatatgtacaaatgtaatttgattatcaaaatgaaaataatttgatacaattttgagtctaaaaataattaagattgcatgttttaagatagaagaaagaagagacaatttggaccatagctctatcatccaaaggctagaaataattaggggaatatagcttaatgagagaagagataaataatgtattaactacacttaataagaataaactatagtatataagattacaaagtcgatcctaatattttctttatcttcttaaaataaacacaatgaactcgcatgtttttgtcttttctgtttgaatgatgtatcacagaatgccctgcaaatttgctgacctttttacctgatacgtcactgatcggactttgaatcatcttttattattgttggaaggaaaaagtatatatgaggtcctcatcttgtcatcgaattacaaaatcatcctccaaccgcaaaatagatatatatcatccctaacttacaaaaccggatcactctaggtccttaggt

SEQ ID NO: 61542 - DNA, 711 bp, Oryza sativa
  unsure (1)..(711): unsure at all n locations
gaggggattganattcgatgtcnatcccttgctcgcatgccngcatgtctactctataggatccccagtatggacatatcactattcttcctcttggagttcaatttatccacgtagtaccgacgcagctctcgagtaatagttgtgtaaaccctcgtccaggaatcagccggggcacacaataacaaattggtaatagagtgcaattattactctaattgataagcgaatataaagtcattacagaggtagatagttcctctcaaacaataaagatctaagcagcggaaaataaaataaagagcgcaggcgactccatcccacaagcagcttgaccagggctacgcctaaccctccacacctttagcatcactgtagaactccttctgtgatgaatgattgcaaggcgagtatatgacatactcaacaagccacgcagcaaatatgcaagtgcaggggataacaaaggatggcataaatagtctcatttgcataaatggcattcaataaatacttcagaatttagaaaaacagtaaagtatctaagtaaacaatattattccaacactatacaacatacccgttgcataggcccaaccattctgaacaaccattcccggctgcacagttctatctccaaaccaggaatataccattccaaaccaggagctaaacaagttattaccaattacagcatcatttattatggtg

SEQ ID NO: 61543 - DNA, 1163 bp, Oryza sativa
gattattactccctccgtttcaggttgtaatacgttttgactttagtcaaagtcaaactactttaagtttgaccaaatttgtagaaaaaagtagtaacattttagacccaagacaaatttattatgaaaatatattctgtcagggttatggataccatatacccaatagtaattgactaagctaggcggggccaaccatataccaagtcctatacgaaatcatacctcatatatagaaggagttccggataagggaggatgagtagagttccatatggaaactacaaggaatatttggattttatctatattggtctccctagttctacttggacaaggagatatctatgggtataagtacaagaccccataggaggagagaagggacaacatatcaacgcacaagccaagacaagccaaacatcgatatcagagataagcctaaataaaccctatctggtgcctgcggaggtcgacaagagggatctagcgccatctctgatctcggcgagtttatattcgaggaggaaaactatcctgtcgtcgactatgtgttggttatctatgccgccaagtcaacgacatctagatgggttatcccaaatattgtattggtgtgattatgatgaatatagagcaataccggcttcggccaacaggatgtaaggctattacctgtcagataaggggcccgaacctgtataaaaacccttgtctccgtctcttttacttcaatctcgcatataccctggtaccaacgatccatatactatgcaaaataccgttgtcgcggtctcaaacgtcgacatatgtgtccaaacatttgatgtgacgtttttggccaaaattttttggatctaaacaagacctaggcttaaaaatataactaattatatagattacgtgtaaattgcgagataaatcttttaagcttaattgctccatgatttgataatatggtgctacagtagacatttgctaatgacggattaattatgcttaataaattcatctcatatgctaattagcacacgtttactgtatcatcacataggctaattatagattaatcaggctcaataaattcgtctcgcaaattagtgtagggttatagaataagctttataattagtctatatttaatacttctaattagtgtctaa

SEQ ID NO: 61544 - DNA, 705 bp, Oryza sativa
agctctgatcgaagattttaacgatctaacatgagctctgttttaattactcgattaagaagctgtacagactttatttatatatataggacatactgtcatgagcccgtatgatacatgaactcggcttcaatatatatcagatcatgcacgtcatttgccgattggcagccagcttgtgaatcaagccatgtaccacacggagatggattaatccttcgtaacaatatactactgagtatttcaccgagtgaagtctgtccggcttcgcgtacaaactacactcggtggggggcatttgtttgatgaatttttgtgctaaaaattcatagaagaaataataaattattgggcatttaattttatatgagaatattatttgtagcacaattttactgaatatatacgagacgtgtctatatgacatgtgggtctagaaattttaaatattatggtgtccgaatatattcgatattggactcgttttgttgtataattgaatagaaagtgatggttcaaatggattttaaatccgatatacgattcaaaagattggaactattaaaacaaaagaaataagaagtgctatcgttactacgtgagcatgcatggtcattggctgtggcgattaaacatatggggcccactgtcattagacatgttaatcacataattatctccagactgcagtacacgttgacggat

SEQ ID NO: 61545 - DNA, 5970 bp, Oryza sativa
ttcgattcatacctacacctcttaacaaaacaactcaaaatttaactttatttcacaatccaatattacatacctaactaattatatgtttggatgccatatacctagaattaatcaaaatctaacaaaaacatgtttaaactaagttcaaacttgttttgaactagttagaaaagtagttaatgttaatacctaaatatttaaaaaaatttcatactcatttgaattgagtatatactcaatttgaaccatggagctcgggcaccatggagcaccaaacaaatatatatatatatatatatatatatatatatatatatatatatatatatatatatatatatatatatatatatatatatatatatatatatatatatatatatatatatatatatatacatatacatacacatatatatatatatatatatacacatacatacatacatacatatatatatatatatatatatatatacatacatatatatatatatatatatatatatacatatatatatatatatatacatatatatacctatatatatatatatatatatatatatatatatacatatatacacatatatagatatatatacatatatatatatatatatatatatatatacatatatatacctatatacatatatatacatatatatatatatatatatatatatatatatatatatatatacatacatatatatgagttggatttttggcacgcgagttcacatgtacccacaatctacaccctatatgtagcttgcacgaatcttagggcaaatatattaggtgctaacaaaatgtaacatgcatgatgtttacgttatactatattttttacaagtgtaaaatacgttgtttatgtaatttttgtatttcttgtatgcaaaacttgtttatgtaatttaccttgtttatataaattaccatgtttatgtagtttttgatggtaggatatatatcattttgtaagtatcatttttgcaagatgacaatttggtgatatagtagatatattgttttctcattttcactaaatatcatgttataaacaaaataagggttagagaaatacaatgcactagatatataaatgtcatacatatgattattattgaaaaaaattatttggtaaaaaatacaacatacatgttatacatattgtgaaccaacctaatcctaatcttttctccctatagtaatcattcatttggttaaggttaggtacattttgcagcacgaatcttggaacacatcaacggtgtagattgtaggtacatgtgaacccgagtgcaaatatgcattttcctatatatatatatatatatatatatatatatatatatatatatatatatatatatatatatatatatatatatatatatatatatatatagggatgcgctaaaccgcgcctggggtgcgcaataactaaactactcctctcacagcactcctccccacccaccaccccccctggtgcccaggaggctctcccgcacctttttctctccctcaccatttgtccttcagtaaataaattacttgcagttaatatcttcttattagtaaatgaattactaactaatatattgatttttgcattgtaatcccgcaccttttggcatgtccattccaactgcaacccgcacatttctcttgcacacgtagtaaataaattactctctgttaatatcatttattagtaaataaattactcggaatccaactcatttcttctctcagtaaatggattactcccaggttgtagcccttctcagttggttcattctctcagtaaatgaattactgtcgggttggtcttatttattctcttagtaaataaattacttaagataatacaacacttaattggatatcataccttctcgcagtaaataaattacttaaaataacgtattgatatcgtctcaagattttcttagtaaataaattactattacaccaatctcaacataacatattgacattgccaacaaattctcttagtaaccaagttactattacaccgatggttctcaacatatgtctctcagtaactaaattactattacatgcacgaatccaacaagcaagacaacgctagtgcctcatatcgatgttgagccgacaaagcactatagattccttaggtctccccatcgataggtatccatcacccacgaacatctagagaggcatcccacatgcacctggatatagacagaaacgattacatcatctaagagaagtctttaatttacactcataaatgactctaaatgagatatgattcgctgaagaagaaataaaatgcttcataaaaaattgagcagcaggaagagagaatatgtgcaaaatgcagcctccatctgaagaacataaatcgagtagaataaattttagaactgatgagtctatactgctttatttacaggaatacactccattagactgatcatagatttcagatgttcacatgcatgttaaattaagaaccaaaattctaattgacacattatcagttcgccaagataaatccagaaaaagtgtgcaaagtgtacgacatgaaacatttagagcgtccaagtcaaatgaaccaaggatcctatatcttcagagatcacccggatatcattgaggtcaagagaaaagttcaatttggcagtcagtaaagatctgtttctagggaacatattattatgcataaaaatgatactaatcaaatagactcgtcctaaatttttcacgataccaatgcccaaataagctaaaatgatatggaaattattcatggatgaaaactcccttggtgtccttgatccgcacctgcggaactagtgaaggacatgccatgtgcacatgagcaattagaacaacaatctcaatcctctgaatatgaaaaaaaaaagcatacttaggcaacaaaaattattgtgtgcccagtagcaaaacacctgcaccaagaacagggatttgtgccaatagactgaacaataaaggtctcaatgtacatcgttgtcagtataatcctcatctgcattgatgctgcatccggattctcactctgcccctgcgaaaaaaagacatatcttgtcttttcatgtctagttataaacactaaactaaaacctgggaaaattgcaaccataaagcatagaagattgaatcgagaagaaaaaccaccatgaatctgaacaacgtggggaaaaaaggcctgatcaccgatcatgcaaacatgaaaaaacaaaaacgaaaaaaagagaaagggaatagatcagattggcatggcagcaccaaagacactattcctttcatgggggatgcagacttcaatcacgcagacgagttcggggttgttgatggtgtcgcttgtgaaggaacgcagatggcgccggccctcctcctcctttgcccgcaccaacaacttatgcaaatccaatccaaatgttgctactacacctcctcagcgtcctccacgggcggcggacgagggcagcgggcgtgggcgatggtggcgatctggaggccgcctgcggacaaaggcggaacggcggccgccgacgaggacgaaggatgttggctcctccgtatagctcgccaacgtggagcagatcggcagcggtggaagggaagccggtggagaccatgggcggaagaaaggcaggcgcccttcgtcgtggagcttgcctccagatccaggcggcgtgatggcctctccccggtgctgccttttctcgaatcgccgccggcaacctcctcgttctagatctgaaaaaagcaaaagaaattaacaaaaaaaaatgagtgtattaaatcctatatatataggaggaagtttagtagtaaaagaattactactgtatgggaaaggggaggaggtcgggggtacaggggaggggtggggtgggtaggggtgggttgtgccatctgtagtatagtatgtctatatatatatatatacacatatatatacatacatatatatatacacatatatatatatatatataggttcctactaccaggagtagttactccctccttttaacgggtcaggttagtggaaccatcttgatccaataaccggtagttaggttgtttttttaatttaaacaattaactaaattgtttattagttgaaattatttcttttttgttagttgcatgcaaacgaacttctgcattggaatttctgctacgtgctggtcaacagaagatacatgttagctagctaaactgaatttctgctcgtttggtgcatgcatatatttcccatgtatttaggaacgttaacgtgatgaaaaggcagaaaatatgtgaacgttgacacatttaaaatgcacggtctgtgaaacagaaaaggaacagagcattagttgagaaggaagcagaacattgtttggaaatgcggcagaacatcacttggaaaaaaaaatcccaaaccgaaaatggagcagaatatcgtttggaaatggagcagaacatcgtttggaaaaaaaaatacattctactcttcctagacaaactccatcttctgctcgtcccggcagaaaatgtatctaaactgaaaatggcagaacatcaaatgaaaaaaaaaatccaaggaggaaaataaacctcaactaaaatttggcagaacgtcaactggaaaaattccccaaatatcaagggcagaacctccctgggtaatacgtgattagttacaaacaacaattgcggcatgtgctccgtgatggccgagtccatctgaacttgtaaataggcaatatagttttattagctagtaggaaggacgaaagcttaacaaaaaaaaaaaaggtgcagaatatgttctgctggtgtaactgaatcccatcctcttataggaagctctatggcaagaatacaggcagaaagtttctgcttgggtaactgaatcccgttctcttataggaagctccctggcaagaatacaggcagaaagtttctgctcgggtagaaacaggaacgggaaaggaagcagtatgtgagtatgtgactcagaaaaggagcagaacatcggttagaaaggaagcagaaaaataatttgaacagaagcacaacatcttctgctccttcaacaaaatcgtcactaagcagatgacgttaaaaaaggcagaaaattaaaaaggaatagaagaacatcaattggaaagaagcagaacattatttgtaaacggaacagaacatcaattagaaaggagcagaacattatttggaaacggaacagaacatcaatttgaaagggagcaaaatggtttctgccaatcatagtgtccatgttctgctcctccggcagatgaactaacatgcattcgaaactgtttgtatcccacgaaaatagcggtcggcattctaaacgggttggataacatggctaattaactccgaaatagcagaaatttgcactgccacgtagcaaaccgtacggtggataagctggaagtagttactcccagtagtagcttataatattcatatatatatatatatatatatatatatataggcaacatatcctatgcacacaggccctcacgtgtacacacgtgcacaccaactaaaaaatgtcaccaaaaaatttagaaaaaatcatacacatactttcaattgtattacacctagggttaaaatcttaacatcaaattcattatattttagccgtaacaaaaaaaaaacaaaaaatctgacaattttaaggttgcaattttgtcagaattttatcttttttgttattctctatgtagaatgaatttgaagatgcgactttgcacgtagatgtaatactattgaaagtacatgtatgaattttcctagaattttttgtgataattttagttggtgtccacggtgtgtacacgcgagggcctgtgtgtataggatacgctcccatatatatatatatatatatagggctgcaggaat

SEQ ID NO: 61546 - DNA, 768 bp, Oryza sativa
tccctcaaccgcaacggcaacaccaacaccagcaccgatcccccagaattcgaacccggaggaccagatcggacgacaaaagggagctcgcggacgagacggagctcgggattcgctcgctcacctgggggggcaggaaaaggcacggggccggagctcgattcccacgggcggcggagctgagatctcacggcggcctcgccgcctcagggcaccacgccgagaccggcggcggaggcaggaaaagtctcgtgtcgtcgcggtcggagccgaagccgatgaggaggaaccggaaacccaacaacccgagaagccaaaatacctctccctgctccccacgcgtccgccatgggtgaatctccaccgtccatctttgatcggacggtcagaaaccatccccagctgacgatgggcttttttctcggcccattgggcttgcaattgggcccatttgtttgtatgtggctaaagcccaccagaagagagctgtgtcctcgtctcgtctcgtcgccggcgaagctcaccgacgacgcgacgccaccccagccgccgccgcagccgcagcccggcgaccggcggcgccgcccccggctccctgacccgccgcggccgcacgggggtaaggcggttcccctgtcggggctctcgccgcaggtacgcgacgttgcctcttcttgttcgtttccccccgtgctccggcgatcttttcgccgttccagatccgcctccgctcccgtgctttgacctggcgttgcgcggtttaacttt

SEQ ID NO: 61547 - DNA, 711 bp, Oryza sativa
tgccattcgttacctcatagcttggcgaccggaagaaaagccaacacacaaaaaaaaatcccacatattttttttctctctcctccttggaaacaagacaactcatttattgtttccccgagtcgagtccctgttgctttgcacatgaactctactcggcgggggcatccgtctcatatgctaataatatttgaagcctgaatttacaagatgtgtgtgaagaaggcctttatgacgcgtggcaaaaaaaacacgtggcaaaagaaaagaaggatgacaacgtctatgatttccggacggaaattattcctactaagtttactgtggtgttcttattacagtgatatgattacttaatatatggttggatcataccaatgtccatgattttcggacgacaattaatattataagttgtacagtgtaatgtgctttctacagtgatttattatttaattgggtttcacccgtgtccaagattttcggacgacgattaattccaacaattctgcactgtaacgaatttttctacagtgatcttattatttcatgaacaattggattatgccaacgtctatgattttcggacggcaattaatcctatcaagtttatactgggacgcgttctcacagtggcccagtcaattacgtacagttgcactgaaccagcatctatgattttcggatgatggtcagtcaatatttgggagc

SEQ ID NO: 61548 - DNA, 706 bp, Oryza sativa
tctagcatatgtgaaatcagttccctggagagcatctccatctcaaactgccatgacctcacagagcttccatatgagctgggcaagctgcattgcctgagcatcctaagggtatacgcctgcccggctctgtggcggctcccgccttcggtatgcagcctgaagaggctgaaatacctcgacatttcgcagtgtgtcaacctgacggacctccctgaggagctcggtcacctgacaagcctggagaagatcgacatgcgagaatgctcgcgactgaggagcctcccgaggtcgtcctcatcgctcaagtccctcgggcacgtcgtgtgcgacgaggagacggcgttgctgtggagggaagctgagcaggtcatcccagacctccgggttcaggtagcagaagagtgttataacctggactggcttgtagactgatgttcctggatgcttttggctccaagctcacctttgtacagatgatgtgtatatttttccctgtctaatacaggatggaggaacaatccactctgcaattttgacatgttcagtgttcatgcaactgactctccagcagcagccaaagcttgctgagaaaatagaaccatagaattaatagagattttttcttcttggcacaaagcatatttacatacacatagcaaatacattaaccaatacatctcttctgtctctctgtttaatacaa

SEQ ID NO: 61549 - DNA, 673 bp, Oryza sativa
agaatccagggtatttcaatcacaaaatttctggaaagttttcggccgattccgagttcagacgaaaactgcccttatcattttcgattccgttttcgagaaaatatttccgaattcgtttccgtttccaaaaaattccgaccgacagattctgttttcgaaaataggttcggaatccggaaagttttcgtaccattttcaccccctacctagcaatgatttatttggtgcatgccttttagagcccacatatcctaatttactgtgtgtatagggttaatttgatctatgccattgcaaatatgtctattcaaataaatgatgtaattcgtctgtttatagctgtgccactcaaatattaaccaactgggccttacatacttcatacttcattcatgaaatccaacggacgaaaatcatctaatctaacgcctcagatcgtcccacatacccccttcaacctccgcacgtattccctcgccgaaaatcatgccgctcacatcgctcctcctcccccacgcgctccgcaacctgcgccatcacctcccatgccaccactagcgccgccccactccccggggcaaacctaatcgccgccgccacctactcctctctcccctgccgtctcaagctccacccccttgctcctcttgcgccaccactggatcactct

SEQ ID NO: 61550 - DNA, 695 bp, Oryza sativa
ggttgtctaatatcaccgtaaatttaccctgttaggatcagtacaaatcattatttacttcatgggcccatcaccggcccacataaagatcagcccatcactgaccgacatagtgatcggcccattaacggcccacgtatcatcgctcgcccccacatcccgacccgttcacctctcccgattctgacccgctcctctctctctctctctctctctcttttcctcgtgagttcgcccgccgcctcgcctgcgccgatctccatcgaactcggcgagcagccgaggcggacctgctgcctccttccgccgcaagcatcctcgccgccggtgagcaccaacccacacgcaccttcctacccccgcaccatctgtcttcgcctaaaccctagcttctcttctcctagatctggaagcttttctcttaatttgccctaaccctagcactaatagcagcagtttgttacggaataaagttttgggggggggggggggttcgagtgaatccccatgcccccacgttaagatccgcccggcctggggaggtgtattcgttggatttatttgcttgcttttgggttgtagctcgcaatttctttcttaccacggtttactgtagaatctcttagctctaagggtttgtccatttttttatttttgggcgtagcaatgattgaccacagaggcacagaccgagc

SEQ ID NO: 61551 - DNA, 3935 bp, Oryza sativa
ttagcttgatatcaatgagaaattgcaagttatcaactctaaagtgagcaaaaatattaaacagagaaaagagttgtgagtatggaaggcatcaggagagctagcaccaggagagccacaacgacgagctatcctgtgcgcgtgtttgcatgtttcctcgtgagaccatggacacggagcctttctgatcccaacagtcttgtgctgcggggaggccaaattgcgggatgatggcttggctaccgcaaatatgagctgcatcagcgtgagaatcgcgtgcctgagccgaccaagctacctgagatggggtcttccagcgttctctattccgttggttctcctgcccatacttgtcgatcattaggagcgcaaggaaaccgatcgttgggtcgaaatcatattctatcctagagtttccttcgaaagcatgcaaacccatgcacgtgatagctttgtactgatcgcgcaagtttgcatgatttcaaaggaaacactgggatatagtatgatttcaactcacgatagggtagccaatctgcgctagaaaggccagaatgccattctcatgagtcacacagcccaggcgcctcgtgcctcagctgtccaggccgtacgtgtaggcgcgcttaattacctgcctagcttgttctcccgcactggttcgagctagcgtgaactccacaatggctgggttgcaccggcttgctcaagtgtggctacgtagcctccttccttgtcccctttgctcccattttccagtgttgtccgtcgagcatgcatgcatatcactattatttcatttttatcattcggtattataaactaacatggagatggactttcatctctcaaggggcatacccatttcttacatatatgcatgccacacctaaataatcatgaaagtttttaacaagatagattaatataaggtatatcactttacaaacatataaattcaaatttaacttctataattataccagaaataatctatcttttttttaaagaaacaaaaataatctatcttgttaattctatgggctgctctcatttcatcatgtagaaaacattgctacatcatgtagaaaacattgctagacttacgatcaattctccctttcatcttatttatatggacaattttattatccttaaaaaggtatcaggaggtattacattttctattataaaacttgataccttatatatatatatatactagatgtcttgacgtaccaaaatttctgaagcaaaggtacctacaattactttctcttatgacccagctgtaccttcattgctatacacacacatcacctcctgctgcttccagtggcggagccgagaattgatcacgctagggccgattagggctaagttgatgtgttcttagtaaaactctttatatcttcagctttttatagtattttgcataacattttaatggaaatttggtcctaagcctagggcctaagccctaattgccccacccttgtctctgcccctagctgcttctacagttgagccatactttgtatgcattacactgtgctacatcgaactctcattgggtatggtaggcatcgggagagccttgtcgatcccacagcagcacatggcccccaagcccctagaacaacggcgcttgcctcaaaatgcagtttgcctccacatgtttggtatagggtgacacccttctttctggcagtagttcgaacactctttggaggcaaagcttccacagaaaatgttccggcctccagcaaattaaaatggaagcggcaaaaatacacgcctgaagccctatgcacggatgtattgaggggatgttcttctactggagtctaccttacgcatgcagcaggccttatgtaacgtgatgagagattttagcttgcagtttaagagaaaaatatatggcttgttagtttgtgaaatggtgtactgttaagatcgatctcgacaactgttattgaaagaaatatttttcagtgatcatttttacggtgagttttacaatggtccagaccattcatatgtttaatctaatggattcatatatttaatccaatggattgtatctattcatactatcaggtagtaaaatacctttttatatcaacataaaacttataaatcaacattgagatcatttctatcattgatactactatagtaaaatattactggtagagatcaacgattctcttgaacaaatttccgtagttttggatgacgcactagctaggatcgtaggttgccttgaccattctaaatatgattatttagactatgaaaaaaaaaagaatctataccgattatattaccagtagtgatcatcgtaaaatatctctatttgtattaccacacacggtactagaatatttttcactaatagtgtagaaatataaatcagtaaatcaatagaggatttacaatgctctctattggtaggaaaataccaccagtgttatcatcagtagaagtaatcttgaccattgatttacgactccactattagtagtagttgatgcagatgtggtaatataaataaaaaataaaatttattggattaaaaagagataaatagtctatattagctttactgatagtaaaaagaattgcccactttctctgataacatcaaacgtttcgtgcgcccagttagacgcagcttcagtctctatatatatgtgcacacaacttgcacctgagtcggatactcctgtgatcgaagcgttgctctaataatacaacaaatcaagtggttgatcaagtaaggtgtaagagaaaatgattgatgtatcaaggggcttaattcttttggcatatattgggaatggaaggaaccaggagaaattctaccacgatattctggatcagcctcacgggaatttcttgagaattttcttgtttgagaagaatttcaggtagcttttcgcttgatggagcaacaacagtatatctgaataatgctgacatggactgcattggctggtgtgtagatgatcctagcaaatgtgatagacctcctctcagctcaagactgacgccagcaggaggcaaggcatgtatcgttgatacaacttcctgctcgagaacttctctgaaaatcccaaatcctgaattaatgtagcgattcgatgtagagcatcaccactcactgagtcactgtggttgcattggtccaatcgacgattaatgcacagacatgttcatcacatatatccccttaaacgccttttgcgatatgatcaccatggcatcaattcgttgtaactagaagacatgaaagtgttcgtaaatttgacatacgtatgtcaagatcacgtgaaaacaaatatagtccctgtgttttgaattacttattattctagtaaacttcacataaacctacattgttatcctcgttaaatacatcccagttattttttttcaaaccatatgatccaacggaaattgtgactctattaatatatacctgcattgatgaagggtagagaggaaagatcacgtctaaagtgctttggaatatgagaaaatattttggcacaaaatttaaatgctagacagattaatagcaataagaaacataggaaataacttaattaatttgcaaaaccaacacggcaacaccttatctttttgtcatcttactatcttagccatgtccccatatattagcaattttacggtttttgaggagataccatcaggtatcactttttctattgtaaatttggtatcgtaaatttggtatctatcgatttctaggtgctataagatactaaattcttgtatctcatgataactcctcaaggaacgtaaaatcgaactcccatatatactacacttcttcatgcctcacatgcccttcgtctgcattatcaactacgtgatcccatctcgacatcagttcgacatacaagtta

SEQ ID NO: 61552 - DNA, 7271 bp, Oryza sativa
ccgcgcacactatccccgttgggaacctctagtagcgaacagatagcatggagtttattatctcacccctccatgcatgcactcctctacgccatgaccagtgtgtgtttattctgaatattttttttctacctttttcaccactgcccaatgcccacttcgtttaccttatgctactgttttacttaaaatgcaatttacttcttcacccgctactactttaaccctctatatatcctgagtagagcctcgctacggtgctctccactaatagtagaaaacagtttgaaccgttgatcttatttgagctaaagattcaaaactatttatactaccacccaattagcgatagtagaaacataaaggggtattattgtctaaaagaaataagtgtgaaaagatataatcgttattagcagtgactaaacttttttccctcttttttagctttctcgatgaaatactacttgccaacccagctgctacccttctttctcgatgatccttatattagcttcatgtcagtgagaagtagcaagctagctatctacccaagaaaacatatagaagagtgtgtgagaatggaaggcattgggagagccaacattaggagattaacaagtccgagctatactgtgcacatgttatcatgctcgtcccagatattctgggcaacaattcttcgaattcgcaacagtccagcgtccagggggagataatcagggtgttaacggcctggctgcctcgtatagcctcaccagcctgagaattgcatgcctgggctgggttgatcaggcttcgtgtgcacctggcggcgcatttccctgattttttcatgcctcacctaacctattcactgtattttcctgtttttctgaccagtgaagatcagcatgtggttcttgatgggagaattcatctgatcttttgcatatgttgtgtacctttcggttggctggttatttcatatggttcagtagaggtgtttgtgccctggaatgtcaggaggagcatcatgattcaaaatctcattgtttttacttgtttcttttttcttgttttaatctaatttaagtttaacactcgtacgaaactaccaataaatttgcaaaacctactttgtggtccatgatgcacacaccatgtaccatattctggaataattaatatgctacatctattttgtcctaacaatttgctttctgaatttaataggattcattggtagaggcagctaaagaggaagctaaattaaattattgcgcatgctactaaataaaattatactccagagtctgatgtttgctttattttggtttgttgttatattggtaaatgtaatgtgctagtcaatttggtctgttctgttaactattttcgttgcgataggtttaagaaggaacatgatgtgtaactaaattgtatcttttactttcaactgaaagcagactttctaagggaaaatgtgcatgaaaatggttcatggagtgttgcaaaaattagggggttgctaattcgtgcatacgcgccagcaatggagttggcgcgcaagttggcggcccctcctcctacgcgcgtgttttcttttttctttttctttttccaattttggcacctcccttaccttagcgtgtttttctcaatttttttcccgctgtttctttccgatatttttaatctttcgcacacgtattttcaaatgtagaattgaaaatttttaaatcttgacttgaaagtttttcaatcttaattgatagtttcaaatattgagttgaaagtttttctaatttgagataaaagtcgaaaaaaattgattcgaaaatttaaatttgagttgaaagcttttctagtttcagatgaaaagttgaaaatttttaaaatttgacttaaaaattaaattttgagttgaaagttttaaaatattagattgaaaaatttcaaatctgggttaaaagttttcaaaagttgacttgaaagttttgaaaatttgagttgtaagttttcaaatatgaatttaaagtttcaaattttgtgttgaaaatttcaaatttagagacatgtttaaaaattgagttagaaagttttaaattgtagatgtactcacacgctaattatggcgctaaccacgtggagggcgtggagggtgatgtgtgcatgtgtgggcagtgggcctgcgcatccgaaacgcgcgcgtggtggcttgaccgcgcaacagcaatcctggcaaaaccatgatctgcttataccactcaattgtgctctttgtattgcaatgcctgcagatgttgccacttgttactccctccatttttttttttgacattggttagttcaaaattgaactaatcaatgtcatacattaatttgtgcaaggaggtagtacttgttagtgttcttgtgatagctttgttagtgtattgggaatgcaaattttcatccctcgagaggacatccctcgttgtttgcatgtcatctaaatagctattaaaaaataaaaaaattgacaataattaattcaaccctctatatcatcacaataaaaagaatgttagtctgagacgatcataactcctatgacttgtatataactttgctttcctgctctatcaatatataaggcaatcttcttgactttccctaaagaaacaataaaagaaaatttgggtgataaagagacaccatctcttgtcctgctgcttcttttcattttacttatgtacctcttctgacgggctataccttgtctggtatacacgtcgacggttgttactcctacaattctatgtaccacctcttgctcttgagctatgagctatgttggggttgggaggcatcgggagagcctggtccatccaactgctgcacatcgccaccgtgcggaagtgaccaagagtttgcttcaatacattcggccggctgagagaattcttcctggctaaatgtatttgcctttgtagttcgactgatgataccatggagctctacttatttgcaccttcagcaaaatggaaataccggaccaagtgtgcacggggccattcccgagttctgggactatcacactccgggcccgggtgttcttctcccagtctttcaccgctcgatcgagcatttcttaattattgcttaattaggacgtacctaattaggcgttgctaagtagcttaatttcagtttcatttctctgtgaagtcttcaaatgattctgattgacatatgtgactcaacttgcacatttgcaagaggaaattaaggaagggaaaaattaactcaattcgttgtgaaatggtgtgcaattaagatctccgtagttatacaaagtgactcgattgccttcataagcatcaacccggcctattgcttcctttctttctcgatgatccttagcccgacacgtcaatgagatcatcagaagtctgaagctatatatcaactcgatcggagtgagcaagaaaacacatagaaaagtgttgctgactcgtgagtatgtacataggcatgcatagaaggcatcgggagagcaagcacttgcaacgcaacaagttcaggatgtcccctgcacgcattggcaagcttgcccggaagagtccgtgctacgttgttctgagtcgcgatagcgcaacgccacaggggaggggagccgatcacggcgaacacggtggcctggtagcgtggctgggctgatgagcgcacgtgttcctggctcgtttcctcatttcggcgactaagccagccctagcgcatcacctgggcttgacgggaaatgacaccgggccgatcggggtgggtagaaatgcgctgtggcaagagatgtgtttttctataagagatgtgtggatttaatattgaggtcccatacaaggagcggatctagaagaagatttaagagggactcatctcctttttccttcttcaatctccttactctttattttcttcctattctttcccttttatctcccccttctagcaatggtgatccagcggtgtaggggggacttcacccacgctggatccgcctctggtcccatgtttgatccccatttcgttcccaatttctccataggaaaacgttccaaatctctccctcttttttttataggagtaactaatttttgatttttaatccatgcagcatatattctttttatcttttctactccgttgatttatatatattattcacgaaaatttgtcatgggtattgcaaatcacagtgcttgtaaatgatgtcagattgtcatcagttatgagtttcccttgataacttttatttttacactcaagaactggttaactggttaagattttcgagcattgtccatattcatataaatgttaatgaatctaggcataaatatatatctagattcattaacatatactccctcattccctaaatatttgacgccattgactttttaaaatatgtttggccgttcgtcttattcaaaaaacttttgtgaaatatgtaaaactatatgtatacataaaagtatatttaacaataaattaaatggtaggaaaagaattaataattgcttaaattttttgaataagacaaacggtcaaacatatttaaaaaagtcaacggcgtcaaacatttaaggatgaagggagtatatataaatatgggcaatgctagaaaatcttataatatgaaatggaggaagtagcaatttgcagtccttgagaatgtaccatgagataccaatttttccattataaatttagtatcccttgatatctagatactatgagataccaaatatacaatagaaaaaaaatattacctcatgttatctcctcaattaccgtaccgtaaaaaaaatgctcattgaaaaagtttcctccactgatcctgttacctgttgccctgttagcagtagcagtgatgtgtttgtacgcgagcactcattgattggtactgtttttctttcttttctttttcttggccctcttccaatttcccaataatggctcgtacgttcagctgccctttgcctgtactgtaggcacttctactggaaatcacttcttctcgccaactgcatgctctctcctatataaatgccacctttgataattattcattcataggactcatcggcctttataaacactcacccctgtcgtctcccttctttctctatgatcctcatagcttggtttaatacgaactcctgagtgagaagaaacagatggttaaacatgatttgatctcattgacgagttgtgacttgtgacagctagtgatcagtatgcatgggaggtgtcgcactactagaaaaatcatttgttgtcacgaaaaaaatcgtggcatcaatactaaaattgtggcaatagatatatgttaccacaattgtaaaatcgttgctagccgtggtaataaacagcatggtaataggttattgcaacgatttttattttgtggtaataaatttagatgttgctacggaatgaatgtggcacaaagtcatattacaacacttcacatcgttgtaataaaaattattgccaccactccatatgtagcattagttttacgtaccaaattaaaatttcaaatattaatctatcatcctatctatttatctagatatcttttttattttgtgtcttcgctaggatttgaacccaagacctgtccttcaggtgtgctctcctttatcaactcacctacgcatcaattctattggaaaatgcatatcgttccatttgagcctagctaactgagatttgaatcatatatttgaatatctaaaagatttcaaatgaaaaagttatcacctataaaattgtagatctcgtcgagagctataatttccatataaaatttgtctcaatccgagtccatatgaaaaaaataagttaaattatgagacaacaatttttttattgcaacgaatttgttgatcgtggcaacaaaaaatagtgaaaagtaccatgtactatataaattgccacaaaaattaaaattgtggtgatagaacatgcttttttgcaatagtacgattttttgtggcgatatctcattttttattgcaacaaaagtactaaataaaatagatcgttgcaataaaaaataattatttgccacagaaaaattatcattgcaatagtataatatattgctacgaattatgttttgttgtaataatttggtggcaatagcacaattatcttgtagtgttagggagagaacgcaccatggaatcaaaccattcaagcgctataacctgcttgggtggctgccttagaacactacgtcgcgatgctttggaatcgcgaccatccagcacaagggagacgcaggggctaaccagcaaccagggtccagggtagggcgttctgacgcaactgctactcgatcgcctcatgcttgaatgcttctgccgattcggtctgcacgtacgatttggtccgaaacaacacaacgtgcctcatgcgtgctcgtcatctccgtcaggacatggcaccgctgcatcgcgtgtgcttgtactttgtaccacggtcactgtttgatttagttttttaagttgattattaacacgaatcatccacttgattatatgaataaagtagatattctgtaagaaataaatttaacaaacagtttaaagaagtggtcaactaatgcagtagatatccattttcaatacctactccctccgtattttaatatatgacgccgttgacgttttaatcaacgtttgaccattcatcttattaaaaaaatgtaattatcatttatttcattgtgacttaatttatcatcaaatattttttaagcatgatataaatatttttatatttacataaaaaaatttgaataagacaaataattaaatattgataaaaaagtcaacgacgtcatacattacattaaaatatagagggagtactttattagtacccgcgttcaactctcaatatttttatattgtggtacgaaggtagttggaaagaaaaatgacgtagatatccattttcaaatgagggacgtttataagaggaagggtagttagaagtaagaaccataagatgagaataaatttgaatattagatgattgatgcgacaagaactgctactgtaggatgttattaactacgcatcctaaccttattcaaggtcttcgatgttgcgcaatattaactactccatccgacccataaagactacatgtctaacgttcaaaatttgtctcaaagacttcatttacagggtttacatgaacttcaatacatttggtcagctgagaaacttctt

SEQ ID NO: 61553 - DNA, 4423 bp, Oryza sativa
cctgaagcgccaaaacatgcactggcaacacccacatccctagagagaaactgcagatgttatcattgtcaagcttcgttgcaccccaacgacatagtagttccgactctacccgatagagacaaccgaagaagttggatgccaccaatacaagaaatgagccaagaaggagaaggcctcaccaaacacctaggcatccaatgcatcgagctgacacaggagtccaccaacagtaaacgatgcatgggtaaggttctccaagacgatgcccccaagaaggatatgacatgaaacgccaccaccgtccgtccggaaaccggattatagttttcaactggagattggtagcggtgaagaaaacgccataacgacgccttcaaaacgggaacaatgccaaaggtgtcgccgtcgtcatgccagccaaaggctaagcaaggctttcgccaatgatttccatccagagccactaccgacccacacaacaaccgtcgccgaaccaccacataatctctttagccatcagttagaccagttcaccaccccacggctcaggtagactcacaggcctgctcccgcacgttgccatggcattgccatcctctgcacaagccgccgggtccaccctctcctggagctccccatggccaagacaagatctggccataggagaggaggggctccacgaagagtggtttgctcagctagctgggaagacgggacaccaccaccgccaaccgcttccccgcgcacaccaccaggccagagagaggcagctcctcccccatgcgcccttgacgcacgccgctgagctaggggtgacaactcctcccctcgccgccgcggtccccgctgctcgatcctcgggccaccgcctccacgtggccctcacgccgcggcagccgccgccacctccgcgcggcccttgcgccgcggccactgcctctgagcggccctctcaccgccgcctccgccaccgcgccgcgccactaccgacccgcgcggctcagcccagatccagccaagggggaccgaattcgaactcgacagcgtcggatctagccatcgtcaccagggccgcgctctcgtcctccggtctcgtcggcgccccaaccggttgaccatgagtgagggagaagggggagtcccgccgtcgccgtctttgcagctgcccggcttggcagcgtggcgggggagaggaggggaagggagggggcgacggcgaggttacgccaccaacgtaacctaattgagttcggatattttttagttggtgtgtatggtatatacacgtgaagccttgtgtgcatatgatacgttttcccagttaatcagctccacacaaacgagcttgactagatactaaacggaaccaaacgtgcaccccatgttcaactaaggtcggcatatatgtagaaccttttcaagttctgagtttcttctttccttttagctaagttttcatcaatacttagctccggtggcagattggtgaagcacatgaacaaaaaatttaattttaccccggtctttggagggtagcaaagtacctaattgagtatgcaaaacacaatctgaactctctgaaaaatatgtgtgatctttttgttgtcctaaatttgtcccatagaacatgacgtgatcttgttgttgtcctaaatttgtcccatagaacatgacacaacaatatcattgagcgtattaattagcacctaggaacttggaagagactacgctaatcttagttacacacactcgagaaggttgcagcagcttatacacactgtattaagctgcgacatgatatattccctttttccctggaaactacgaattccctagaagctcaacgagtgttgggcttggctgtcatgtttccgccgcctttgctagcttaggttagttgttgagtgttattgtagttgtgattttgtccagtttttcttaatgaactttgtacggtaagatttggtctcgtttctttttaaaatggacaccttcttatttatataaaacattggcaacgaccttaccattcgggaaggaaaaaaaaccaattaatcaatccctacaacacaagaattaggtagatgtatttgggaacactcattgatttatatgtacattctgcttttttatttcccctcttccatcttccccattgcccattcaattgccatctgcctgatcatgagagggaatttacttcttcaactgctagacccctgacctgatgaactcctttataaacacaagcttgtagcttccctctttctcgacgaccctactctgagtgagaaagaaattaaacagggacaaaccatcgcgacttatgagtatggaaggcgtcaggagagcaagcccttgaaaaccaatcaattggagctatcctgtgcagatttttgcatgcatcttgatgagccatctcaaagaagaagtgcagtttggcgtgctaatcttgttcatcttgatccacggagctagcctaacaacggtggtcttggcaggattagccttcgccgagttggtcgtctcacagttgatctcggcagcctagcagtgtccttcaaccacgctcggacgcaagcacggtaagcagaaaggcgaggctgcgcgggcgttcgttcccgccataaagcttctctccatggtttctggcttgctggctcttcgtccctctcgtgtgttcttaggctgcttgtgcttaaatgtacatttgtaatttattaacaagtgggggtggatgatgagttcttcttctaccagaaattttattttcattcttgttctctgcatattattcagtaataggatcctgaccccagctcctaatctaaactctgtatttttcactgtttgcctgactagtgaattggagagctgtggactgtggttgggatggtagagtgtctgatctttttctgtcattaatggacctctggtttcttttcataatgagatagaagtgtttgtttgtgcccttaaatgttaggagaaacatatcgtgctttcatcatctaaaacctcacttgctgctacttgaacattttaagagttgaagtgggaacttaggttggtacatgcagatgtgtttgtgagcactcattgatatattggtggtatatatatgtgcatcctgaatatccttttcacccacattgctcattcaattgcccctctgcatatatatacacactttaaattggaattcacttcttcacccactactactcccctaagccaatgaattcgttcccatttctctggcctttattcgcctttataaacacctgccctcttgcttcccttctatccggataaaaatccttactcctgatgccaatgagaggttgtgtgtcctatcgactccaattgagcaagaaagacggagatcgagtagagctagtgactgagcatgagaggcgttgggagagcaagcactataaggtcaatactctgaagctatcgtgagcaataatgatgtgtttgcgtgcgctttgctaaattaaagctgtgggcaagaacttcttgaacgagaggtagctacagcgtgtggttgatcaagttactctagagagacggcatggctgccgcccgtatagttggcttggtgtacctacgcccatacaccggcagtgttttcttgctcatgggcagcttcagtgctgtttcttctacctagagtactcttaggagccaaaactttaattagacaagttaggccattttgactttatgtagtcaaattaatctctctaagtttaacatgtttacataaaacatcacagcattttcaataccaaataaacatactatatatcaaaatatattcaatatttggttttaatttggtgttataagagttgttacgtttctccgtaaaatcgatcaaatttatagaagtttaatttataataaaaaatcaaagtgttttgtaatatgaaacagacggagtactagaattttcatgcgtagtttgacctttttcacgatatgtttgccatcttatattgtggtgatactgtatcttgactttttcttgagcttggtatactgtcccctttgtcaattgttaatcgatataattaaaaatcatatgcatgcatacaccatatcaatagatcgtcgtacaaataactgaaggtcaagggtctgatcgaatcagtttagagttctatattgatttgcaaaatctcacttggacacacgttgtgttcatgagtgctagctaatgttttttcctccattttttttttccggagaactccattttcttccccttactttggctgtgttcggcagtggctgttgccatcctctactcctcgttttccgtgcgcacgtttttcaaactgctaaacagtgtgttttttgcaaaaaatttctatacgaaagttgcttaaaaaatattgatccatttttaaga

SEQ ID NO: 61554 - DNA, 2992 bp, Oryza sativa
ccgccatgtccgagggagcggcggccgccgcgccgtcgccggcagagatgtacggtgacgaactaggcgacctcgagaacaaggtgccggtgatagggccgtagacgaagggcgtatcgtacggccgggatgatgctgccgcgagttaatttatacgtttcaatgttcactgctccctccgtcccattttcacgcctaactttaatcgtctgtttttttataatttatatctttattgttatgagatgataaaacatgaatagtattttatgtgtgacttatatttttaatttttttaaaaaaattgaataagatgaatggttaaagttgtacgcggaaaattatggctgcattcaaaatgaaatgggggagtatgaagcaagagcgatcattaggctgctaattaacgtacgtttcagtatttaatttgtaaacggacgtgctaactaaacatataaactttgttaccgtaataatatattagttgacgtttatacatttgtgtagctctaaatttgcctattcttttttcttgttttcaatttgttcttcacttcttctgcttcagttttggacttcaaatatgatcagatgcatgcaattggatacgtaattaaccaattttgatccagtaaacaagcatttattacttttctaattgagagttacggaaagcatttaaacgcgtaatcgagctctaaataatgttgagtatcgtttctttctgaggttttaaatatatgcaacgtaacgcataatgacctggataattaacggtgctagtattttgatcaaacgcttaaacctaacgattcttaaaaataattcatcccatcaaagtatctctctgaaaagaaaaataatatcaagcttatctagctaatgaaaaataataactttgattaagctttttttaaaaaattaatggtagtctactctactctacctacaaacagtcctaacgggattttttttttcattttaattttttaatatttacagaaatattataccgacgaaaatatttacagaaatagaccctgccatccagtatagagcagcaaggtgacatggcacacggcgccgtgtgcgtattttgcgctgaggtcccttgctgttaaatgcagtttttgcctgctcagcggcctccccgagggcggtagggtatatttctgtaaatattttcgtcagtataatatttctgtaaatattaaaaataaaaattttaaaatgaaaaaaaattcgtcctaacggaagcagaagcccactagattagctagaacacccggcccatgggcttggcctacccacttgatattccaggcccattaagcccaacccagcgaagcgaaacatatcccacccaccccaccgtctctctccatttggactccgattccacgccgacgtcgccgcctgatcgtctccggcgccggcgatcccaaccgccgcaaccaccgcctctccctcctcctcctcctccggtaggtgctcgcggccgctcgacggccacgcacgtgctcgtgtctcgctgtcccgtccgccgcctcttctccactcccccacgcttccgctccagatctgcctctccgcccgcccggatctagccaccggttcgccggcccgccgctcgggagctgaaccgtgtggccgagtggcgacctctcctaccgcgtagccatggtaagatccgttcattctatccggtttcgtggtctgtgtagcgagcgctgtgtttgcttgcgcggggggaggaggatgatctcggaggagattagtggtaggaatggatctagtgttgggactgagatggatgaactttctgccatttgctgttgttggtcttctgcagatcaatttcgtgctcctgatcagccgccagggcaaggtgaggcttaccaagtggtactcgccttacacccagaaggagaggactaaggtcagcatcctgtactgaattctgtaccaaccactgatcatatgatgctgatgctgtttctctgctctttgagcatcactagcggtggctgttgcttctgttcaatagttagacgatatgctttgtagttcgtgtgatccatgtgccgtggcagggtttgcaacttaggctgtttttgcttaaatgtacactaattaaacaagcatattattctgttctaggatctgtctgtatttagcacccatgtttcagtggaccttatgatgatgatgattcttgtctcatgctcaaaggcacggtattggttcttttttggttccacttgtgggtttaatgtttgcggaaacccgaaagatctgttctgagcccatgaataacactgtaggtgcccactgaacattcttgacagaatacacaaagcctcttcattttattattcttgggtttgcagtgcccaattgcttatgttctgttggtgagctgcactgtactgtttatcttgtatgtaattttctacacttgttgaaaaggttatccgtgagctcagtgggctcattctaacacgcgggccaaaactctgcaactttgttgagtggaagggttacaaggttgtgtacagaaggtatgattccagcatgtcattggtgttctattgtttgactaatcggttatgttgcttcgtggtatcttctaaattagctattttatgttctgtttataattatggtggcaaggtatgcgagcctgtatttctgcatgtgcattgatgctgaggacaatgagctcgaggtccttgaaattatccatcacttcgttgaagtactggaccgatattttggcagcgtgagtgctttgatgctgtttatcatgtagcttctctttcatttgcttgttgtactgctgttttgagtccttgtttcaacctcattaggtatgcgagctggatttgatattcaatttccacaaggtaatatcttttggttctattgaagttgctactacagaggatctaggattggaatttacatgattcttcttgctagtctattgtca

SEQ ID NO: 61555 - DNA, 15601 bp, Oryza sativa
acaggtacctgattgaaatatcatgggacagaagaataaactgactgaatgaaaactacaaaattttccaagcatcatataatagacaacttgcaggattgattagattatgtgaataataagggcgattgaagatccctttagtgctatgctatttaggaatttatttttttctcagcaaatggttccatctaaatgtattgtgataactgatagcaggcagaaatgtgctgtgacaactgataaaagataatggaatcctattcaacttaacataatagcaagtagaaatgcattgtaataactgataagaatgaagtgtgttacaaacttgccatggaaatttcatcataaaataggtaagtggaagaacaagtgaggggaatggtgatgatctggagttacatgaatggctaacatgtaggttgcatataccttagtcaaaggctctgagaatgctaacataagagcaaaacaggggcgaacagggatatcctgaatcatcattgacaattgtggaagcaatgacaaatctgagaaggaaaaataatgcaactgctcagacattcagctgagatatcataaaaataccgctgttctgtgtaattaggaacaatggtacaatgtatcctacatgagtccaatcaaacaccggtttattttgacattaagtaacctgcattgtacccttcattaaatgtgcattttcttgctgtcaacttattgtttggacatggtagctgcaaaaccatattctttaaaaggaaaaaaggaacaatcttccataaggaggcaggcatagattcatataggagcattttcttactgtcttcactattttgtcaatctattactacattttaaacaaatgtagaaatcttaagatacagacaatgataaaattaagttatagaaaacaagagttatttttctaatcaaagataaatatggttatcctggttaccataaaccgtcagaaaaattagaacaaagaatttatggtgaaagaatattttctttaattaattgtagtgctagacctcctgatcaatataatttgctaaaaaaaactattgtacaatattgtctttcaaaacataacataagttcataaacccattattttgaaacttgtgttatggtagtgcatattatgaagataatagaataaaacgaaccaagaggcggtggtcttccagttagcccagaaaatcttggtgatgctatattcttatcggttgctacaacataatcaaaatggccaagatctctcccatccaaactagccagtaaccatgaactcctatcttgaatccagtccatcctgccaatggtgacaccaaatttggccaccacacctaacaggcacaagagatagcatgtatgagcagcaagttctagattgctggtactgaagagtcataaactcataatgctacaaagtaagtctaaccatcctctagacaaagtgatttgcatattgagttcatgcctggcactcccacatacttcttaattgttccctcctgtgcgaatataatgccagaaagcttatgttagtaagtagaaagtatcattttaagcggtgcagatacataagactacatatcattctaatccacccccaactccatcttttgataaggatcagcactacaatagtaccatcaacatcagagacatcacaggttaagttgattctgaacatgtgagtaacggtagttcgatctatccactaaatttttagagtactgcacattatatattcagtgatgagtagatttggcagcagaaagatggcttactattccaagtgcaacctactgcattctgcattcagacattcagttaaggggttcaccagtaaactatcccaattcccacagtcatgctaccactagatacgtgacatgttcaagttgaagcctcaactatgggagggtttcgaagcctagaaccttctcgaaatcagtgaatttgccggcctcccgatcgaagcacgcgaacatggccttccactcggcgacgagcccccgcgcctcccacccgctcacgacccgagcaacctcgtcgttgctcacggtgaagtatggcgcgccgtggtcgaatcgcagctccgtgccgtcctccatcacctccctgcgcccacacaaaccagcaaaatggggtggaaaaaataacagcaccgatcagcgcggaaccaacacacgcggcccgggcagtaaattggtcgagcacctccgctgcgccatgcggccaccggccccgcggccggagtcgaagagcgtcaccgccacgccgcgcgcggccagcagcgacgcgcatacagcgcccgatactgcatcggtggacaaaccaaaaaggggatcgcaggtacgggtcagttcaaacgggagcaatcggatcagagagagaggatgagggattggaatgggctgcgtctgcttacttccgcccccgatgacggcgacattggcagccgaggcggctgcggcggcggcggcggcgctcattgttcgaggcttcccggcgacggggtgcggtgcggagaatggagagcttttccgatcgaggcgggagggcttggctgcttccgcggtgaagagattgcgcgctgcggcgtcgacgtggcgtctcgtggacccctcgcttttctgggctcttctccatccggcccagcaactgaatttggcccataaggtccaagtcttctggactaatcttttcgctcatgcttatacttatacttatcagccaaaccaaaatttgaatttttaatcttaaatttaaagttgattttagagttttttttgttatcaaagtttattttacaacatttgcttttaggtcactaagaagcggaaatcctgtttggcgatcgatcgccctggggatggatcagcgatcgatcccctcccccctccctcccaccacccctccacctggttttcatttttggcaccgcattattttcttattttagtaaatttatacacctaaagtttatacacctaaagtttatacatctaaagtttagagaccaaaagtttataagtcaaaagtttatatatccgattcaaatttgaatttgaattcaaatattttttttatatatagtatttctatacatctaaagtttatagacctaaagtttatagatctaaagtttataagtcaaaattttatatactcgtttcaaatttgaatttgaattcaaatattttctatatatcatatttctatacatctaatgtttatacacctaaagtttatagatccaaagtttataagtcaaaagtttacagacccgattcaaatttgaatttgaattatgtcgacgtttgatgtctcgactacggtatttggacagtatggggatcgtcggtgctaggatatacgcgagactgaggtaaaagaaatggggacgaggatttttatgcaggtttgggcccctgaattgtcaggtaataaccctacatcctgttggccgaagccggtattgctctttattcactataatcacaccagtacaatatgtggggtagcctatctaactgttgtcgacatggcggtctgaagatctgactcgtagtcgacaacagggtagccttcctcctcgagctcgcgccctgacggaatcagagacagtgctagatccctatggccggcctctgaaggtaccggatagggtcgatccaggcgtatctctgatgtcgatatctggcggcttgtcttggtgtatgttgacttgtatgctgtggcttctatgtcgattgtgttgggtgttgattttgtcaggtgttaatcctgttgggtgttgattgtcttgtcccccatggtggttgttgatcgtgttgatcatctcatatcatgggtgtccccctgtcctcctaggggggcttgtatttatacccataggtgtcccctcgtccaagtagaactagggaaaccaatatggatacaatccgagtagtccttgttgtttccatgtagaactctggttgtcttttcttatccagaactccctccatatctgaagtcagtttccgtataagacatggtatgtggtggatcctgccaagatttagtcaactactattaggtatgtggtatccataaccctgacagtagcccccgacttcgatgcaaatgaacgaattcatattctcaaccgcgcgcaaacattggagtaactgttatcgagctcatgtgaccgttctcggtgagtttagagataacgttggacttcctttgtcaacctcgtgcgagcaccgaaagggtttgtgtaagtcaatctctgatgtcgaccgagaaagtatagagcgtacgactaattctcacatcttgctgtaatcgagaatttggattgaagtcaagaaattttatctcggcgggtacaccatctcttcattccgtattccttgtcgagatctagcaaccgttctcgagcgattgagaaggcgtagagtctgcgacggaactttgtcgacattggtcgtactcgccttagtcgatcttggtgtagaaccatagagacatggagtcttcgtcaatgtcgaatagaattttcctgaaatcaatactcagaaaagaatatcaaataaaaatagcccccgagcgaacgctcaaagggtgacacgttataatatgacagactagtgaattgaatgtacagaccagtgctttgtatatgagtgtcttctctcttaccgactccgatcagtcagtttgtagagtcatacactctccgtagcccccagccttgtcgtcggagaatcgttatcagaagataaggctcttggacctttgacctgcctcggttgaacaagcactgattctagcccctagccgtgaagttggaaaatccatttccgattacacggcttagttaatacgcacggcgagaactcttacacgaccagatcttacatggtctttcgtctctgaaggatccgacaaggccttatcggctctgggcgtgcccagccgaagttccctcaggttcctcggaggccttgtcaagacggcgtaaagggacagtaggataggtttcaacgctaggtgtcatctgggtaagggatctctgggtaaaacacttggcgatcttgtgtacctaacatcaactttattgaagcaggggtaatgggagaatcgctggtcgaggaccagacagtagttgtaactcgaccatttgaagtggaaatagtgggagaaacgagaaacactacatcgctagtcgaggaccaggcagtagtcgtaactcgaccacttgaagtggaaatagtgggagaaacgctacaccgctggtcgaggaccaggcagtagtcgtaactcgaccacttaaagtggaagtagtgggagaaacgctacatctctggtcgagaactaggcagtagtcgtaactcgaccacttaaagtggaagtagtgggagagacgctacatcgctggtcgaggaccaggcagtagtcgtaacttgaccacttaaagtggaagtgatgggagaaacgctacatcgctggtcgaggaccaggcagtagtcgtaactcgaccacttaaagtgaggcaagagagatcactacgttttactggttcgagaaccaggagtaggagtctcttaatcacctataggggcgctaaagttggtttattacatgtgcatatcatgtggccagcatgactcccatacccaacttatagcatatccggatatccgttcgcaatcatgtcgggtgatcaagccgacggcgttcgcgaggaattatccgttaacaaccttttctcgagtagtccagcgatggccggtgctatgagataggtcgtcggtcttcgttggcaggttgggtgcgataactccgcatttgtcgagaatgttctcgataatggagtgtactcgatcataacctactcgagtgctcaattgttcctgaaaaatattttctagaatgcaagatatatagcagataatatcgagtatgtactcaaaaaactgcatggatcttctagtattatcaggacataacgagcagatgtaattattaggcattatgtaaaccgtaaacaagaatgatttatacataagagaacggagtgagcccccggcgttagacaatagttggcctatcgtcggaagtactcgcacaatggatattgtataagaagtatgctctaggtaaacataataaattattgatctgacaatactgtatgatctgaaaagtaggtacggtaaattgtgtatataatattgcgtacctttgtagatacatgccggatgtatatacggaattattagattaattaaaaatcaatcttactaattaccttatttgacttgcatatggtgaacagccatcacacgtggctcccgagatgatacacgtgtactgtacggggagtccaccaatccgatcagtgcatggtcttatgtgctgatgtcatgcatgctccaaatggtttatttttcaacatttgcttctaggtcactaagaagcggaaatcctgtttggcgatcgatcgccctggggatggatcagcgatcgatcctctcctccctccctccacctggtttttatttttggcactgcattattttcctattttagtaaatttatacacctaaagtttatacacctaaagtttacacatctaaagtttagagaccaaaagtttataagtcaaaagtttatatatccgattcaaatttgaatttgaattcaaatattttttttatatatagtatttctatacatctaaagtttatacacctaaagtttatagaactaaagtttatagatctaaagtttataagtcaaaagtttatatacccgtttcgaatttgactttgaattcaaatattttctatatatagtatttctatacatctaatgtttatacacctaaagtttatagatccaaagtttataagtcaaaagtttacatacccgattcaaatttaaatttgaattcaaattttttatttatatagtatttctatacataaatttactgtagtgaaaaaatttgtgtggtgtactgtagtagaaagagaagaagggggagaagagggaggagtataggggtaggcggggtaaaccgatcgctaggcgatcgcccattagcctcccccactaagaacacgtatataaaagttttattcacaaattattttttgtttgcaaatagggaataagcaaaacgatggggccgctcttttctggactttttttattaaaaatgtcgtgcgtaattttttttttacgaaacgtaactatagttgataatattattacacttgggttaacttgcatttacaccacagtaactgagaactaattgcgtccacttctccactataaaaaccattcaagcctccggattccagcgcaagaggcacagcgcgccactccacacgaaatggccaagctcacggtattcgtggccatcctcgccgtcgccgccgccgccgccgccgcggccgtctcgacgacgacggcgcacggcgtcgccgtcggccgccgcgctctggatgagtacaggagcgtgctgcgcgtgatcgtacccttggaggtggccggagcgccatcgtctgggtcgttggacgacgacgcggcggcggctctcggccccgacctgccggagtttggagctgcgccggcggctggccccgccgcggcggcgtgcggcggcgatgaagttgactgcgacaacaaggtgccggtgtatgggccgtagcccatgtcgtgtgaaggttttcacttcgtcgcctacggaattgatgaagtgcgtcgttttgaccatgtaaatggccttcagattattattgttacacctgaataatgaaatgcagaactatatatatcctaatttaatcaccttatgtttttttttctctctaggataaatgttgctagctagtgatttatcatatttggatatgtgagactccagcaaagatacagcaatgtgacagattttttttcttcgtgcatggtttattatcctcgtcttcttcatcggctccattttagatagctgaaattgatggattaatggattacctgattttctttatagctatttaagggtacaagcgaataaattaaatcatacaaaattgaaaggttgttctacaaaagtatctcaggaaaatttgatatagaattctcctttacacgaaacacaccgcttaggaagcttgcaaatgaaaatccaaaatcataatcagtgaagaacagggccggccatcgttgtcagcattcttttttttcctcaaacaataaattaatgtgtttccatttaaaagaaagaaacaaattgtcttccatccgaatatccaaaataaagccaaaccaaggtgaccgccgagcaatctacctcagtccagaacttaaacgacattgcacaaaccgttctgtcgttataagattcgatgatggttcatatgcagataaaactccagaatctgcttacaaaataaacaataggttagatgcttgcggggattttttttttggaatgctcaattaaccttggcgaatggacatatcagagaaatgtacacatactcgaacaaaattttgtttctgaaccaatgagattaagaacaaaatttgcagcaagaagacaacaaactcactagcatttcaaatattccatacgatatattttaggtgtttttagatgaaagatcatcacgatccggctttgaaagaaagcctagacgtccattacagaggttaattacaagcccaacctaaaaacaataggaaacataccaacactaattccatcacaggagcttgcatctagcaacatcttctacccaagttccacacaaaaacacccaaaagatcaattttcctaacccacgagtgctattttttcagatctccagcggcaatacatcctgaggatatgtttaagtaggagttgaactgcagatatactgcagagccacatccaaagccaaaataagcttaatatatctgcttcttgagcagagtaaacactagctagtactcctggtagaactccagatagatctacagagagcacagaaaacgttgaacgaatcaatcgttgaattcatattcaaaatcctcgaattcgtcttcaaaatcacccatcaggtcagcacccatggaagccataatgtcatcaggaagccgctcagggaggctttgcactattttctcccactccagtcggaacctcagtgcttcgtcggcgtagctgcagaagagctgaattggactgaaaggaggttcagtagaaacgaggaagacgggattcaacgaatctatggctccgccgatcttggtcgtctcctcgctctcgagttcatacatgtagatgtccgcggatgtgaggtcgtcgcgctcctggtagtagattcggttgccatcaatggcgttgaacttatccgcgttgatggatatgcacctggtggcgccgacgaagatggcgcggccgccgccgatgctcttcacctcctccagcgatcgatctccttcacccctcccgtgctcatcttgtaaatctgcacgatctttctgtccatcttgaagatgagcagcgcttcccccgcggattccaccacgaagcaacggaacgcggggttcgcgcgacatgtgtttgtgattttgacggcgagagggagccccgtcttgatggcctcggggaccaggatcgacgccaccgaccctagctcgccggcggcggcgtagcggccaccgacgacggccagcctgatgagagcgcacgcgtagctctcctcgaacacggagaagccttcgctgtcggggtcggcgaagtagaccttggcggagtcgtcggcgagcaggacgagggtgggcgaagcgccgatgacatgggcatcgaacccgtcctcgcaaggcagcggcgccgcgaagcgcgtcgtggcgccgcgcttcgcggcgccggtgaacgggttgaggacgcgcaccgcgtgcgggggggctcgcctcggccagcacgaggtcgccgccgggggcgctggcgacgaggcggtagcggcggccgcggccgagcagcggcaggtccatgcggaggaagcggccggtggcggcgttggcgaagaggcgcgcgtcggtctggaagacttcgtcgagcatggcccagtggcgggggcggaagcgggggtcccgggcgctcgcccccctggggtcgtcggtggcggagcgccagcagcggcagacggcgcggtagcccatgtagtagtcgaggtcgccggtgtggaggaagcagcgggcgatgcggttgatgaggtccaccggcagcgtcgaccggggcttttaactatttgccacacttaccagagtggggcttaacgatttgccactaattccacatattatagacacataagggttcatatgttatagacacggtgtgacaaatcgttaattgacatgtcacaagagtgacaaatagataaattttccgcgtcagagcttttaactatttaccgctttatgagtggtggttaacgatttgccgcgaccagtccgccattgccgtaggctggaggaaggggtgaaaggtttggaagcagtgcggaaagcagctgaccgacgggcgacggtggcgcgatttgaagggaccagtggctgcactgcccgggggatgtggagtagacttttattgtggcgttttccaacgtggacgacgaggcgaaaggacgtcctactcccctactatgcgcgattcccgggggaggtggggaggtggtgggacgtgtgggggtggggccgtgggggagtgaaaggaaggcagaacgctgaacgcagaagcgaggctttgtttagatttcaaaaaaaaaaaaaagccaaaacttcgtataaaatgtttgacacatacacgtagcattaaatatatagataaaaaaaattaattgcacagtttatatataaatttcgagacgaatcttttaagcctaattacgccatgatttgacaatatgatgctacattaaatatttgttaataacggattaattagtcttaataaatttgtctcgcagtttatagatagaatcggtaatttattttgttactagtctacatttaatacttcaaatgtgtgtccgtatacttcaataattttacacccaaagaattaaacacacccttagcaccaatgtgtagcacaatctaatcttaatgtgggccctaatacaagttgactataactatttctattgccacaatgcttaaggccttgtttagttctaaactttttcttcaaacttccaacttttccatcacatcaaaacttttttacacacataaactttcaacttttccatcacatcgttccaatttaaaccaaacttccaaatttgacgtaaaataaacacaccctaagtttacataagaatagatgttggcccattcacacttgccaaaccaaccatttaagaatagagaagagagagaataaattcttcgatttctttattctcttgtggtgcactctaaacttatggttgtttttcttcacaaattttgacagtttgaccctttgcaaaaactatttttacaaatgaaccgctgccaaaacttatttcaaatctgatcctttttgctcaacgccaaatcatgtggcgttgaacttagatacctcagcgccacgtcagctggcattgaatgccgtgccacggcggatgggagactaagtcagcgtgccaacgtacattcagcgccatgctatttggcgctgaggtgtctaaattcagcgccacacgatttggcgttaagcaaaagggtcagatttaaaataagttttggcagcagttcatttataaaaatagtttttgcaaagagtcaaattgtcaaaatttatggtttttcttgttgttgcctagtactagcttattgccaatgctatgatgcactttaaggatcttaaggttacacttttgcgacattgtggttgcccttagacatataaaaaattttacaggaaagttatttaaaaaaatcgtgttaatcttttcttcattttttctaatacttaataaggttaattaattgtgcactatactccttgcgtttaaaagaaaggctctgtttagttcgttcgtgtgccaaaatttttgaagtatacgaatacacatttaaagtattaaacatagactaataataaaataaattatagattccgcctgtaaactgtgagacgaatctattaggacattcccaatccaagacactagacatagtttccataaactctacatcatcaagaaactagtactagacactactcttccaatgcaaacactactattccatacttaaatttaatgctacttatctcacataatgtcttggatgttgtgtagaaaccatgtctcatgcaagacatggtttccttctttttcctcatttattcaattgccacatcatttttcatcctaggtgtcagggttatagataccacatacctaatagtagttgactaaatctcggcaggatccactacataccatgtcctatacggaagaggagttctggataaggaaagacaaccaaagttctatatagaaacgacaaggactactcagattgtatccatattggtttccctagttctacttggacaaagggatacctatgggtataaatacaagccccctaagaggagagggcagaggatgaacacccaacataatcgacatagaagccacaacatagaagcctacatacgccaagacacgccgtcggatatcgacttcagggataagcacggctagtaccctacggtgtctccggatactgtcaggagagacgaaagcactatctctgatctcgtcgggcacggattcgaggagaaaggctaccctgctgtcgactatgggtcagatcgtcagaccgccatgtcgacagcagttagataggctacctcaaatattgtactggtgtgattatcatgaataagagcaataccggcttcggccaacaggatgtagggttattacctgacaattcacaggcccgaacctgtataaaaatccctgtctccatctcttttacctcagtctcgcgtataccctagtaccgacgatccccataccatgcaaataccggaatcgcgacatcaaacgttgacactaggtgacaacttattcaatgctatggacaccatcctagttattgggttgggaatgcccttaagcctaattaatccattattagcaaatatttattatagcaccacattaccaaattatggcgtaattaggctcaaaagattcgtctcacgatttacatgcaaactgtgcaattaggttttttcgtccacatttaatgtttcatgcatgtgttcaaacatttgatgtgacggaaaatttgaaagtttaaagaaaaaaatttgaatctaaacacggccaaatacaatctaggaaaggatgtgaccccttgatcccttcgttgtaatagaagcgccgggacacatcctcagtacgttcgtctcgttttacgtctaaggagagaagggctatgaggctgcgttcgggacccccacggcatcaaccaaaccggtgaaatctttcgttgatcagcttggatcgacatacgcatagcacgtcctctgtactcatattcatccttctttccacaaatttcattcgcatgagagaggaaagacacaagtgaaatctgaacaagaaaatggatggatacgtacaagttgttgctgctgccctgccccactctatcgtggaatcgcagtagatgatgagccccatcaccgatttcctttctataatatattttaccaagacaaatttattataaaaatatatttgtttacatctaaatttgtcacctatggatgaaatagaggaaaattgccaaagtttgaaaattaccgggtttccttcacagggccggtcagaccgcaggtatatgggcggtctgaccggctagtagggccggtctgaccgcaggtatgtgggcggtcagaccggcagggtccgagtccgagtctgttttcgtcgggtctcgggtttccttgctcgggaaggcatattttgtgttttctttggtttctatcccgagttggacgtggagaagggcctgtagagggcaagaccaacccctatttaagggacaaggccggttcattgtaaaacccccgaatacaatctatttgaatcgttcttttactatgttttctattgagtaaatttcacaaaactacagatactttgatcaaactatcacaaaactacagatttaagaatgtatttcacaaaactacagatttagagttaaatttatcatggaactacagatttaaggtattatatcacaaaactattgatttaacaactattttattacaaaactacacatttaaaaactattttatcacaaaactacaaattttataactttaaataaataatagtgctatgatctaaactctagaatatgtagttctttgataacttaatcactaaatctgtagttttgtgatatggtgcattaaatctgtagttccgtgaaaagtttaacgctaaatctgtagttttgtgatacacattcttaaatatatagttttgtgataatttgacacaagtatatgtagttttgtgaaatttactcttttctattttaccctagtttagttcatctttgttggtttgcgccgtaaaccgtccaccgccgctgcgagagtgcgacacctctttgtaggtttatcctgaaaaccttccgttttgctcacgagacgggtagttatcctcatatcgatctaaatcggtctagaggctgattttgatctctaaattggctccgctagccggtttaacttttctttttgcaaaacccatcttgatttggccttttggctagatcgaggtggttggcgactccatatcaccgcaaggcgtttaggtgttgcgatcgtgcttatcgacttgtcacaaaaagttgctaacaatatttaataattattttaatagacctaatttgataatgtaagtattactatatttgtctgtaaacttagttaaatttgaagcggtttaactttgaccaaagttaaaacatcctagaacctaaaacatagggaatactattaaatccaaataacactttcaaagaattcaaagagcaatttagtaggattcaaatcctacataaattttactagagtaaattacactcacggtacatgaacttgcgtggtggatgcaaataggtacaacaagttgcaaagtgcttatttcagtacaataactcgtctatattgtgcgaattggacaaaaatgatccaaacaagcaaaattgttagaacttagcatgtactgatgaggtagcagtttaatttacatacttattatgttttggagatcttatttgcaatccaaataaaaagagaaattagtgatgcaaaagtttgtttcatttcatttctgaggaattttcgttccttcataagtcatcttatgtttatttatatctttagggccaagacaaaatctggcgtggcatagtgcaagtaacactaggaaattcattttaatttctatgtctagaatttccattttattgaaagtttattttcatgacc

SEQ ID NO: 61556 - DNA, 5006 bp, Oryza sativa
attagaaaaaaggatatcttgatgagtttcaagaacagatcgatcgaactatatatggatgacaagaaaatactgatcatgactgagaacgggaggcgtcaggagatgttctgttctgctggaaacgtgggacagtatccagacacaaaaaagttggaattcggctggagcattcgctactaaactcaaaagtgagcgtccgactcctctcgtagagacggccaacaccggttgtcccatgcgcatgatgtgatgagtagagagtatagtagcaagtagaataccaatagcggcagcagagatatcacaattgcaacaattcaccgttcaagcatggagtcgaggaagaaattatgtttaatgattgatagatcatcaagaacgtagtttgcaatatgttgggaataatggaaggaaccatgagaaattcaatctgccacatgagaaattcaatctgccactaatcgatggatcttgctcacggattggggattttttttgtttttgttttttgggttcactggagatattccaccgtagcctttcgctcggaggaacaacaaccgtagcctaaaaactgcaccggcttgtgcgtcatcgtcaatgatcgatcctagcaagcatgcatgaactactcgcggttgtattgagcctaggccttacgctgtgcttgaatttgtatttttaattgtaaactcagcctatcatggagagagatacgcacataggccacaacggattttttttatttattaaattttttacaaatctacacctacacggtatatgggagggtgttttttaaaatacgtcctccaaaagaacgtttcttataatgtgacacgtgatcgttattgtaacgccccgacatttgttagctataaacacagctaactcacaccggggtgttatgcattacctgtgatatagtaccagtcccaggatacactagctgatactcacagaataaatgtggaatcaaagtaaactgctttattacatcactgggtagtagtccttataaacgttgctatcatggacatgcccatagatgaacaacacaacattacagaaaaacacaaaagcgacggcgcagaaatgaatagcacggagaactaagcaactaagcgactacgcactaggcaaagaacctagacaactaacttatttcacaggcgaggcttggggctaggcacgaaacatctaaaagtcttcatactcggcttgctcctggagatacttctcggcggtcgggtcgacgtcttcatcttcaaactctatagattattataaggggcaagggtgagtacttaacgtacttagcaagccagggaaaagaatgacatgtcggtttaacaaggaggctacggttttatttgcgaaggctgccattttggcaaaatgatttatttcacaaaattcctagtgagtgagtcaagttttagttgtcgagaggaggctcacgcctcgacccattccacaagttgctttgcaacaacttgtcacaattaacgaacaacaattaaattgttttctctattagttcctttttcacaacaacacagttcatacaaatatcctggttatcccagcacatcaacgtcatcatggccctaacaacaccttggtgtcggacgacaccccaggtcacacagacccgttcctaaccacaaaagttagccgtctgccacacaggcggactctggtaacgttcctttttcagtaaccacttttccacaaacctttgtcaaacaaatctacgctatgagaaacaccttacactcgcccttgaccgtgggcacggctgttcgaacagttcattaatctctgcagaggttgcacgctttacccacacgacacgaaacttacaccggtactggccggtaccggaagttcgtgataaggcctttccaaagctaacccatgaaaatcacataccacctagttgggctaaaatccatagccgagtatcaggcaatgacagccgtcatccactcaggaaataccgaggatgcctcctactcctactggtaccacgccacaatagaggcaaaaagacacccatgatgggcaataaatgtgtaacacttcgtttcctcatcctcggtattccacaaccattggcacaccaactcccatgtgaaaacaatttactcaaccagaggcatcccataaatactcgtgtggtcgcattgtaacgtgttcggatggatttcccaaaggaatcggtccttaacgacaatacgtggccaaaccacaaaggcttgactccgcatcatcaccactttcacaacacattttatttcacaactcctcggtacaacgtaccggatttttaatcaggtaatttggaataacccaagtttcccacacggcaacaacgtaagcatggctaagcgaaactacctcggtaatcgtgtaacgataccagcgcaaacatttgtggagctatcaaaggtatggaaacatcaacctatgtaatataaatgcgactactaggttggtccgtcggttgttaaaacaatccgaggcctaaacatgttaatcgtgtatgctaagtaatgcacttttcaaacaacatatctttgcaaatatagaggcaaagtgaccaaagaggtttgccttgcacagggttggggtcttctcattcgaaagcggcgtccggagcttcctcgaactcgggctcttaacgcgaaaacaaagctaataaacaaaaggcaataaaacaagctcaaaccagagaaacaatagcaccactgtgtagatctcaattttagaaaaatttaggaacttaacggggtcaatcggagttatggttgatttactatgaattttcaaaggataaatggtttttctagaatttcatttattggacggcaagagaatattccgttggaatattccgctagactaacagcaaagggagggggcccacctgtcagcggccaatggaggaaaggaggcgcgggcccggcttgtcagcggcttgagagaggaaagggaggtggggccggcttggcagtggttgaggaggtcttcttcctcctccacgcgctgctctatcccagtcccgggcagcgatgtgccgtggcggcgaggctcggctcggcagccggcgaccggggaggcggcggagaattccggcggatctccggcgaggcaccgccggcgacggcggcgctagaaggcgcggcacagcggctatagacggcaacacagagaggagaacgagcaaaagtgagagaggagagagagagatggtgatggtgtggggagaaggagctcgggctgcttccccttttataggcgagcgacgcggtggcgagctggcggtctaggcgcggcattccgggcgtagatggctagcagctagggcgggattccggggcggacgagatggcgatgcgacgacattgcgtcatgcaccggtggcgacgcgatgtgaagcgacgcactaagacagacgatggacggcgatggtgatggcgcgacgcgacgcgaagagacgtgcggagagcgagtttggcaacgggataaggatgacgcacggccgacggcggctatggccggaaattgggcggtagggttctcagatcgatgcgacgcgagcgacgtcacacggcggtggcgatggaacgcgagagagagggagagacgcggctcggcgacttcccggaaggagacagtcgacaagacgacgaggcgacagcgaagggacgcgcgtccacggatgtgaggcggcgacgcgatggccaaggtgacggcgcgaggcgacggaagcggcgtcatgcggcggtggcgacaagacgcgagagaaagagagagagagagagagagagacgcagctcggaggctaagctccttcctcacgaagcaacgagaacggataagggagatgatcggataagagaatgactcggcctagggttagggatgacgacgagtgaggtggcggccgttatccgtcggggtcgatgcaacgggcgacgggatagatggagtggacggcgacgggacggggtgacgcgaggcgacgtggctccgtgtctcccggagagaaaccggagcgaggtcgggcttggcgcgacgcgattttggcgtggcgcggcctcggcctggtgcggaggcggtgcggcgcgggtgttggcacgacgcgcggcgcacgggagggtgttttggtgcaacacacggctcagcacgactcggcgtccgggcgaaacatttcgtcgaacaccttgtgtgcacgtggctagctgcctcaaggaagaagaaggtgaataggagctaggctgggctggccgactggggaggagaagagttgggccgaggggaaaagaaagagaggatgaggcccgaactgaacagtactgcttcacaatttcgcaaggatttgtagagtttgaattttgaggagatttcaaaggatttgaatttgaatttgacctaggatctcacagaaattttaaaggcaattctaagagaggatttgagatctatttggcacaaaatcaactaagaaccaaattaactccaaaattttaaatgacaagatttttaaataaaagcaaataaaatacgggtgctacagttatcgcatgctaacggccacgtagcagagcggcaaagggattggttgtaaaatggtcagtttcccctctgctcggttgtcaaaatacgctcacaaacgtgtaccacatcattaaaaaggttctttgggaggaataaaaacgctctcctaattaaagagcggtagtaatgtagattttatagaactatgaaaaaatattttaataaataaaatgaaaattttaaaaatttcagccacagccactggtggagaaaccatctttggtcagtcgaccaaaatatataatattcctggttgcaataaaaaccgggactaaaaatatctttagtcccggttcaaaaggttagagttttttttatctttagtcctggttggtaataccaaccggaacaaaagatctatttttagtcccggttgg

SEQ ID NO: 61557 - DNA, 562 bp, Oryza sativa
agaagcatgacgtgtggcgcctcggaggagaaccccccaccgtcaccgaagtcatcgaggatagtggcaatataatacggctcgtcggagagcttcgaggaacaccatgggggaaaagatcctacaaggtttgggtggtctagggtttttttggaagagtgagaagaaaaatgagctaaagtgggggcagcctgcgcccctatcctggcaatcgccaccaccaccaccgccgtatctactagcctgcgcggtcacctcgctctagctgttcctctccgctcctcctacccctcggacggatgccttggggctcgggcttagggctgtcaacgagccgagctcgagcgagctcgtctgcccaagctcgagctcgaacgagctcggtcataagtagtataatatatattttaatgataattttttgataagtataattattttctagttaatcacactaataaaagagtagaaaatgattaaaataaatatattatgctaacacatgctaatttattgtgtaaatagactactaatatatattatatttacctattagtttatt

SEQ ID NO: 61558 - DNA, 7402 bp, Oryza sativa
cataaatcaattctttattcaaaattccatgaatcatttcccttggtcccgcacgtccgtgactgtcaataatattcttgagaatattatttctataaatttcataaatcaatttccccttgttccacaaatatcttcctttgtccacaaattccaattaaacttccaaaattcatatctcccgatccgtaacaccgattgaccccgttccacttccaataattccgtaaaattgagatctatctaatggaactattatttagtctaaataggatctttcttttggtcttttgtttaggttttttattgtttgcgtatagttgcggttaccggattttcgtcgatcgcgggttttctcgaagattcgtgaagcttcgtgaagaccttgagcaaggcaagtcaccctttgaccaattgctcctataattgaaaaatcattactattttgtttgcaacttgcattattagaatcatacactcaacttgcttggcctcggtttgcgtgccaaaccgtcggacctacctagtagtcgcactaattcctgtaggtcgtactaccctgattccttgtcgctccacccttgtggtacctcggtattcgttctctctaagcgcgtataccaaatattccacatacaccattgtttgtcgataatatgggaaatgggtttgagaagcctttaaaacccgacctgtggtgtcggcgtgtttgaaaataaaatgaattgtgaaaactcgcgatgcaggtgctgtgcctgggtggcactgtcccgtattcgcatataagaaccgattcctttgggaaactcatcaagcataacaagtgcaaccacatggtggtatgggacaccctggctaagtaattagctgcttttggaaaatcttgtatgtcaatagaggcggaaagccgggatgtgggggtagaggcatcctgggagtccgaaacagaggaaggcatccgggagtcctaaaaggaaagccggagttggcccgatgttggtcaaggagaccctctatgtggcatgaggtgacccaaagttagctttggaaaggctttgtcgcaaacctctaacaccggccagtgtctggagtaagttcgtgtcttgtgggtaaagtgtacccctctgcagaggttaactaactgttcgaacagccgtgcccacggtcatgggcggatgtgaggtggttcccgatgcgtagatttgtttgcctgtgctttgtgaaaagttgttgtgaattgggaatcgtaaccagaatcagcctaagtggcagatggatgacctgagtggtcagaaacgaatctgtgtgattcgggatgtctgcgggcatcatagactaggcttcccgagtggaagcggattgctttgctgctgggcagctgaactttgggagtccgcaaaaatgaaaaaggctctgggagccgcttaatcaagtgaaatggctctgggagccgataagtaatgatctgacccgggggtcagtacattaccatttgagttgttgaaaagcatctcttaagtcgaatcgagacgcaagtctcctctcgacccaaacttaaaaagaaataaatcacttagtgattccaaaatgttttcaaacaaaggatttgcaaaacaaccttgcctctcttccaagcttgcattaaacacctaagttcccgtgacttgctgagtacgaaagtactcatccttgctctatataaatatatatatagttcctccgccctgaagctgaagatgaagtgaagtgaagattagggtttcgtcctggttcccagccatcgcctgtggtgttgggtgttagttcgttggttccgctgctgctgctgttgctggtgttttctcgtcagtgtcttcggttgtattctcaggctgtcctgagctgcaacctaagttaaggtaaataagtcctctatttattttaaggattttgcaatgaatcatatttgtcaccgtgggtaccagcactatgtcctgggactggtactgtgatcgcggtttcgtaggaagcggttcgcgccgtttttcctgcgacacgctcctatcaggtgccgttgtacggcggtgccggattggggtgtgacattgaggtagagtatgtctcatctaaagatcaagttgcagatggctttaccaaaaccttgacagtaaggcagatggagatgtttagaaacaatctgaacctggtaggttgagattgagggggagtgttaggatttacgtgaaatattgtttcatatggtttggatagggttgttagctctagatagagtttgctgttatccctctgtattaggagataagctcaacaaccctgccggctgtatatatgcatgtacttgtgatcagcccgtttttgaggcttctgaattaacacgaaaccacccaccgaggtgttctccacgcttgcacctctgttctttacacgtccgattttttattaagaagaaagggtgcctcaattacatttgtacaacaaacaaggttattgcgacctcgacacatacacgagttctctgacagctaacatgcagccagcaggccattcgccttctctctatatatacacggctggttctagaggtcactgaatttgatccatcaataccagagaagaagacactgtcactttgtacactgatagagcaacaatgcagtgtaatgctcgactgcagctggtgtgagaaatggctttgttttcaactggcctccttaggaatgcaaggcatctggagaatctgtgagaaaggtacttgatcaatttgtctctactaaatattgggtgtccttgtcgccaaacagcatttggaagtgcatttcatcatgttgaaaattttgaactttcatacatggtgcaaaaaactcattggagacttcgatttggcaccttttggggatgaagtaatttggtttttgtatggtgtattggtgtacaccatcatcttcaagggcattcgtaattttcaagcaacagcatgcaaaaagaaaaaaaattatgttccatgaatggtaatagtaagtagcacgtcaaaaaaaccggagcgatcgaagcaccaagattctagtttgtcttatgttcatgtctgataattttactaaacttttttgcctatgaactgttcgattgacgatgtaattacatcatttttcttttatgcaggaccaactaaatcccttacacaagggtaggatggttgatggagtttaggaatttggttaccgaccgttcatgtcagtactagatgttttcagtttcctaggtcatgctatgcaggaacgcggaaccaaacgtctatctgaggtacaaaatgccttgtggccctagcaggaggatatagcattatagcttgattgatgctgggagtcaatcgcatgatacagtccatactaccgatcaggttcagttcttgaatccaagctagactctggaacagacgttttagcttgttttttcataactagacgagttgatcaggattggggatttgctggattagactcggccattttgggattattggaagaaactacggttgagcaggatgatctcgtcgttgcaaaaacttgtagcgagatgagtaaacatttgtggttgattgcacagataaagctagcattaacgaatgtttttagtactagagttcgtctcaaatacgaagagaaggatgtacagttcttagaaaaagaaaatatttgcagttcttttggcagagtattcatatgcagctattcgggtgtttgagaaattaaaatagcatgaaaatgcccaattagccatgcccaaaaggaaaacgagcacaaaataaaaggagcaacggttactgtaatttcaacaatgctagctcttttctgaaacttttttcatcaattcgatcctataccaactctgcttaaactcttcttcgatctctgacaactaatgacaactaacatgcagccaacaggccagccatcttctctatatatacatggcctcattcatggctgcttctcaccttatcctctgaatctgattcatcaaataccttgtctaatgcctgataactgagaagtgagagaagaagacgctgtcgtgttgtacactgatagaacaacaagctgtgatgtgcttgagtgtagctgggtgagaaatgtttgagaattgcattgccctcctactaggagtggaaggcatccagataatttctaagaaaggtgcttgatcaatcgttctctactgagaactcgggtgccaccaaaccacacataaaactactgtcatcaaatattctagctttctcagacgatgagaagcacctatatatagtctatcatctaatttcttcgtgataatttactaactgggttccttttcttttttgaaaaagaatttcactaactgggtatgcctgtaaactacttgattggagatataacatcactatttttgtctctttttgcaggagctgcacatgggatgtacgtggctatattggtactagctaggttaacaagtgggacatgatttcatcgtccgggttctcctctcaaattatgtcctctgcatcgaagcattcaatgtcatcgtcgtcaaggctctcatcatcaaccaaactcaaaaattttccccaactaaacaaggccacagtatatatacatagggtccaaagacaactaggcaggtgctagatgtgaagttgaataactgatagtatatgcacaaccacgatcaacattgtgttgacacgcaatcaaaattatatgggggcaaaacataaaaggtagcgacccaaagtaggggtaaaatgcagaataattcgatgattagatgaggctgcacatgggatcgatgttacatggctatattggtactagatttcatcgtccgggtttccaaacagattatgtcttctgcatcaaagcattcaatgttatcgtcgtcgaggctctcacaatcatcatcatcatcatccaggtcctcctcacagtcgatttcttcctcatcatcgaagatttcatcatctgggttctcctcgcagatcttgtcctctacatcatagcattcaatgtcatcgtcgtcgaggctctcatcatcatcatccaattcttcctcgtcgtcaaagatttcatcatcggggttctcacagattccgtcctcctcatcaaagcattcaatgtcatcgttggtctcatcatccaagtcctcctcgccggagaaggtcgtgtcctcggcggcggcgatgttggagtcgacgtggtcattgtttctctctgccacgtcagatatctcggcgttctcgtgctcacctccggcgatcgccggagacacctcgggtaatgtcctccttgtcctcttcggctgcgtcgagcaccggagcgtgagaagaagctgcgacgagctcggaagctttcccgagaacgcctggcggtacgagacggtcttaaagaaccccggcggcgaaggcgaaggttgcagtggcacggcctccacggcgatcgtcgtgtgcggcagcgccgccggcgtgtcggcgccgacggccgcagcggcacggccgcggacctacacgaccgcgaagccgctctcgctgtcggagccgccgacgtcgctgccgtcgtggagctccacgctgtcgccgtcgctgtcgctgagaacgacccagtcctccatggccggcgctgcgctctcctcctcctcagcggcggctgctgcgtgcgtgagcctgagttctcggctgcggcgctcgtgcgtagatcgaagtatcgaagcgatcgtggtgaactctggttggtggggtggtgatcaggtttcgctgtgaggttcaaggcggcgaggagcgctgcgtatatagggggtggatacgggtgtaggattcgaactcgatcggcgctgtgtgcagatgtccgtttcagtttcagaagaaagaatccgagttgataagggaatttcgtcgttgagaacaccgcaacaacatgagccgtgagcgtgagtcggagttgggatcgttttcctgtgaggctgtgaccgtgactgacatctccttttccttgagtattactccagtttaaggacttgtaacttgtttgtgttttggggatattcgtttcgtgttgaccgtgactgcaagttgtgggaagcgcaggatttttatttaaaaatataagtttagttttccatcattaatttgccttttaagcttatgaccgaagctaagtttattagtacataattttgtagttaattttagataattttgtacataattgacagagtacgcattatgtactgcaggtgttggagaaattaaacgggcccctccagggcctgaaaattcccagcccaattgactaggcccaaagagcaaacgagtccaagcgcagcccaaaaggaaaaaagaagaaaggctcaagattttctgaaatgcaggtattatatatattttcttggactagcatcatattcgttcgttatcgttgcaacttattacattaaatatgttataagtatgaaatataaggtaaattaattgatgaattatttctaaatttataaaacctatatacataattatatgacaccaactgaccaccttcatacactcatatatatatatatatgccaaatgaccaacaactacaaataaaccctacagataagatatacagtcctatattatatagggctgaacaatctaccatctcatctcgaactctctaagatgggcaagacaaaattaagaattaagagagcactccatcaaacgccaaggatctgaaactaatacatacatatacacatgcataattgcgtaatcaattggcatgcatgatcagtcacttgaaatcaagatataagaccatgatatcaatcgtacacacaggtcagctcatgcatctaccataatctaacctctcctaatcagatcaagatagaaaaccatgacaacaattgtatatgcatgcatttatgtcagcagtcagcactaccatgcatcagaaaaaggtggcaaacagtacatgaaacaaactagctaggctgtcaataatttttttcagagaagttgctcaccaagtgactgcatgcagatgtgtaatcaaccagagaactattagtacacactatatacacaggtttgctcacttactgcaaatcatgacagcgtcacacacaagcgaaaaataaaatgcatgcaatatgtattaagcataactactcatcaaactaataagaaaccataaccaagcgcataactaattaaaagagactaattgtaataagaactaataagactactaaaactgcagtataaactaccgtatgatccatgtttatcaggtttaattaagcgtgtaatcttaagtgagcacacacaatgagtcaatgagagagagatagagacagagagagacggtcatgcttggctcct

SEQ ID NO: 61559 - DNA, 14154 bp, Oryza sativa
cgcccctgggggagagcgacgcacatgaatgctgttgaaaccttatttatgtttgtgagttggagacacaatggacgaattgtgacgttcgggacttcggggtacgctgtgcgtgtaggggttgtcaatattcagttttaaaacttaagattctatatggacattcatccaaagtttagaggatgcatgcaattctttttattatagttatgaatattacatatcattgactgtctgagcaagcaatatatttgtgtgattaaggagagaaggattagactggccgacatatgtcaagaaaggggataatggggagtggattctaatccctcgaggggacatcccctcgtatacctttttctttcaaatttgatacaaatagttgtgaaaaattctaaaaaaaattgacaatgtagagtataatgatacctactagtccaccaaaattcatgttccaattcgatctacacatcgagaaaaaaaaagacaaatttagatataaacagtacgctactattcatacgctgaatttgtcttttttatatctcgaagtgtgagttgagtttggacttaagattttgtgaagttgtatatatgtgttgtatgaatgttgtcaaatttttccagaatttttcataaccgtttaaatgatttttgagcaaacgagggaacatcccctcgagggattagaatagtttcccgggataatgcgcaacgctacttgatgggggacaaaactacagtaaaaatcgaatcgttcttgactattttggtcttttggagatgttcgatcgagcaacccaatgatgcaaatcccatgtaaaaaaaacaaatatagatttgtttttttcaaaaagaagttaaaatctttgtctcgtatgtattgataaagcaggagaaaaacaaacaaagtaaggtgttatttacaggccttgccggaaaaaaacatcacattatactccctccggttttattttaattgacgctttggacaatgacatgctctacgagacatacctttgaccttatttttctattataatatatacaataaataaatgcatgtttacttttattatagtgttttgaaagacaaatctatatatgtttttctagtttctttgaactaaatatttttaaagttattgattgttaaagttataaaagtttaacctcaatcttgtctaaaactttaattaatatagaaccagagggagtaatggatacgaagattaagaacatcacgttaaaaagttccattatttcgaagcagatatgttccaacttttcaaccgaaatgatggttccacagatgaccttctaaagtcggtcaccagtcagccagtaacatggaaggagaatgctgctgctaagtctgtaaacagtaaactgtttgagagatgatgacacgccggtgcaggtaactgaactgcgcagggacatttagttgataacgtgaagggaaaaaaaacagatatttgtcgttgtttgttcctgcggagtgtgcaatcaagtagccctccgttttaggttataagatattttgactttagtcaaagttagactattttaagtttgactaagtttatagataaatataataatatttataatactaatttcattaaatcaataattgaataaattttcataataaatttctacaaacttggtcaaacttaagttgaatatattttcataataaattaaatataattgattatagaaaaaatattattacttttttctacaaactcgataacttaaagcagtttgactttgattaaagtcaaaacgtcgcataacctaaaacggagggaatatttgttttctattttgcaaatgaatggcgggctctttcttgtatgcacaccctatctcttgtttaaggtgtcaaacaaaaacatttctctttaattaagatctctcacacccttaacattttaatggctacacatttttttccgcatgagttgtgcttttcacgcccacttctctctatccaatagcaattatcacgtacatttctcacaagaatgctcctgcagatgccttccatccctaagaacccatgcatagctctctatcattttcttaaccatattgttctattcatgcaaaagcttagtgcgagtgcgtacaacgaagagacaaattaagttgcaagtggtgagcagaaataatatgtatatagagtccaaagacaactaggcaggtgctagataagtaatggagagcctgtgaattagttgaataactgatagatgcacaaccacgatcaacattgtgtcgagacgcaatcgaaattatgggggcaaaacataaaaggtctgacagctaacgaccgaaagtaggggtaaaaatgcagaataattcgataattagatgcggctgtacatgggatcgatgtacgtggctaaattggtactagctaggttaataataagtgggacatgatttcatcgtccgggttctccttgcagattatgtcctctgcatcaaagcattcaacgtcatcagcgtcgaggctctcatcatcatcatcatccaattcttcctcgcagtcgatttcctcatcgtcgtcgaagatttcgtcatcggggttctcctcacagattccgtcctcctcatcaaagcattgatcaatgtcatcgtcggtctcatcatccaagtcctcctcgccggagaaggtcgtgtccttggcggcggcgatcttggagtcgacgtggtcatagttgctctctgtcgcgtcagatatctctgcgttctcgtgcacgaccgcgaagctgctctcgctgccgtcgtggagctccacgctgtcgccgccgtcgctgccgctgaggacgacccagtcctccatggccggcgtggcgctctcctcctcctcctcggcggctgctgctgctgcgtgcgtagatcgaagtatcgaagcgatcgtggtgaagtctggttggtggggtggtgatcagatttcgctatgaggttcaaagcggcgaggcgcgctgcatatataggggtggatacgttacgggggggtaggattcgaactcggcgatgtccgtttcagtttcagaagcaagaatccgagttgagacggaaattcgtcgttgggaacaccgctacgacatgagacgtgagtcggagttgggaccgcgtttgaggctgtgaccgtgaccgagaccgacatctactttccttgagtattaaggacttgtaacctgtttgtgtttgtgttttggggttcgttgccggctctctttgctgctgatgataaggagaacatgtataggcctcacgagtcctctcttgttacgttacttggttcatgcgtttagttattgtaagttgccatcttatgtaccaaatcccctacaaatcgcgcatttaaaattttgtaacttgaacacggagtagtgcataactctgatggggatgtggaccacgtttggttgggcccagtttcagtgagttgggtttttacaatggggcagtattgcctcgttgatatcaccatatgtaaactatttttctttctttttaaacgttatattaatagtagtattacattgcctgatttttttttgctttttagaaactttcattgccaaaataagactagtaaatataatggaatatcaacccctgttttcttcgattgaatctcgaccaaatttattccgactaaacccaattcaaggattttgtttgtacttactacatatatacaacttgagaaatttcaagaaaaaacagccaaattaggagtgacatatacctgttgagttgtgatccaaattcatttgcacttaataaagactagcttctaccgtagtggagcataggcccgtcgccggtagatttgggccggagcgtacggatcgtcatcccttttagggtttctaccatatatatacctcttgtaagccgccgtgcggcgttgtaacctcaccccagatatagtgaagatattttgctgactggtgcccgtggtttttctttcctgtcttgggagggtttttcacgttaaatctcgtgtcttgattgatctattattctttatcgtttatttgtctatcgtttcataacaatactatcacgatcgatcatatgattcatatcatatatactctctctgtccctaaatatttgatgtcattgacttttataaacatgtttaaccgttcgtcttgttcaaaaaatttaagtaattattatcttttgattcatttttaaatttaagtaatttaagtttttgaataatattcacaatagttataagacgaacagttaaacatatttaaagaaatcaacgacgtcaaatatttaaggacggaggaattaccatatatataataaaagaacatgatatttgcagtactaaaccacaaactttatcagcatcactccctaataaatccttaattctaattcaatgcgcagattcgcagaagaaggtacacgacaccaaagagcaggtagaagactgcaagcgaaaccaccccgtcttggagtgcgagcgtatcagggaggaaggccgccgccgccgtgttgctcgcgctaacgtcaacgccaacggcgaagctgggcgcggccgccatggcgcgcaggcccgtggctccctgcgacagcgcctccacgtcctgcgccgccagcccgccggcggcggcctgcatgtacgaatcgatcgcgtcggccgccctcaccatcgccgctgcagcctggttccgagccgccgcttgttgcatcgcctgctggaactgcgacgacgtggacgccggctcggccgccgccgccgcgctattcccgcctgccatgtcggcgctgtcgccgtgcgcctcgccatcgccggcgtcgggagcagtgtcgtggtcgctctcaccggcgtcagagggctcctcctcgtcggcgccgcttgcgtctccaccgatctcctctccgagctgcgtgccatcgaactcgtctccggtgatcagctgatagaactcctcgccgtcgatgagctccatgcagcggccacagacgcacacgtgctcgcactcctcgtcgcaggagctttcagtttcatagtcgtagagcgtgtcgccatagaagaaatccaggaactcatcgttcaagccatggaagaaatccaggacctcatcgtccaagacgctttcctcctcaccaaagctttcattgtcaatgccaccatcggcgagaacctgcaggtactcctcgaagtcgtcgccgttaaggctttcgtagtcgatgccatcgtagccgccaccggcgaactcctcgggctcctcctcatcatcactctgctcgtcggagacgctctcctcctcatacaagctctcactgtcaatgtcgtcgtacttgccgccgtcgatctccatgtcagagtcggtgtcgatgtcgttgtagctgacagggacaccggtgaactccggccactcctcttcagcatcactctgctccatgcagctctcctcctcaccgaagctttcgttgtcaatggcgtcgtacttattaccaccatgctcctcctcctcctcctcatcgatctcctcgtcacaatcgctctcctcctcgtcgtcaatctcctcatcagaatagctgtcctcctcgtcgtcgctctcctcctcgtcagagcttccggtgtccacggattcatcgtccgggttctccgtgccgattttgtcctcttcatcaaagcattcagagccatcgtcgtcgaggctttcatcatcatcatctaggtcgtcctcgtcatgggaagattcagtgctttcagtatcttcgtcagaatcgctttccaagtcagtggtatcctcctcctcgtaatcgctctcctcgtcggtgctttctatatactcatcggaatcagtctccaagtcagagcttccgatgtcctcctcctcgggatcgctctcctcctcttcgtcgtcgaagatttcatcatcggggttctcctcgcagattccgtcctcctcatcaaaacattcaatgtcaccgtcggtctcatcatccaagtcctcctcgccggagaaggtcgtgacctcggtggcggcgtcgatgttggagtcgacgtggtcattgttgctctctaccacgtcagatatctcggcgttctcgtgctcacctccgacgatcaccggagacacctcggcaatgtcctcctctgccgcgtcgagcaccggagcgtgagaagaagctgcgacgtgctcggaagctattcccgagaacgcctggccgtatgagacggtcttaaagaaccccggcggcgaaggcgaaggttgcgacggcacggcctccacggcgatcgccggcgtgtcagcggcacgaccgcggacctgcacgaccgcgaagctgctctcggtgtcggagccaccaacgtcgctgccgtcgtggagctccacgctgtcgccgccgtcgctgccgctgaggacgacccagtcctccatggacggcgtggcgctctcctcctcctcctcggcggcggctgctgcgtgcgtgaggttctcggcggcggcgctcgtgcgtagatcaaagtatcgaaccgatcgtggtgaactctggttggtggggtggtgatcagaattcgctgtgaggttcgaggcggcgagacgcgctgcgtatataggggtggaattatacgggggtaggattcgaactcggcgctgtcagctgtgtcgatgtccgtttcagtttcagaagaaatccagaatcggaaagccggagttgcctccgatttctatcggctatggacaagcgaacacacacgcacgaagcactcgggctcggtacatgctagctgatggggttgtgaattgtgatcagtggcgtgcaagaaagtaaactcattggcttaaccacactggaaatttggcaaagactcacgtttgcagttgcaggggccttcgatgcatgtgcttctgcggtagtttatcagttattggtcttcttgctcgatcggatggtgaaattgaaatatggaattaatgcgaatgtactgcatataaacttgcacgagttgggatacaaatcagggggttgtgtcaatacaattaaagataaagaaaatctcagctttgctacatttgctgtttctgaaattttttccatcatttgctatcaagtctgcttacactcttcttccatctctgacagctaacaatgttttaattatggattttcattagtccaacctctgtatacataaaagatatacacagccaaaacatacacgtgttctctctttatttttcgccgggatggcggaagaaacgccgtcctgttaggatttacgtgaaatattgtttcatatggtttggatagggttgttagctctaaatagagtttgctgttatccctccgtattaggagatgagctcaacaaccctgccggctgtatatatgcatgtacttgtgatcagcccgtttttgaggcttctgaattaacacgaaaccacccactgaggtgttctccacgcttgcatctctgttctttacatggtatcagagcaaaaactcgatctatattagatctcatggcgagttcctcctcctccaccgcttttgcaaatcctttgttcggcgtccaagtttctgagaaactcaccaagcaaaatcactccctctggtcggcacaagttctcacagccctaaggggcgcgcgactggagggccatgtcctcggaacatccgttccaccagaagccgagcttgagcagaaggaaggagaaaaaggagagaagaccgtcagagtcccaaacccggcgtatggcgaatggtttgccacggaccaacaggtccttggttttctgttctcctctctgaccagggagattcggtcgcaagtcgcaggcgcaccgacggcagccgcggcatggaagacgatcgagaacacgttctcgacacgatctcacgcaggcgcgatcaacgttagattggctctcaccaccactcagaagggccaatcgactgtcaccgagtacgtcagcaagatgcgtgctctcggtgacgaaattgctgcaacaggaaagccaatagatgatgaagaacttgttgcttacattattaatggtcttgattcagagtttgatccagtggtggaagcactcatcgccaagaatgcatctgtcactgttgcagaggtctactcacagcttcttggctttgaaaacagggtgaagatccgaacagcgtgcgctgctacgagtggaaaccgtggcagcggaaatcagggacgtggtggcggcaaccctcgcggccgcggcactggacgcggcggcggcggcagcggtggccgaggtggcgggcacggccgtggcaatggacgcggcggcactgacaacagacctacctgccaagtctgtcacaagaaagggcatgtggtggcggactgctggcaccgctacgacgagaactacgtccccgatgagaagctaggaggcgctgcgacgcacgcttacggtgttgacaccaattggtatgttgacaccgaggcaaccgaccacatcaccgggcagctggacaagctgaccacacgggagaagtacaagggcaccgaccaaatccacacagctagtggtgaaggtatggatatacagcatattggtcattcctatgtacctacatctagccgtcccctccatcttaaaaatattttgcatgttcctaaggcatcaaaaaatcttatttcagttcatagacttgttgctgataattatgcattccttgagattcatcaaaagtattttttgattaaggacaaggtcacgaggaggacaattcttgaaggaccatgtcggcgcgatctctaccctttgcctgccggagatccaataaaacaagtctttgctgtgatgccatcgttcgagcgatggcatggtcgtctagggcatgcctcaaagcccattgttcttagggttattaatcaaaataaattgccttgtagcaatgagtctcctagtgagtctgtttgtgatgcttgtcaacagggaaagtctcatcagttgccatttcctaagttttttagtgtttctagtaatcctttggaacttattcattcagatgtatggggtcctgcctctgactccgttggagccaagcgctattatgtgagttttattgatgattatagtaaatttgtgtggatctactttcttaaatttaagtctgaagtttttgagaaatttaaagagttccaaagcatggttgagagacaatttaatcgtaagattctaggcatgcaaacagattggggaggagagtatcaaaaattgaattccttctttaagcaaattggcatagcacatcaagtgtcgtgccctcatacccatcaacaaaatggtgccgttgaacggaaacaccgtcatattgttgagattgggctatctctccttgctcatgcatctatgcctttgaaattttgggacgaagcttttcttgcagccacttatctcattaatcgcttgcctagaaaagtaattgactttgacacacctcttgcacgcctttttcaccaacaacctgattataaatctcttcgaacttttggttgtgcttgttggcctaatcttcgtccctacaatactcacaaattacaattccggtccaaacaatgtgtctttctcggttttagcaatttacataaggggtttaagtgcttagaagtggcaaccggtcaagtctatatttcccgtgatgtcacctttgatgaacaggagtttcctttctccaagcttcagccaaatgctggagcgcgtctacgtgctgaaatttcccttcttcctgctgatcttacatcgcatgcatctgatcaagggggagtagcacatagcaatgatcatatgcataatatcctacctgttgttactgattcctcttttgagaatgatgctgcagatgacacagatgctagcgacagcaatgcagaaattaatgcagagcaacctgatggaattcatcctggtgcatctaccggggtacacacagcagaaacagaagtggcggcagaatcgccgtctcgtactgatcagcggcgcgccgtgcaggcccctgagcaacctgcgaccgtcaccgaaccagcagccgccacgtcgtcggctgtacagagctcccgcgcgagttcccgctccatcgcaagccaccaccagctcggaggtgacacatcgccagggcctcatcatgatgcggcaggatcgtctgcggctccggaggttatcgctgcaacagagcaaggtgatattaatgctagaccaaaaactagactccaaagtgggattagaaaaaagaaaatttatactgatggcacagtcaaatatggttgttttacatcatctggggaaccacagaacctagctgaggctctaggagataggaactggaaagaggccatggacaaagaatattatgcattaatgaaaaatgaaacatggcatttagttcctcctaaaaagggaattaatattatagactgtaagtgggtctataaaattaaaagaaaggctgatgggagtttagatagatacaagggtagattggttgcaaagggtttcaagcagaggtatggcatagattatgaagatacctttagcccagttgttaaagctgcaaccataagaactgttctatccttagtagcttctaaaggttagagtcttcgtcagttagatgttcaaaatgccttcttgcatggagttctagaagaagaggtgtatattagacagccaccaggatatgtaaaatctaaggcacttaactatgtgtgcaaactagataaggcattgtatggattgaaacaggcacctagggcctggtactcgaggctaagtacaaagttgaatgagctggggtttgtgtcatcaaaatcagatacatctctgtttttctatgataagaatggagttactatgtttatgcttgtatatgttgatgacatcattgtgtctagctcttccgaaaaggccacctcagctcttctgcaggatttgaatcaggagtttgcactgaaggatttgggagatcttcacttcttcctaggaattgaggttaaaaaggtaaatgatgggctagtgctaacacaggaaaagtatgcctcagatgtcctgagaagggtaggtatgagtgactgtaaaccagttaatacacctctgtccatctctgaaaagttgtcaagtcaagggggagctctccttggtcccaatgatagcactcagtaccgcagcatagttggagcattgcagtatttgacattgacaagaccggatatatcattttcagtaaacaaggtatgtcagtatttacatgctccaactacagatcattgggcagcggtaaaaaggatattgaggtatataaaacatactgtgaaacttggtctacagattaacaagtctagttctttgcttgttagtgcatttactgatgcagattgggcaggctgtcttgatgacagaagatccactagaggatttgatgtttttgtaggacccaaccttgtatcttggagtgcacgaaaacaagctacagtttctagatcaagtactgaagctgaatacaaggcattggcaaatgcaacagcagaaattatgtggatacaaacattacttcaggaacttggtgtaaaagggcctagagccgctaaggtatggtgtgataatatttgagctaaatacttaacagcaaatccagtttttcatgccagaacaaagcatatagaggtggattatcattttgttagagaacgagttgctcacaagttacttgaggtgtaacgctccgctttttgcgtgacattaaaaactaattcggcaaaatcctaattgcgaaaatttcgttctttgtgtgcgagtctaagttgtgccatggatctcaattcaatctccatcgttgttccctttcgtcgccatcaaaatccaccacctcaagattccaattccgattcaagtctctgaaatcaacatcctgaaatcaatcgtcgattctttcgtccctatctctctctccctctctctaatcaatctgcctacctactatctatccatcgatctgtctatcgatcttcctattcgtttatctacccatcagccgatctatctgtctatgtatcgatctacctatctatctaactaaccagctgtctatctatctatcaatctatccgtccctctacccatctacctttggaacctatcccataccattgtcccaactccaaagataggtctcacttgaatccctctcatctaatccctcggaccgccgagtataactttgctccaaagaaacaccgaattctcgcttgggtgcttccccttgactcctccctgctttgtcagaccaagcctcaagttcgaaatccaaattcaatttccaaatctcatatccctccgaatcgatttcctcggaaaaagtctaatttacctccctcggttgttgtgggccgttttttttttccctcggcccatctctctccctcagccgctccttcctccctcgcgtgcctcgcgcgtgcgccgctctgagcgagggcgctcgctctctctccctcgtcgaactccctctcaccggcgccgatttcccgccgccgccgttcgaaatccggccgcaccctcgcgtcgcgcgcgcgctcgcccgcgcgtggccgactgcccggtcgccgccgcgtcagccctggcagcctgcgccacgcagccgcccatgccgccctgccgcttgcccccacctctgtgcgcttgcgtccaaaacgtggagccagagctcgcgctcccatccttctctccctccccaaaatggcatggtcgaacccctcctttccaccctgcccttttcctttttccctcccgagctggacctcctctgccgcccgtgagcgccagccgcgttcttgaccgcgccagctcgccatccttgcaccctcaaccgccctatgtcggttcctcccccaaaccgccttccccaccctataaaacccaagctgagatccctccccatcccaatcaatcgcgttttgctcctcgcctcgaccacgccattgccgccgtcccactgttcttgccgtcgccgtccgtcgccaaacaccgagggaaccggtgcgtgcgtgggcgtgtgacgcaggactccgggcaccctccttcctccccttccccggcctgaggccgaagagctcgccccgcgccgtcggccatctcccagcgcacgtcccgacacggtagccttccgttccccttcctcgctccatctcctccccttagcttcgggcagtagtgcgagtagccttccagtagctagctggcgccgccccgactgccgccgctgctcgccgtaggcttgccgccgtcgccgcccgctctcggaggccaccgctcgtcgccggacctccatggcgtcgctctgccccatccgatgccagaaatgggcttcccgaccaccatagatactcccaccgctttgaatcggactcccgttgcctgtcgacaaatcccctcttttaccaccgccggcggccgccgccgcaattcgtcaacgtcgaactccctccggcgaatctgagccgttggctcgctccttctcgatgccctcgtcactccggtgtgctccccgaagaccaaatccgtcgcgcttgctccagtgaacacgcccgccgtccgccgtccatctcggcctccccttcttccttctcccgccggcctgcatggctgccacgtaggcgccacgtcggcgccacctcggctttgaccgggccaagccggtcagccgcccccctccctccgtcttccctcccgtgcgcgcggtccacggcaagccgtgcggctgcacgtgggcccgccgccatccgtccacccggtgcaccgctcctaagccacgtgcacccgaaaccctagcgccgcacctcgcatgcgcccatcccaccgtgggccgtgtcaccgacaagcgggccccacctggaacccgcgaggtgcactcggtccaccgaaccgctcccccccttccgcgcgccctaatgggccgcctttcccgtgcctgcgccggcccaaatggctcggccgagcctccttcaaccctcgggccgcgcccttgccgcccaaaaaagtctaatatacatccctcgtccatttccttttccataaatcaattctttattccaaaattccatgaatcatttcc

SEQ ID NO: 61560 - DNA, 13110 bp, Oryza sativa
ggcaacgggctttttttttcttctttttaaaatttgtgattcggatctgtgtatttaatttgtgtgtgatgtgaatgtgatgtatctgtgatgaactttgtaaaatttgtgatgtatctgtgatgtatcgaattggggagttgaggatttgaggatttggggataatttatttgggattttgggatgtggatggggtgaaatcaatataatgaagaaaagaaaataataatcgagcaaccggggctagactagctctatctttagtcccggttttttactcccggtttttttatccgggactaaagatagtgatctacagggggttacgaaccgggagtaaaacccctttctccaccagtagcgtactctagatagtttacaaagtactgcctctggtacttgttttgatttatagcatttttttatgggacattagtccttgaccaatcatatttagccagatctgaattatttttcattttatctgtactttatatccctaatttggatcacatctcgacactccactagtaagatagtgtggttgttgtatctgccattttcatactcaaaagaaaaaaaaacaacctagtcaatgatgggacataatctaatacagtgaatttggacgtggttatatccatattcgttaaatgccacgttgtctaggttaaatgctccactaagttatgtctcattgttgtctagattggttttttgggacagaatgagtatatcataaaagaagtaattatagtggggattgtctgtggtactactgtacctgcggtagttgccgctgacacgtaggaccacccgtcacccgtcaaccactgctactatgggtgggcattcggtctaaccgaaaaatttggttcggttcctcggtctttttgaaaattcggtctttgtaatctcaagaccgaactaaccataaaaacagcaaaaacatagcaaatcaacaaaactatctgtaaaaacagcaaaaacaaagcaaatcaacaattagtggagacggcgcccggcggtggaggcggcggcggcgcgccggctggaggcggcgcccggcgatggaagtggaggcgcgccggcgctggaggcggaagcggcgcctggcgatggagcgaaggaggatgcggatgggatggagacgggacggcgccgcaccaagatggatggggatgaaacgatgcttgtgacgcacctgcccctagggtttcttattagtgggcttattgggccaactagatctattgagcctaattcggttatttcggttaattcggttaattgaggcccatgaccgaataaaccgaatatatttcggtctttcaatagttgagaccgaattatagaccaaatttttcggtctcggtcttttcggttcggttctttggttcggttttattctgcccacccctaactgctactatagatgcagtactacagaatatccgtgtccaagtaatcaaatgaatttaatttgttgccatcaccaaccaattaaccactttcctctcaaaagaaaagaaagaaagaaagaaagaaaagaaataatggttagtcctctcttgacccagtactcatcaaccagctgcctagcatgcttcggcctctatatatacacggtctctgctcactattttcatcctttgcttcttcattctacacactctgcactaacagagaaatgaaacttagcacatgaatagaacaacgtagtgaaaaaaatgattgagagctttgggctcttagaaatggaagtcatcaggagaattcctgtcagaaaggtttgtgatcatttttctttttcttcggaagatcctcttttagtccttaacagcagatacgatgcggcaaaaatgtgtagccattaaaatgtaaaactgtcaggtctgaaaaaaacttgagtttggcaccaattagttagaaggatgtgaaactgaaaacggccatcgttccttaactttgtagagaaaaatgccgttcgatccagagtacttccgtagagtgcaacaaaatatgaatgcaaatcaaattagttcatttagtaatatcctgggtacgaactgtaacctgtacgcatgcatttcaactacttgaagatctaatatcgtttttcttttctccacaggaacaatcacatgtctcatggttagcgccacatcatcgtcactagtacagctcgccgtaaaagccagacagagttcgtccacgtcgacagtagcagtggcggagctacagagaattggaggggtgcagtattcaatcaggtgtccatacccatcgagccatatagatttttcaagtaatatattgtactaaataattatgcctcccattaaatatttaaaaaggaaatcaatatgtgatgccaattatatcaaaattaagaggagtgcaatgataaaaatactgtactgaccaatgtgagtaaatgcattatactagcaaaaccgaaatgcattgccccaacctccatgttagctcttaactaaaaaagcttatgaactattcacgtcaaatagatacatcatacattatcttctactatttatgactctacatttaatttttttaatgcttgttaaacagtaaggcaaacctggatatttatatatattcctttcacactgttggcttgttctatcggccacttcttttataaaaaaaaatcccaaaaaatcacctatacagcattgacaaatagtccgcaattttcgggagtatgatctaatccatcaggagccttgttatgaacacattagtgcattgaagccttcctagtagcacctgttcggcctggtgatctgcaatgcacgcactggactttacgtcttcgtggcttaattctcggtctgggggtacacatacgtgagccaagggggtgcccacatagtcattagggggtattaatcactaattttactttcctagtcgggttcctaggaacacctggggactacatagctttgcccctggacagcagggtgacgtggttgcacgcgatcatcgagcaacacaacgggcaattctaccatgatcaaacaaggccttacagaaaaaaaaagttatttcgataataacgcttgaattttcatcaaatttaaatttttttagcaaaatttgctacagtgcatcgaaaaaacgtgtaattagctcatggacaccgcaaaaatgagaatttgctatcgggcataaaaaaaacgtgtaattagctcctagacactcggacgttattttattatttcctgtgaatttgctatcgggtataaaaaaacgtgtaatttgcgatcgcgtcctcgacggctgctgtctcttccaccggccaaccacaccaccctgatgtggaccaggatgcgttctgtccggcctactccacaagttgtgctattgactgatgcacctgtgcaagtccatgagatatttcgttcttcctgcggagaaaacaatattaattagatgatcagtagtttgcctggatgaaaattttgaaatttgtattcacagaacattggtaaaaaagaacaaatctgattaaatatttatattttgctgcaaaactcttaatcaattgataatttttcctagtcagaaaatgcatgatggtctgcttcggatccacatcctttcaactgattaattagtgtcaaactaacgaatttctcttaagtgcttagatctcatggtctaacattttaatcaggggcggaggagtcggtatggcgctcgccataccttgatctcccgccggacccccccccctcctgcagcgaatcccaggtcccagggcggtgactcacatggcgatggcggcatcgctccgagccggcggcgaggcatccaactgccgattgccgaagccaatcctgcccacagcccacgtgcgaacaggccaaccaattaggcttttttttggtgtaaatgggccttttcacctgttgaacatgaaaccctaactccaaaattccccatcccccattccccaatccaatccgggcatccgactgaggaggcaagcgccgacggccgacgacgacactgtgactctgcgacagggagctgcgatggccggtgggggctcggcagctggcggggtaggcgggtgcgcggccacgctgggaggcaggcagcagctagccggccagggccaggcagcggcgcggcggcgtgggcgtgctgcggtgcggccgcgggaggcaggcggccagcgcagcagggcagccggcaacaagcagtgagccacagagccagtgaggcaggcagaggagagaccgagagaggatacatattcttcaaaagttcaaatggatagaaagagaaaaggaaaagcattgtcttcacaaagaggtacatattcttcaaatgctgacaattttagaacatttttgcatttgtttcatttgttttgcatatttgaagagttattggacctggggctcttgtagtgcatgcccaagtactcatggaagccaaaatgttgcagtagagatggaggaggaggaggggcagatggaggagcatgttgtccaagagcttggggaagaacgtgttgaagagaattttgaaggtataactaagttcaacccagattacattggctgtgtttagatccaaagtttggatccaaacttcagtccttttccattacatcaacctgtcatacacacacaacttttcagtcacatgatctccaatttcaaccaaaattcaaactttggatccaactaaacacagccattatgtctgatctggggcttcgcgctagtccatgggtcacaccgccatatctagatttttttccatcctccgccactgattttaatagaggtacattcttcccacatggtatatatgtaccatgcgcactcgtgaaagagtcgatgcgatagcagttttttagagtaattatcacgtacatttctcataggaatgctcctgatgccttccagtcccaaaaattaacacaaagctctctatcatttccttcgctatattgttctattcatgcagcttcattttctatgttagtgtgagtgtgtgcaaatgaaggggcaaggatgcagcaattgagcagaaagaatgtactactccgtatatatagaggctgaaactagcattagtgttagagtttgtgtcgaacatgtgtacaaaatcggttacagtttaggacttagagttgtactaggtataggaatagagtatgagtcggactatatcctaggatctctcataaatagaggggcgtgcctcttgtaaccgcatggcgacttagcacagcgagagggagcggctgccggcagtgaccagccgtgagtcgttgtaactctgatacgctgtaatatgctagatcggggaggaacgcccgcaatcagtgacccagagatgtaggcctcggcagaacttcgttatcaaatatcgtgcctcagtgtcgtcatcgtatttggatcttctatggcgtttcttccgcgtttggtttccgatgtgatttgggggccggttttataacagagacttcaagttggcaccttttggggagaaagtaatttggtttttgtatggtgtattggtgtacaccatcgtcttcaagggcattcgtaattttcaatcacattgaaagcaagcgaaaagaaaaaagaatcttattttccatgagtgcgtaatagtaagtaaatcgtcaaaaaaaaaactggagcgacctaagcaccaagattctagtttatcttatgtttccattcaaaaaaaaagtttattttatgttcatgtctgatgattttaccgaagttttttgcgtatgaactgcttgattgaagatgtaattacatcatttttcttttatgcaggaccaactaaatccctgtagcacccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaattccttccaaatcgaatccctccgcaaaagtctagtttgcctcccccgggttcgatgggccgaattccgctcggcccatctcttccccggccccctctctcccgggcgctccctctctctctctctctcgctttccccggcgcgtttccccccctgctcgctgctcgcgcgtgcgagagccgcgccgagcgccccctcctctcgcgtgagctccccgctcgcaaagccggccccgcgcgccgtcgctcgcgcgcgcgcccgcgtggcttcccgcccgagacgcgtcgtctgcgccgtccgcgtcgcccggtcccgctgcccagccgcgccgcccgttgtttcccgcgcgcgcgtgccgagtggccgaccgcccggtcgccgccgccgtcaccctctgccgcgccagcccgcgcctgtcgcccgtgtcgtcgcgccgctccaaaccgccccgccgtcatcgccgtcgtcatcgcccggcccccgccactccgcgcgctagcctccaaggggcggaggcagagagcccctctccctctgccgagtcgccccgctccctccttttcccgaatcggcaaaggggcgagccccctttctctccctccttctcctctttttctcccctttttcccctctcgccggcgtcacctcctgtcgccgctttggacgctagccggagcgccagctcgccggcttgaccgcccatgtcggttcccctctctcaaaccgacattgccgcccttttaaacccgtcttccccctcccttcctttcctctcccattcgcctcctcaccgttgccgccgctcccgtgctctgcctcgcctccgccgtccatcgccaagcgccgggagagccggttcgttcgtggacgcggaaggggactccgggcgcgccctcttcttcctcttcctcagcccgaggccggagagattactcccgcgccgccggcctctcgtcacagcgcccctcctcttctcggtaatgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggcctcgctcggcgtagttccgtccaatccgacgctagcgtcgagttcccgacgccgcgtagatgctctcaccgctgggaatcgacctctcgtgacctcgtcgccgtttccctcttctcccgccgccggttgccgccgccgcaatccgccgccgtcgagcaacctccggcgaatccgagccgttggctcgtctccccttgtcacgtgcaaccgcccggtgtgcacgcttttgcccgtatcgccgtggttcgctccgccgctcgccgccgccgcccgccgtccattcgaggccgggtcgtcgtctacctcccgccggcccgcgtggcagccacgtaggcgccacgtcggcgccagctcagccagaccgggtcgggccgaccccggtcggtccctccgcgtgcgcgcgatccaccgcgagccgtgaggctgcgcgtgggcccgccgcacctgcgtccaccgcggaccgcgcgcatgcaccgcgtcccgtccccgcccgcgcgcgtgcgtcgcatgctccctccgcacggtgagccgagccgctgacaagcgggtcccacccgggaccgcgcgtggtgagcccggtccaccggctctctatctcctccctcccgcgcgcgcgcgagtttgggccgccttgggccagccggcccatttagctcggccggaccgctccatttctcttgggccgcgccctagccgtccgagaaaagtctatattccctccctcccttcttttcttttttctttttcaaaaaggatttaaataaatcctttttcctttagaccaaaaatccaataatcttagaaattcaatatcttcccaaccgtaaatccgattgactccgttcaacttccaaaattcctcaaatctcgagatctatctaatgacacgcttagaggtcattaatagggctttattttcgccgtttgttgagttgtcctgtttcgcgtgtagtttcggagcccgaagatccgcagtgcgaggatttcgaggatcaagctccggatctcgagcaaggcaagccacctttgaacatcttgagcctatatttgaaatttaattatattgcttgcgaaatattattcattgataggatcacacttaatctgttgtcccgtctgcaaggcagattggcagacctacctaatttgttacatttgatccttcctttgttaattgttataccatgtccccttgtaaccacccagttgcacctcgatattcgtgcactctgtgcgagtatcgacggtcgccttcgaacttaaaatctgagtaacaacttgggtaaaactggagttttacaaaagacttggaaaacccgacacccgggtcggtgcttgcgaactaaatgaatttccaaaaccgcggaccggggaacgtacggggtgtacggtttcccgctctcgcacttaaggaccgattccttggaatttcatccaaacataagacaagtacaaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttagtaatgtcgtgtgggtaaagtgtaccccctctgcagaggtcattgaactgttcgaacagccgtgcccacggtcaagcgcggatgtgaggtgattcctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgtttgaaaagttgttggcccgggaggccgtttgaaaagctgttggccggatgccagctgttggccgtttgtaaaactccagttgcacctcgatattcatgcactctgtgcgagtatcgacggtcgccttcgaacttaaaatctgagtaacaacttgggtaaaactggagttttacaaaagacttggaaaacccgacacccgggtcggtgcttgcgaactaaatgaatttccaaaaccgcggaccggggaacgtaccgggtgtacggtttcccgctctcgcacttaaggaccgattccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagttggaagtctcccgacgtggctgatccccacgggctgggtgacccgggttagtaatgtcgtgtgggtaaagtgtaccccctctgcagaggtcattgaactgttcgaacagccgtgcccacggtcaagggcggatgtgaggtgattcctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgtttgaaaagttgttggcccgggaggccgtttgaaaagctgttggccgaatgccaaccctgtttcaagatctaaagactgatacattgcacatactccgaccggacgagacgcactgtcccatccgtgtcgtttgagaagcactcacctagtcgttttagaaaaagagttcaaataaaaccaaattgcaaaaacaacagccttcccctggcttgctgagtactcccgtactcacccttgttctatataaatatcccccccccagttgctgaagaagatgaagcggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatcagtccgcagcccaacatgactgtacttctactctataataaagagacctctgttgctgtgatactctgtctccctgtgataccagcattgtttcctgggactggtatcgattaacaggttaatttggagcgtcacgggctagttccggtcgggactagttcggggcgtgacaatcccttacacaagggtaggatggttgatggagtttaggaatttggttaccgacagttcatgtcagtactaggtgttttcagtttcctaggtcatgttatgcaggaccgcggcaccagtcgtctctctagatgaggtacaaaatgcttaatttgtggcactaaccagacaccagcgcgatatagattgatgctggactagtcgatggcatgatacagtccacactgacgatcagactcagttcttgaatccaagctagactctggaacaaacgttttagattctaagttttttcataactagacgagttgatcaggattggggatttgctggattagactcggccattttggcattattggaagaaactacggttgagcaggatgatctcgtcgttgcaaaacttgtagccagatgagtaaacatttgtggttgattgcatagataaagctagcattaacgaatgcttttaggagtagagttcgtctcaaatacgaagagaaggatgtacaattcctggaaaaagaaaagatttgcagttattttggcagcgtattcatatgcagctattcaagtatttgagaaattaaatagcataaaaatgaccaattagccaggcccaaaattggccatgtatattcatcttataatgcaaaggccggacgctgcccattatatatataaaaaaaagccaggcccaaaaagaaaacgagcacaacataaaaggaacaaaggttgctgtaatttcaacaatgctagctcttttctgaaactttttccatcaattcgatcctaccaactctgcttaaactcttcttggatctctgacaactaacgtgcagccaacaggccagccatcttctttatatatacatggcctcattcatggctgcttctcacctcatcctctgaatctgatccatcaaataccttgtctaatgcctgataactgagaagtgacagaagaagacgctgtcatattgtacactgatagaacagctgtgcttgagtgtagctgggtgagaaatgtttgagcattgcattggcctcctactaggagtggaaggcatccggataatttctgagaaaggtgcttgatcaatcgttctctactgaaaaatcaagtaccaccaaaccacacataaaactactgtcatcaaagattctagctttctcagacaatgagaagcaccacgaataattatatatagtctatcctctattttcttcgtgataatttactaactgggttcctttttttttgaaaaagaatttcactaactcggtatgcctgtaaactacttgattggagatataacatcactatttttgtctctttttgcaggagctgcacatgggatgtacgtggctatattggtactagctatgttaataagtgggacatgatttcatcgtccgggttctcctcgtagattatgtcctctacatcaaagtattcaagtcattgtcgtcgaggctctcatctcatcctcgcagtcgatttccgcctcgtcatcgaagatttcatcatccggattctcctagcagattctatcatctacatcatagcattcaatgtcacttaggcaaccaataggactgtacgatgccaagcgttgctagttttatattagagcaattttacagttattgaggaggtatatacctgctaaggacagtaaaatttattttttatattatattataagtaggggaaaaactttatataaccacccagggtgaagaaaagaaaaaaaaggaaaaggaaaggcaaaactacatcagaacatgctagggcgcattatctataaaaaaaagggggggagggcatgctagggcgctattctcgttgtctttcatggggttgtacgtgtcaagttaaatggttgggtaactagcaagctagctgtaaactatggctatggctagttaacgtatattcacagttaaatttatttttacgttgtaacctatagaagttaaattagatcttgcatgtttgtagagtgattttcacatattaatatgtcttgttgattttcttttaaaaaaatttataattatttagatgacatgcaaacaacgagtaaatgtcctctcgaaaatttataatagtttaccaagtgtgatattatcttcactttcactgaagtagtttacgtgtatctgtgtatgcacggtttactgtttatttttcacgctgcacagaacattactaaaaaaataactaatttgattaattattcatgttttgctgcagtatgctgaattgccaatcaattattttttctgctttgcaaatgaatggcgggctctctttcttgtatcgtcaccattccggccgccatcgcccacatcccctcgcccctaccgtcgtcgtctccactcccaccgacatcgctgtccccgccgccagctgccaccctaccaggatctggcagtcaccatcgccgctgcactagaggctcccctggccgcccgcacagggagaggcgtgaagcccaaccgccgccgccgtccttgcaggtacatggctctgcggccactacggcggtggcgaggcggaagaggaa

SEQ ID NO: 61561 - DNA, 502 bp, Oryza sativa
acttcgacaacccttctcactctctctctcttcacttataagcaagctcacacacacctcactctctctctctctctctctctctctctcttccgttggagtaaaaaaggaggggaaagtgagaaaaagaggagaaaagctcacaccacccacctcctccattactagtttacttctcttctcctcctttctcccccattcccccaattcattccttcgccgaaccaccagagtggtggagagtagctagcagagtagcagagcggtgggagcagcagcagccgtagccgcatccggagagattcgggcaggagaagccgccgcagcgatgggcgcgccggtgcgcggcgccctcgtcttcttgcttcttctcgccggcgcggccgcggagacggcgccggaggaacccacattgccctccgccgccgccgatggggcggctagtagcgggacaacatctggcgctggtgctggaacgggaatcaactcgaactcggggctg

SEQ ID NO: 61562 - DNA, 679 bp, Oryza sativa
tattttgggaccctaaacagttttaatttaaaaacttttcaactacaaagttgtaggtcgcgttgagggctacaattttgatataaagtttgtcttcattagagttaacatgaaaaagttatgaattattttttgatataaagtttttagaccgtcctgtttagggaccgaggtgacacaactgaacaagttggaggacctaaacgagtgatccgcatgtttagggactgggatgatacagtcgaacaagtttgagtacctgaacggttgatttgtgagtttagggaccgggatgacacagcggtacaagtttagggaccggtgatggactttactcattagaattttatgcatgactatgtgcatctgaatacctcatcaataataagtacaaaacaagttctcatgtctagttttctcaactactaacatttctagttttgtgttttgtcagccatttgatatttctgcaaaagttagttttgttttctagaccaaatatctggaaatcagttttgtcaatccttgacaaggggggcctgcgcggtctcccggtgaggagccccacgctccgtcacacatatttcgtcatttaagttttttctttctatggttggttcttatatgtttctaaatgtgaaaaaaaaattgttggacatctcttccctctacactatag

SEQ ID NO: 61563 - DNA, 688 bp, Oryza sativa
tggaatgcgggcgctgggggatgggggatggggaggaaggaggatgaaggcggcggcgtctggacgatggatcggtgaccgctgttgatacggagggtatcgaggaggaagaaggatcaaaggcaccgctcgggagagaggggaacgcgtgcgcgtctgcactcggcaggatcagagcattgcggaagcgatctgagccattggatttcacgatcctacgtttagtattacgcgtgtctatcaggattggagtcaccgctaccactacggaatttttaagtagcagagattacgaatctcaactctaattgcgattgccactaaatattaggggtataaacggagcggatattatccgatccgctccgaatccgtccgatgtaaggatatggtaagggtttttagtatccggccggatacggatgcggattttgtcatgcggatatggtatcaatgatatccgatggatgcggattatccgatattttaatcggattatccgatgtactgtttggcggataattcacaactttcaggccacacaacaactttcagacccatctagcccatctattataaccctaacctaattcactcctcccccagatccctctctctctctgccgtcagccctcagccgtcacgaggtcgaggagtctgagagtggcggcgcgacgggacccagcat

SEQ ID NO: 61564 - DNA, 634 bp, Oryza sativa
ggatcccccatgattgtaaagagttgacacttaattcaataataataaggtgttgtgttcaaaagtccaaattttgataacaatagatgtgttaatttataaaaaccaattgattcatccttcctccgctttctggaatcacgtctcttcttgtttctatcttcctttagctcttttgtcaataatgggtacctctctctagcacacttcctttttagttcagccgtactgggattagtaacatcttcatgcatgttgggtgtaccgtacgacagttcagctttgtctgtgcatggtagccgcacatgcctaatgacagaagcgttattttcatagcctgcaccgcaaaatcagaatgctgatgttagcctaaaacaaatatctcatatattaaaaaaataaagccaatataagtatgataccaaatccaatagttgaggttctctgaatcttatatgtagagttcttgttgatctgttgacagttctcacggtcttttggaacattgatttcacttgggataaccgcgcggcacgcttgtttgtcaacttggcattaatcacattagttatattcacaaaaggacctaaaggaagagtgtatgtaaaactaggaagcaaaaatatatcaattg

SEQ ID NO: 61565 - DNA, 723 bp, Oryza sativa
aggcgtcagcaccggacagccgtacgaggtaggctaccgaggatgatgatgatgatgccattgttgttgaatgtggtactcatcgtctgacaaatctcaatgtgaatcgaaatcgaatatgtgctttctgtactcttcgaagagaaaattgcctaaattttaaagattgggagggagagatttaaatatattacttaatagcctgaacatcatttagcaaagacaaaagagtctctttgatcttcatgtcttagcaaacaagggaaacacccagggtcttccggctaactccacaaggtggtgggctaaacgaactggattcgaagcctcacgcccacaccccttctaattatttgatattaggttcttctctaatattcgcgtgttttatgtcttagcaaaccagagtcagagttcttgatttccgaatggggcgacggcgaggaggagcaaatggttctcacatccgtgtcttgtgattgcaccggcttcccttggataatttatgaatgaaattaccgcttctaaatgacgtttataggctatttagtcccttttctcgatctttgggctttgggcgcaatgcgaggtcatcgggctttgggtgcacggatggcgcctgggccatggatcgtcgtgggaaggtattggtgaagataatccccgacgacaatgacagggacgctggtggcgaggcggaggggtgatatgagagcatggcga

SEQ ID NO: 61566 - DNA, 500 bp, Oryza sativa
  unsure (1)..(500): unsure at all n locations
tttacaaataagccgtttcgcttataccgccaataagagaaacaatggcttcgtatgtctctatatacatatataatatatatagcggcagctatagccggaaatttaaaacggcgaggaatctaatctaacggcactttcaagaataacgccatactatacatacctgagtcatctctatcttgcttgaaatagaggaatccgagcagcaatccagccaacgaactcgtcaaggcaagagcaccttttacggcgccatggccgacgccgagatccctctgcgcggagagggacgggagcgtgagccgctgcgcgcgagtgatgaaattttcgatctgagatcagggggggaaacggagagagactcacgagggtgcggagagcgcgtggcttcgctggcctagtccccgccgccgccgccgatcgcngcgctgcgcgccgcgtgccgagagcctccggtcgaggagagatgcgagtgcgcggaggaacatgggcctcga

SEQ ID NO: 61567 - DNA, 1691 bp, Oryza sativa
cacttttgtcttcattccctaatgatcacactaatacgattttgcatcgtttacatatcatgtcagcaaaagcatcgcgtctcttgacgccgccgcacccgagcagagcgtattcgatcaccacccgcgccaagagcgcttgtcgatccgatccggtgcaggacaacttcttccatcatcccggctgaggatgcttgctttgctgagctaattgcatgcaagagagcaattgaaacaggccaaggaagtcagagtgttacctagggacagtcggacagacagacaatccagatgtagtgagaatgcttgaggggagggatctcaacagatcagcttatggagccttagcacaagatatcaaagcgaaactcctcttacttcaggaggtaaaggttggctgggtccgacaaatcaggcgtcgcataagttagcgcagaatagaatttttttaccagtgcttggtttaatgtatgtaacccctcattcttagaggcggcttttttccccttattaaatccagggaacttcattttccccccttattttactgtagaaactagcaagtgcagaggattcaacccaattttgtatatgagaagaaaaacaatgcatatactctatattatatttcccatttttatctcagaaggtacaaactttaccctgtatcattagacaatatatgattttgatcaagtgcttatagccgctcaagaagctggcattgatatcccatcacaacaatgaatttggagctggtagtaagagttcaggagggcctcattgaaccgtttcgggtcctcctgtggggcatatggccggtgttctttatgattttccaacctagcattcgcacgaaagtgttctgcatttgcattaattcatcttgtgtaagtgaaattacaaggtgcagcctcagcatgtaattcccctgcaattattttaatattttttttttgaaaaagagagcaaaagctttgcttcatactctatcatgttccataatactcgatgttttggacagggttaaattcaaacttttatatcattaacgaacaataacattaaaagtacttagttcaaagtcagtaaaacaacattacaaagtattataataaaagtaaaatatatttatttattataaatattataatagaaaattatagttaaatatgtattttgaagattatgtggttcaaatcttaaagaattgtgaaaccggagagagtatgtattactctaattatattagaaggaataagtaccgacctcgctactttaaatgccttctccatgggaaatatctgatcatgctctcccccacaatacaagaacttgctgaaaggtgagacagtcagacaaagaccatttgataaaggtaaacttgggaagtaaagcactcttgtaattattcatcagctgctaatcgctatggaatacctggggaaatggagcgagatggaatttgtctttgtcccccagtgttgtccccttgatgatgagctcttctcttctattttgtcggtgtagagatactgcaacacagtgttacctgttactgttactcattctttttgataaataagttactgatactaaagtcaagaagctgtaatcaaagataatgactctcaagaacaattagtgcagttgattacatgattgtactcatcactgccagaaaatttcca

SEQ ID NO: 61568 - DNA, 713 bp, Oryza sativa
agacatgggtatatgagatgacccagggtttgtaaccaaatcatacctttctcggccttttggctaagatcaagtgtagtatctgttcttatcagtttaatatctgatatgtgtaccatgtgttcactttgatattaaatttattttagccaaccatgtcctcggcgcctagggttcctaggcgactcaaggtgggttctgcgtgggtagggtttcaatcttctctcaaccccatcggtctcatgcctgatcggatcgatctcttcggtctagatcctgagtcggatcgatctcttcggtctagatcctgagtccacatcccatccttcctctgtgtccacggttagattctctgttttggagccgagccaaaccttgctagccggggaggggtagttttagggttcggagggcaccatggaggcgatgcaggcactgatgaagcgcatgcaattgtcggaggcagagaagaaggggatccggatctgcgaggcggagtctggaagtatgggatcaggggatccgaaggcgatcgggaaggtcctggcggagaaagtggtgaacgcggagggtttggcgcaagcactggggaagatctggtgtctgattaggggaataacgtgcagagatctaggcgagaaccatttcctgtttacctttcatcagcatccgggaagcggcatgctctggaggatggaccctggatgtttggt

SEQ ID NO: 61569 - DNA, 1664 bp, Oryza sativa
ggcttattactaatgaatgggctttaaagtgggggaaattcaagttgggcctgattttggcccatcttgagtagtaacccattaaaggcccaacttaacatttgctttttctttcaaaaaaaagaacattgacacggtcatggaaaaaaatgtaaagatttgattatattttttagataataaagatttgattatatgacccgataaaattattttcagtgacgcttttcagtggtgaaactaaaatttgggcctccttttagcccaatcttgagcagaactcacttacggcccaacctatgaaccatagcccacatcactaagctttcctttccttttctttggtagagaagtacaatatgataataaccattaactagtactagttaagtatgaagtgatgcataacactataacagcataagtacagtatgatactaagtttctctgacataatcatgtcataaaatgcttcaaaatccaaactgtgccaagtacaatttcctagtcattactctaccttttcactgatgatgatgaaaaggtcattaggatgatactatatatatagtatatcatatgtgatgtgtgcatcaaaaactcctagctaactgagatgcatgcatatgagaggtgtcaatctacctaggaaaagctacagggcactcaccgaatcgagcaggatgttggaggccttgaagtcacggtagatgaccggcttctctgcgtcgtggaggaacgccaaacccttcgcggcgccaaccgcgatgtttaatcgggtcgaccacggcagcactgcaggaatctctgcagaaaaagaagaaaagaaaagaaaatatcttcagaaatctcagcaggatcaacgtcagctaaagccgcgcatgtcatcattataattaattaatcgatagctgatagccatgttatgtatacacatcaatcgaataagaaagctggaaaaggaaaaacaaagcagtttatgcgtattgttgcagcagaggagaaaaaaaagacgatgaacagtactggctagccggccatgcgtgttgtcgcctttgtggaattttggtttcttgttctttctgccttctgaattttcaagaaatgttattattgtaatttggagggattcgatatccagtcaacgagttaggagatttcgtcatgaccaagaacaaatcaatcagcttgagccagtgaggcagctgggaagattgcagcacactagattactatgtcaacctgaaattgatccaacaactacaggtgacctcactttcatctgacgtctgtaatctagcattagaaaacgtctagtagcataatctatagcttgtctcgcaagggtgagtgaatgtataattgacccttacctaatgaaatactattttccatgggttttgcaagctcataagtgagcagagaaggccagtcaaattcagtttggtcagaactctgaactctaataagctaaagaagttggctagccaaacgaaggaaaacatatccatcatccaagctgaaagcctcaaagacgcaaccaagttttttgagtagcaaagctacccatttgaagtagacttctgaataatggctttgcttctctctcattttgtgatatctataatccattattaagttggaatataacctcattttctcaa

SEQ ID NO: 61570 - DNA, 723 bp, Oryza sativa
taatctgagctgaagtgcaagattagatgacaaacggctgtacttctatgataagtctttgtatgggccccctcttctttcatttttgatatttattggacttgtcaatttcctgactaggaagtggccactgctagatcattgatagcgaccgatagaactttctgattgttactttgttcattggggcttctagattatagttttttatgcctttctgaggtgggtactgagtttccgtcatctctttattatattgagcagagggaacctgcttgtattgacttgtacttcagtattgtagaatctcaacagattcctggttggttatcagatccaatcagcgtggtacagtttggtgatttttgttgcctgctcttttcattttccctgtttgtggatgggctattaaatgtatgatgctttactattttgttgtaacttggggcactttttttttcttttttctttagataatggaagctttattaagacttagtcaaatacaccaagttcttggggcacttatatatgtttagtaagcatggctgttgtctgagaacattgcgaattggctgcaatttaagttctgctgccttttctgtaggtttcaaatctaagtcatttgagcaaactggctcgtagaaatgatacagccagcagagtagatgaagctgacaaattgcgtacggttttccttgcaatggaggatgcgagagcagt

SEQ ID NO: 61571 - DNA, 1648 bp, Oryza sativa
atcttgaaactgcaggctccagtttggccatcccaggctcccagcacacccgctcaaaaagacagaagtttagagagagagagagaatatgcggtaattttttttagtggagttggttacatacaaatttcttataaaaatgttgattgtgccacgttatgaacgaatcttgattttttttttataactcgcgactaattaaataaaatgttgaaatcattataaggaagaagtttatatataagactattttttctattgcaatgctctttatcataaagacgaacgacctgtcaatggtcatattactattaatacgctgaaacaattggtactagggattagggaaaggaaaaaaagtttgaattagacctccaaactagtgagtgagtaagaattaccacctagactttagattggttttgctcttatgtgatagactagtcaatattttttaaaaaaaaaattggtaggacccgtccatctcttcttacaggtggggttccactgatttattatgaaaattattgattgagctgtcataatataggaccaaaactattttggattgtgttaaggggattttaattcaataaaaaaattcaatattaatattaatatggcgttcatgaaaatatttatagttgagagtgaaaaatgtatgattttcgtgtctagaggttaatttgcactcatccaataatttagagggtgtaatagttgagagtgaaaaatgtatgatttttgtgtctaggaggttaatttgcactcgtctaataatttagcgggtgtaatttggacttttttccatacagaaatgggcactgagtcaaacaacaccacatcattaattactgcagtagactgtgagcctgtgaagatggtataaatgtatgctgagcgcctagaggcacgccgaagccagacaggcagacactaaccgtggagtagtctgatcgatctatagaaatactaagtagtagaacacagtactgtagccaaaaactaggccaagagagagattgggcgttctgagcgtagccaaagacatggcaactgatgcccacataacacacttcgcccatccacaacaccgccttctcaagaccccgtacagcagcgcctcgcgccatgtctgcgacatctgcgaagccaagctctccggcctcgtcggctaccgctgcaacgcctgcgacttcgacatccatgaggcgtgcgccgactacttcaaggagaccatctccttcttcgcccacccgtggcacaccctcacgctctgccgcatgcctcctgagaataaaggatgggtatgtgacctctgcatggagcattgtcccccaggaaatttcgtgtaccgctgcatccagtgcaagttcgacgtgcaccccctgtgcacgttgctccctcagacgatccgcagcccgcttcacccacaccacgacctcaacatggtaccttcttcagggcactgcaatgcttgccctgaacgtttgcccgtgtggcactacatctgtggcccttgtacgtctccgtcttatcggctacatatcgggtgcgtctctggcgcgccaagcggtgtcggtcagggtagcggcagcaccaccaaccagaacaacagtagcagccgtggccagggcaccggcaacac

SEQ ID NO: 61572 - DNA, 1383 bp, Oryza sativa
tgcacggtttttcatggtttttcacggttaccgcggtaaccgtgcttaccgccggggcgcggtaacccggccccggcggtttaagaaaccctgatggtgggtcaagccttggggtcgacctaccagtatccctaacagttattctttattataggtaacggtattaccatattatcttattgttctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttgtctcttatctaactttctatccattgggatgtggcaatcttactgccaaaatgttaaagataaaaccaatgatgttttttaacaagaaaaaaatatttatcgacacttgtctggcttactatagtggtttgaaagacaactttctcctatttcatctatgtcacgtgattcctttagggctccaaccgtgtgtccggtgtgacatgggactcttaaaatagtaaaatccccttgtgatgcatttgcatagttcatctacatggagattccacaacaaaaacaccaggacaacacatcaagaaacaaaaatctaatttctttttagcttccaaaaaaaatctccttccttcttggaccaaaatggcgataaaaccccaaaccacagcccaacatcccagcataacaaaccaagagagaaacaagcctaaaagaagcaaggcccagcccaatagcccatcaagctcaccattcctcgcctcctagggtttcctcctatccaatccaccaactccgcctcgccgcctccatccctcccattcccgaacacgtccccaaggtaagccggcggcggcggcgatgacgacgagcctgaggaagaaccgcaagaagcgcggccacgtgtccgccggccacggccgcatcgggaagcaccggaagcacccgggaggccggggcaacgccggaggcatgcaccaccaccgcatcctcttcgacaagtaccacccgggctacttcggcaaggtcggcatgcgctacttccacaggctccgcaacaagttctactccccggcggtgaacgtggagcggctctggtcgatggtgcccgccgagcaggcggcggaggccgccggcgccggcaaggcgcccctgctggacgtgacgcagttcggctacttcaaggtgctcgggaagggtctgctgccggagaagcccatcgtcgtcaaggccaagctcatctccaaggtcgccgagaagaagatcaaggccgccggcggcgccgtcgtgctcaccgcctagggtttggtcctggccctgccttttgttc

SEQ ID NO: 61573 - DNA, 1108 bp, Oryza sativa
tggagtattaactaagttagctatactttcgaacagaggaaataatttttagaattaacatagaaggttttcaactgctttcgtaactcagctgggttatagattgctaggatagaagaatataattattatgctaaaattattttcggttaattcagaaacatgttttcgtttttcttttagaaaaaaaagctttgaacagggttacaataatcatcttctccatttcccttttctgcgtacagtacgtactctgattttattttctgctacgttggacgaattatcttctggaacagtatgttaaggtgcattaataattaatttaaaaacaatattggttcgatgtagggccaggtaaaacgacctccaacaaaccaaattaattaaccaccaacgactgaatgctcatgggaaaagtagcttcctaaatcttcacactcacgagttaaacagccattaaatgcgatcaacttcttgatacttggactgcacttattaatgaacggattgtttgggcctttggttatcctcgcatttaatgcgaggcaatgctaatgcaggattctctgtgggggatgcaccgagttgacatgtgtgctctcaacgtgttttgttttactgggaagacccacctagaaatacacggggtattccggatagctccacagggtggtgagttagccggcttgtatttgatattaggtaattctctaatatttactgttttttttacaggaagacctacactctcacacactaatatacgtcaattcccttcagtttcataattcttgtcttgtcttttggacaatgatacgggctccgaaatatatcgttagttatgtatttttattatgatatatgcgataactaaatgcatgtttagtatcattatagtacttttgtaagacaaatatatatatatatatatatatatatatatatatatatatatatatatatatatatatatatatatatataagcattaagatttaagagtgaattgcacccacggtgcaacaacttggcaggtgggtgcaatttggtgtaataacttgaaaaatgagcgttctggtgcaacaacttagtaagaaggtgcaat

SEQ ID NO: 61574 - DNA, 2583 bp, Oryza sativa
aactcagaaatcacagagcgctcacgagatcagagagagcgaggactcaccatgagatcaagccgcctctcccacccggcgggaaccttcacctcgaggtcgaccaccttgtcctcccctccgccgccgccgacgacgccgccgcggctgtcgccgccgcacccgccgagcagatccatcgtcacgacctcccccgccgccccgcccctcctcccggcctcccctcgcagcagcctcgccacagagctcacgtccgccgccattcccctctcccccgtggcggctttcctctgcttctccgcgtcgccgcaagaagaagaagaatcgaaagaagaagaagcggtggcgctggtggtggtgggcgcggctcgcctatatatatatagagggcgcgcgccgccgtggccgacaggtgggacccacgcggcgaatgggcggccactaatttattggtgttgttgggaaatggttgggggaattattcatgccaattaattccgatttctagggggaaggaggaggaggaggaggagaaagaaagaaggcctctctctgtggtttgatctagtcgagttttaaatgcattttgattttttggatttgttttggtttaaagtttgcatttattctgcattccatatacctgtggtgtggtgccacatttggcattcagaaaaagatgaagaaaacctgatctgcccacctgtaaattgtagtaatggttcatttagagagggctatttttatgcagtgatgcaaatatattcatttagtgtcatgtctttaatgagaaatgatcctcaatttatttgcattattcagttccttatgtgtagttattagttcatctagaaacagatgttcattatgatattcattattagttccatctaccatgaaagaacatgctatattaatttatatgcatggcgcgtcatctgtttttagatatataatcttattaaaaataaatcacaatgatttgtcaacgaacatagctaaaacgtgttatcgtatatttcttggagctgaataatattaatctctttgtcaaaagtcatatattggagtacatgcacggtatggatactccagcagtcgtaaaaacattaaaacgtcccaaacaaacctttaattctttgaatggcaacatctttttagattgattgtataaaactcatatattcataattatcttaaaaattagctctcaatatgatctcaatgaattttgtaaataatagtcatcaactcgtgcgttgcatggctacaattattcataaggtaaatcttagaattcgaatcatatgttcaatacatagattactttttctccaaattactactactacctttgtcctattttcgtattatttagcatatattaagatttgagaagaaagactaaggtgtccctcattaaatggtgtataggtaagagtggggtggtggttgggggtagaatatggaaaattttaaatcagaagtgattaaagggaaaattagtactctattataacaactattttggcacaaatttgaaacgtacagatacaattattatgggacggtgatagtattgcttagatttaaaagggagtccatgtcatttataatatgataattattaattttaatttcataataaattgagagcataattctaagtggtacaacttcatatttattagttacaaattattgaactttggaaaaaacttaaactcaagactccatgtataatggcatgttttatatcacactaaatctcaatatgatatatagccgtgataatacaatcaacttaatcaacggttagtaccatatctttttgttaacgtaaagggcactctcacactagatatatattcttttaaacagtctaatatatctactttctacactcttttatagacaagatgatagataggtagatagatagatagatggcgtgttcgtcgacatagggattcaagatgccaccgtcgtcaccctctagccctgccgcacggagagggatttggggatagatccaactatccaagggagttggacagagaagaggaaatacaacgagcggttatctgcgaagttgtaacaggagatgtgtgatggctttctatacaaacgctctggctgaattatatcctttgtattaaaattaaagggttgattgcattagtgcatgagggctggtgcgtgcatagaatacattgccaatcgatacatagatagatagatagaaatttgttttcataatattgcaattttaggatttttttaattactctttgttccaaattagaaaatggagggatgtccgtatatatttttaaaaacatgtaaaaatatctatattttaaaatggtggtaatattataaagatggtgctgatatgccaaatggcatgtattcagtgatccaattccgtaaatttgtggcaacccacaccaatattaaggaagtataatcttactaataatgatatgatccgaatattgaagaaaaaatagttcaggcatatgacagtaaaattttagtggccaaatagggtgtcatcaattcactctaaaaatgggggat

SEQ ID NO: 61575 - DNA, 10132 bp, Oryza sativa
accgctgcttcgcttccctcttctctcctctctctcggccgccgctccgccgtgcctatggccgccgccggcgaccataggggcgcgggcgcgccgcctcccgtcggccgtgccggcaaggccgccttcgggcgcgccccgcggttgccaggtggggcccggccgtcagccgcccgcgcccgcgggtgcggctgacgcgtgggacccacggcgccggccggcgtcagccgcgtgcgcccggtccaccgtgtaccgtgaggctgacgcgtggcccccactcccgtggacccggtccgcgtgccctctccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatatggagtttattagagtaaaagccttttcttttccattggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgctttatttaaattcccgcgttatcactgttttatttagccatgcctatttacctttgttatgaccttattattattgttattgttattattattaccttgtgcaccctagaataaacaaaacctcaactagtggacactctactcatggcaccactagtttaattttaggtagatgcttcgcaatttaattaggtaacattaggtggtttttcaactatagactttgggaaatattcatatcacctggatactatggaatggtttggttattgtggaattggcttcacaccgctccttctattcaaaatccccaaaatggttttaggctgggcgcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgtttcaattcttaaaacctgcttaacaactaaaaggtggaatggttggcctgggttggcttgggacgagctgggacccagggtcgggttgccagttcggtcttaatcatcataggccttgggttaaggcaggttcgtgtgggttcacggccttgataaataatattgtatagttctaggatcgcgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttatcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgttacaagttggtatcagagccacccttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtagatggccggcagcgtcacccgtcgtggtttggacatgactggcttcgtcttggagctgcggggcatatgcgtggtcttggggtacccacatggagtggactaccaggccaggccgcttccggagcaggagggtgacgacgcggagccccacgctggttgggaggtcactgcagtgatcctctctggctatcccgagcggacttcgctggcagtcaccgcgggtggggattccttccccgccgcttgccagaacgacgctctcctcgccatcgtcactcttcaccagcgctacccggacgagttgcagcactcgccctaccgctaccaccctcgtcgcggaggagcccgcgactacgccaccttccgagatgctagctcggaggatgacgctaccatcgtgcacctggcgcgcatggtggaggcgtacgacgcggctcgtatcgacttccatcagatggtgcatcgcgggatggtcgagaacaacatgaagatcctggagctgcgtcaggagaacctgcagctcaagaaggacctagacgtggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccagaagggggaagcctccggcgttggtagcacggaggatgcgctgttgctcaccttccgtcctggcccgtcgcagcggtagacgagcagttagtaggcttgcgcgtgtgttctttctcgtttgtcttcttgttgagtcgtgtggggcatggttatgccggtgtgtggtataactgtgtcggagcctgtcttattttatttgcctaagcaacttgaactttaatgaacccatttaatagcagtaataaattcaagaattatagtagtcgtgggtggttagttttaattgttagctctttctctgcttgctggttctgtgtggggggttttcagatggtgacgaccaggagaaatgctgctaccggtgatggcaaccaacctgaaggcagcaaccacaaccaccagggcaacccacctccacctcctcctccacctccaccaccaccaccagataccaatgccattctcacccaaatcctcgcccagcaggccaacatgatgactgctttcctccaccacctccaaaatccaccacaacataatgctccaccaccacccccacaacactctaaactcgccgagttcctccgcatccgtccacccaccttctctagctccaacaaccccgtggatgcgttggattggttgcatgccgtggggaaaaagctagacacggtgcagtgcagcgatgaggagaaagtcatcttcgccgcccaccagctgcaggggcccgcatctctatggtgggaccatttccaggctacgcagccagaggggcaacctattacttgggcccgcttcaccgccgctttccggagaacccatgtgcccgccggagtcatggcccttaagaaaagggaattccgagagttgaagcaaggcaaccgcttcgtgatggagtatttgcatgagttcaacaatctggcccgttacgccccggaggatgtgcgggaagatgaggagaagcaagagaagttcttggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcccgggggatcctcttcgcagcagcaacaacagcagcagcaaccccgctctgcgccccgacctcaattcgtggtgcgcgtcccacagccgcagcagcagcagaatcagcaagggactcgtgcgccccgtcctcctacgccaacggtgcagcctggtcaaggccgcagggacgctcaaggtcagcagcgtctgtgcttcaactgcttcgagcccgggcactttgtggataaatgcccgaagccaaggcgccagcaaggccaagcgcctccccgctccaacaacggtgggaaggatgtcattcggggtcgtgtgaatcacgtgacggccaaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgagacgcaccgtcactctgtaccgagggccggaacaaccggttgttttctttgcacccccaacctctgtcagtagttcagaactgcattagataggactgtcagaaatccccatcgtcagggagttcggagatgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacgggctgtatgaattcacggtgatgtcattcggtctaaccaatgcacctgccttcttcatgaacttaatgaacaaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagttaaattcttaggacacgtgatatctgctaaaggagttgctgtggaccccgaaacagtgaccgccgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaaggcgagaaggcgtttcaaactctcaaggaaaagctggtttcctcgccggtgttaatcttgctggatactcgcaaggatttcatagtgtattgtgacgcttcgcgccaaggattagggtgcgtgctcatgcaggacggtcacgtggtagcctatgcctcacgtcagctatggcctcatgaaggcaactaccctacccatgacttggagttagccgcggtggttcatgctctaaaaatctggcggcactatctcattgggaatcgctgtgaaatatataccgatcataagagtttgaaatacatcttcacccagtcggatctgaatcttcggcaaaggagatggttagaactcatcaaggattatgatgtgggaattcactatcatcctggtaaggccaacgtggttgccgacgctctaagtcgaaagagccattgcaacactcttaacgtccgtggcattccacccgaacttaatcaacagatggaagccctgaacctaagcatagttggtcgtggattcttagctgcgttagaagccaagcctaccttgctcgatcaaatccgcgaggctcagaagaatgatccggacatgcatggactcctcaagaatatgaaacagggtaaagccgctggtttcacagaggatgaacacggaaccctatgaaacggaaagcgggtatgcgttccagataacagagaacttaaacagctgatacttcaggaagctcatgaaagtccttattccatccaccctggcagtacgaagatgtacttagacttgaaggagaaatactggtgggttagcatgaagcgggaaattgcagagtttgtggccctatgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaagctagccgagctctacttcgctaggatcgtgagtctccatggcgttcccaagaaaatcgtatctgataggggaagccaattcacctctcacttttggaagaagctccaagaagagctgggtacccgattaaatttcagcaccgcctatcacccgcagacagatggacagaccgagcgtctaaatcagatcctagaagatatgctccgcgcatgtgtcctagattttgggaagacctgggataagagtctcccctatgccgagttctcctacaataacagttaacaagccagcatacaaatggcaccttatgaagcgttgtacgggcgcaaatgccggacaccgctcttgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtataccttcgggtcacgccattgcgaggtgtgcacaggtttcagacaaaagggaagctcgcacctcggtatgtgggtcctttccgtatcaatgctcggcgcggagaagtcgcttaccagctggagctgcccgcctccttgggcaacatgcatgatgtgtttcatgtgtcgcaacacaagaaatgccttcgagtgccatccgagcaggccgactcagagcaaattgaagttcgcgaagatttgacctacgtggagaggccagtgaaaatcctggacaccatggagcgcaggaccaggaaccgggtaattcgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatacatcctcgaaattgtgcaaagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaaaccctaaaagaagtcttctttcccccccttcccttcttgggccggctcggcccaacttcctccctccctctcctctcccccgcggcccatcggccttcccccgcgcgcgcgccgctgatgggcgggcccgcccgccaccctcgctgacgggtggggcccacctgtcatcccctacctcgcgccgcgcccgccgcccgcccgtgccctagcgccgccgccgccgccgaatccgccgcatcccgccgtccccgcgcgccataaagagggggaaatcactccccgtgattccctccctcttttcccccgcttttccctctctctctacctcggattcgtccggatttgctcccgcgatcctcgccggcgcatcaatggcggccgagatttccgcggccgattccttcccctccggccgctctctccccctcccgacgctatataatcgctccccgtgcctctctcctccgtttccgccactcgccgcactctctccccgtcggattcgagctcgcgccgttgtcctccctctccgccgtcgccgccgagctccggttcgccgccgtcgtcgccccggacctcctcccgcttcggcatcgcctccttcggcttcgccgcgttctcgtcgacctcgtccgctcctccgtttcgcccgccgaccgccggagcatcgccgtcctcgtcgacccgagccgcgccgccgcctctctccgcttcggtcgccgttcccgtcgtcgccgtcgacccggggtgagccgaggaccgccgcttcgcttccctcttctctccttctctctcggccgccgctccgccgtacctatggccgccgccggcgaccataggggcacgggcgcgccgcctcccgtcggctgtgccggcgtggccgccttcgggcgcgccccgcggctgccgtgtggggcccggctgtcagccgcccacgcccttaggtgcggctgacgcgtgggacccacggtgccggccggtgcgagcccgggtgcgcccggtccaccgtgggccgtggggctgccgcgtgggccccacccccgtggatccggcccgcgtgccccttccctcggctgacgcaataaatacattttaaattaaaaatttaaatgaagaaattcgcaaatattcatttaaagagcatataaacttcaaatggccataacttggccatttgaactcagaattggaccgttcaagtctctaatttttccttaagaagtcaagaacccatttttgtgctttgttcctgcttgttatatggagtttattagagtaaaagccttttttttctttccgttggtcgtctagacgctgcagctttggaagatccgctcttcgtggaggttgaagccgacgtttgggaaagcgagcaaggcaagtcacatcatccttgaacatattgaatcccattttataaaattattttgatttaaattattgcattatcgctttatttaaattcccgcgttatcactgttttattcagccatgcctatttacctttgttatgaccttattattattgctattgttattattattaccttgttcaccctagaataaacaaaactccaactagtgggcactccactcatggtaccactagtatgaatttaggtagatgcttcgctggttaattaggcaacattaggtggttttacaactttagactttgggaatattcatatcacctggacactatggaatggttggattattgtggaattggattcacacctccccctctattcaaaaccctcaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctggttataaacaaagtacacggatggagatggacgaagtcgggggttgatggac

SEQ ID NO: 61576 - DNA, 2412 bp, Oryza sativa
aagatggtttctccaccagtgagtatatataccgctatttctagattagtaacacaccgttattcctgattagttgtaacacatttttctggatttttggactactaatatatatcacttttcatacattggtagtaactttttttcatactagtatatactgttatttctagtgtactaagtatataccatttttttctagattttcagtatataccacttttctaaattagtagtatgtactgctcttttttttttgtcagtatgtactcaatgacgatttggccagcacgtatatactgcattcctcattgaagctagattgttttttttttttttgcataatagtagtatatactgattttttttcgttgacggagtatatatatactgcccccctttttttttcagtatatatgtagtattctttggccagtatatactacattcctcattgaagatatatgtacacgattattaaaaaaaatgtactcgtagcagatttacccagcaaggggtgtgtatagaattgtacgagctgcagaattgtcagagttacaacaactactgagtatatatatccctggagaaagaagtatcgtttcaatttttgtacaagaattgcatcgcctcaattatgatcgaggctgtcacctggccggaatctctgctgcacggccatacaggctagccgatggatcgatgccgtcgtcgtcacccggacaccgcccgggaagcggcgagatgaatgatggcgccggaagcaaaaatcagtatatactactaatctgcaaaaaacaatctagcttcaatgaggaatgcagtatatacgtactggccaaatcgtcaatgagtacatgctgatatttagaaaagtggtatatactgcaaatctagaaaaaaaaatagtatatactctctatatgagagaatctcttaatgccactagaatttcaccaattcccttatatgccacttaaaattggcttctcccttatatgccactagttcaagtttttccacccttttatgccacttccaccactatagtgttagttgactgttagtcaaaggttagtttttttcataaatgaccaatatgccctctcaactaaaaaatgtgtaaacttcaaaaaaatcataactagtttattttaaatcttttttaagtgaacaaaattttgtcataaccagtgaaaaatgctctttatattaaaaatattgttggaaaactgcatgtttcatgcttacattgaaaatttatttgtgatggtaatggtaatggctaaaattgcatgtgatgcagaaaaaatcaattttcatatgttatatccagtagctatattagtactaaaatacctattattggttgtatactaattctcaagggcaaatgcatctttttacaatcaagttaacggtcaactgacggtggattgacggtaatggcataaaagggaagagaaacttgaaccggcggcataaaagggagaagccaatttaaagtgacatataagggaaccagttaatttagagtggcatataagggattctctctatatacttatatacttagtacactagaaaagcatatactggtaagaaaaaagttaccgccgctcaggaaacggcgagatggatgatggcgccggaagcaagatctatgcatgcatccaaagaaaattaattaaacagaagttcacaatcatatttggaaacgaatgatttggtgcatacctatagagatctaacaagaaaacaaaaagaaaacagatccatcttcttgatgatcgatgacgttgctgtatgattcagcgagcagatcgatcacgccgtcgcctccggcttgccgatgggctgcgctgtggacaccattgccactggatcgtgacgtcggctccggcttgctaatgtgactgcatcgtagatgcagaaacgccgacagatcacaccgtgaatgtacgccgaattgccgccgcggacgccgagtcgcctatcgatctcacggtcaccgccgaattcgtccgtaaatcaaggtctcgccctgggatcgatctgtggtttgatttggcaccaccgtctacgaacgagagtttttaaaagtggttttcacggttgttcggatcgctatatccacgaaaatcaaaacgggtccggtagttagacccagtaccaggtttgatcgggactaggccgctgatgtacggtggatgagagcaggagtacgtacacctgggtgtatatatatatatagaatcggatctctcttttgtactcccaggtgtatgtactatcttttcttaatggatatccattagttcaaaatgaataattagattaaaaaaagaaaacaccattctttttttcaaattatctgcatgcaacggctggtgcgtaggactaggttaaaaa

SEQ ID NO: 61577 - DNA, 3861 bp, Oryza sativa
tttttacctggtagtatcaacgatcaaagaacagtacgtatataccactaagcagtgcatgctgtttaaacaaacgagcagtgtgtaatcatactgattacaataacgagtggtatgtaagatataatcgattaagaagtacagaaggttaagttataatcaactaagaagacggtaacagtacatagatacaactgagattaagaaaaagaaatcatagctacagaggaaaaactgcatcactgcatcgccatcgtcgtcagactataatcttaagctaagctaattgttacatctctaccagaaaccaaatcacaatgggagatgtgcgtacatgttcgtatctgcggtcttccaccgttgccgcgtgattcattagctgggaataactctacaaactggcatcatcgtgcatggtcgatctgtggcagccgccggccgaatcgttcgattcgtttgcctcgaccagccgtactgattttagttggaggagagttcgcgtttcttgctgcggtagtggaactgtggaagccgccgccgaccctgatactgttgccatgggaatcctgcgaaaggggagtaatggatgtaaacaaccatcaatgataattcaagcattgaaaggacgtaaatctagtcgatcggcaccatcgacggggagcacaacccaactacctgatgtcgttgctaatcccatccgtctgaggactgtatgaggaagcgggtggtcgaactggttgatggagcgcgccgtccacccgtccgtggctgccgtggcaagattgctccagttcttccaccgccggcggacttcgcgacctccaaccaagctaccgtcaaggaaccgtcgccgcctccgcctcgcgtcaaaccgcaaatgtcgcgagagctgttcgatctgttgagtactaaccggtgcgatttatataattaagcgctaattaaggatcatggattattattttacaaaaggaaaatcaaaacgggtccgttcggtgatccgctaaggagcttcatcgagatggctgtgatggacggtagatggaaccgggtgtacgtactcccgggagtacataatcattttcatatatatatatatatatatatatatatatatatatgacatatattaataatatgtatttatacatatatctatgcatatgtacatgtacaaaatagacatatatgtatatacttaacattttatgtgcatatataatatatttacactaaagtaaatgtgtacatatataaatatagatatgtattacaattcattatgtcctagctacgacttcgacgtagtcgttatctcagaagttaacgacttatgaattgtagatccgtcgtagtagaattcaccctcgggatcaaggacttgttcattgatgaatcccatgagttggttcttgaacagccgtgataaagtcctcgtgtgtgaggttgtccctcatgtgaataacctatgaatgtatgaagttaattagtaaacaagaaatcgatacatacgcaatgaaattttgaatggtttatttatacgtacatcgagttctcttgtggtgatgatttgggttgtaacgcagtggcaatactcgcatatgtagtagccgcacaagttagttccctcttcctgttttgcacactatatacatgacaaacgacgagagattttatatttgaattagagattcgatataaattttgatcatgtactcactacaaatttgaacctccggcgaagtttttctttccaagtgccacggaccaaatgacggaaccgataccaagccctacatgaagtttaaaactatatatgattcgtactagcaatagcaaaattcgtaataattaataacactggaacatatgacattacctgtttataagttcaaaaatctggtcaaaagtagactcatctttattcattgagtcatagacattgactctacattccttcaagtcgaagagtaaaaggacccagtggaatatgcaatttgtgtgagatgatatatgaaacactgtgcatctatatgtacgggaacgaaatttgttcggtagatagtaaaaactaactctgtgttgtacggcagtagtatgaacgtcttgaaatgctgctccttgaggagatggacgagattgacctctgtgggttgcggatacttggtgaccatttcgacgtttactttccgagggtcgatgaatccagtattgaaaaacccccgctgtcgagccctttgaatctccattctacaacgatgaaggaattgttatatatggtgtacatatatacaaggagctaattaaaggaacgtaagaaatataactcaatgatatgtacaaaatccatgcgctcagaatagagacgtccatgcgcacagaatagaggacgtcgagggcatctagttggtatagttcgtagatatccttgaaattgatccagagaacatcttctccttgtaagaagtcggagttcttgattctcgctccaataatctccctaccgctggcgctcatctccatgtaccattcatggaattggtacatctgtgtgggtagggactgcagctgctcaggcttgacaagcggtttaccaagttcgtcaaggtgtctcacttccgcctttggaggtgcacctctaagtaactgagccctagttagcccgatatcagaaatgaattcttttattccaatttcttgcccagtcaccaatggctcgacctcctggtttggttgctctccaagctgagggacttttttggactttctataatatgctttcctaagtgttcgctcatagtccgttagctttaaggcctgcttgagtggtcccgacatcttctggaagaacttgttggcactcgggtctataggaatctgcttttctggacttcgaggcttcaattatctcttcacttctacagccacataagcgtcaagctcctcttgcgtgcaatcgtacggcggctccttgttctcggcggcgtcaactttcgccttcttcattgcccttgtgccggcaggcagtggagcttggtgagttcttgacttagaaggtgccggaggacacggcgcaggagcctgatcaggaggagacggtgcaggagcctgaggaggagacggtggagccggaggggatggtgcacgagacgccgcttgtcgcccagggaggatgaggtagcgcttgcgccatagtataatggcgtggcttgtgtcacgtagatgcgtctcaccgtctcctccagggtagtccaattcgaggtcctcgtacgtggcttccaccagctcaacttcgactctcgagtatcctgcaggaatcggcctacagtggtaagtccctgaagggtccgttgggatggccattcccgacacaaccttcacgtgatgagaggttatctattagtaatcaacctaagcagaaacttgcggaatgtacaagtccaaaaaacataaactacgggcataccttgattgataagttcttgaagggaatatgcagctcacgtggtgtctactgcgtgatttcatcaacggggcaggtggttacgtcctgagtttgcatagcatccatgctctgtgatcctacctgccccgttgggtcatggatcaattcaagttccttcttataaacttgtttatggacacgaagcggttttgccatgggaaactaaaatcggctccagacgattagatttacaagacagtttagcagccgatgagtattacaatctcatggtagatgaaacagaagatttggtccaatccagattgagagcccttgccaaggtgagtaaggataaggaacgggttgctcggcattataacaaaaaagtggtgcctaagtctttttctgaaggagag

SEQ ID NO: 61578 - DNA, 639 bp, Oryza sativa
tgggtaccacatacccacatggcacgtatatccgactggttataggtgatagcttgtacagatagaatatgtttaggaaatgactcgggaattatgttaacttgtatgtcaagaaaatatccaatagtgccagttagttacagttgtaatacatattcgttagcctagtacgtaagccatatgggctgtacattgtaatcttggctcctccccctatataaggtcgggtccaagtgtacctaggggcataacttttctcccagatcatcagatcaataatacactcggtggaataattccccggctgtataaacctttgcctcctacgtcctaacctatccacttttccagcttgattgctaccccttttagtattgccggaatcttgttttgacagttggcgcgtcaggtaggggttgcgccatgtttttcgccgactagtgcgatgggattcatttcgggcatcaccgacttcgctttccctcccgggcagacgtgctggttcggcggcccatggacctcatcagccacccgtacatgcatgcaaagaagacatcgtacgacagatcaatccatgattataaatcaagctaataatattatatagattggaaagaagttaaaactgtatatgtgcag

SEQ ID NO: 61579 - DNA, 11176 bp, Oryza sativa
ccggtgatatgcaattgcatgagaagacccaaaagtccaatttaacaatcacaaatgggcttagaatgtatgtcactgatttaggggcccacatggaagtctcctggaggaagctgggggccaaaagagcccatatggggtcggccgaccccttgtttagcccaatccagccgcattttggccaggagataatggaggccgaggaggaagcagcaggccagaaaccaggcctgttgggccagtctagggttcggccgaaccctgatcttagccgttggctctcccctttggcgtggacgctccggattaactcctgatggcggttgcagggcatttctgacaattcccatgctctacaaccgtcattgggagctataaaaggacctcacctccttcactttcaacacaagctcaagtaaggattgaagctccatttctccaaagttagaattagtatagtactagtggaatagaattatagtagttccgagttgcggaagctttaggaagttcggtaaagttcttagcttttcctttcttcttttataagacttcctttttattaatataatatttcttctttatacaagttcggtactttattccaatcatagaatatgagtaccattcttagtttatttataatcagtataatcttagtagttaaaccttctgggatttgcattgatgctggtataatgtctgattaccaggtcataagtctgctctggctaggctgagaactatgccccggggactcagatgctctacaccgattgcaaggctgtagagtaataagtagtaacttaagcatggggtttaggttatcacttatcattattttggggtatattcgccgggagagtagcaggccgctgatggtgacagcttagtacgtgcgtcttccccacagtttatatttctacgtacaatttcctggggttggatacacctttgtatcctactttggtttgagggttatgataggttgtcgtaagaaactcgtcaacctagggtaactttgcgatgcatcatatcgggagggcatagctgagttctggcttagctatgctgcattgttaaagggaatatactacatagagtatactagctagaatagactaggatgttgtatactagaagtacatgagtgagacatttctattctatttccacttattcatatttaggataaggaggagttagcggaatccttagctgtgtgtcactctacccttaagcttaacttacccctgcatagaccttaatgtatacaggtaatacataaactattagcatagtactcttttatcatatatttccttgggataaaataaatacgatatcttggaatactcctgggtgaaatgatacaatggtatatccgtgcgtttgcggatcatatttgtaaccataatatatcaggattatttctagtgctattgctgggaattatatttccagtagtgttactaagaaataccaacatggcgctcatgtccaccgcgtcatgcgcgattgcgaacgtgtggcaggtgacggcggcaacagttggcatcgggagagcgacgaggtcggcaacgaggtcccgaggggcaccgcctatagaggcgtgcagctcgactggcgcatgcgcgcacaggcaggccaaagccgttggagaagcacttctccatggtggcaatcgctggtgcactggcacccaaagtggcgcagacatgagggccaggccaaggcatgagtgctcgccagcaccagttagggtgatgacgtggacatacggggctgcacttctccacagtgcacaagctcgccatgtccatttgcattacttggtaggctgcagaatcattttttttctattacattgcatatatggtcattctctttggaaatatcataattggaaattttaaaagatctatacatatatagaagtgagtgttctaaagaaacattctctgttatacattgttaggaacccactacttccaactcaacaacaagcatccaccatagaagcaacaactgttttggggacaagagaagaagctatggaatacaagtgctggaaacttctagaaccgaggggggagggaaggctggagatcggaggagaggtaggggagagagatcgacgagggtgcccaccggccacccaagtcgccgccgccgccaggagcttcagctctgccaagtccaaacgatctttcgatgccccctggtgttgtcgatgctgctgcttatatgctgctcccttccgtttgcttgggcctcatggcgatgggctgaccagcctgtgtgcggcccacccgggatcctgacaatcccctcttcttgaaatttggcttgtccacaagccgatggaaaacacctctcgaatcccatggttgctccaaatatttggtgttagacaatgaaccatcattgaagaagaatagagcaagtagctttagcttgaataactgcttactccatgtaaagtacacctgggtgatgcatgacaatggcactgttacgaatcgcttgccaacattgattcccaacaatttgatatgctgcaaagagtgacaacctcgcttgatcaacaccactgtaggaactaacccaaaagtatacttctcatcatgaattgaattaatgcaacttcttccatttctttcacccttttgcagcctttttcatcagcaatcacatatagcaaatatctttcaacattcaaaccaatgtaatttgattccaaacatgatcagattctgatatcaccatgcaaattattctcatattccatttctccactctagtttggtagtagttgagcaacatcccctgaagatcaacagatgataaccaaacagataatgatttaggatcacaaaataactagattgctttccttgctagcaagtgatgtcaaactgacctggaaagttagatcccaaaacttctgcattttttgctcaaagcaagtgcaagtttcagtaatcatcattttcttttgctcattccatggaattatacttgcagcagaatcagtagtgcaacatttcccttctctaacttccagcaaacaaactaatggcagccaaggtggcatgacaaatagtctgagcttgtcaacatgttttcctttgaaggaaaagttcacagaaccaaattgcccagtactgctcagctccacaaccatcactcttgcaagaagtaagtgactccaacttaagtagcagttgccctttctttccatttcaacaaaagatagccccaaaagtaaatattcaggttcaccagcagcatagataccttccttgctagtggctgctataaggttgatcaaaaaggacaactcacttttcactccaacattgaatttcagcttattgctccacaaaatttacctccaatgaaaataatgttgtgggaaccaatcatccatccatattgatattttgcaaaggtggacctttccatcacctggatcccacactagtggcccaaacatgacatgtataatgttcagcgagtttaccaatgaaaattgcttgcccacaaagagttgaaaccatttcgcttcggttggagggggccaaggtggcagtatatgtactttacaacagctgcagttgaatgccagccatgacattaactgtgactccaatatgatcaactcttgatcccttgatgttatgggtggccatggatcaacctcaaagtgttgcaacagcagttgccatggaactaacaaatgtccttcaactgattccactaacactggggtgcttaagaaggacaaataagacacaacttgagagttgttagacccagaacatttcgctgaatacctggtgggcatcaatgtgtaatgcttgatgtcggcgatcatccttggtgagaaggcgctcaatgatgcaatggatgctggaacggtctcaagtacaaccgtcttggtcaggaacacgatgtcggctttgttggcgtcccacttgatatcgaagcccaacatcgaacacttggcgtgcgtctccttggaatagtcagtggtgggaattttggtggtgctggttgcaccattatcagctaccaacttcatggaggccatggcagtggcggcacatttgaccaccgcaaccacggtgagattgggctcgatgtcgggactagagcatttcgtcgaacatgtggtgggcgtcacctttgactgctctttcttaattgacgctggcaagtcttttgccttcttcccaacttccggtgtgcatgcttcaaccacatctatgagagaccgtatatcagctctagttctccgatcagcctcctctcgcctcagctcatactcctctattgtcacaccctgtagttctccaactaagcctaaaagtgaattaataagagaccctaagaaaataccggtgcaaagcaagagtaaaccctattaaatcaatgcaaacaataatcggaattggcatgtggaatttttcttgagttctacaagtcgaaattcactaacaggatttttagtggaattttgagagctctcgaaataattttaactatttaaaattgagcttgcaatattttaaatcccagggaaattcttttcctccttttcctcttcttgggccgtcggcccagtccaccccgccatgcgcgccctcctccttgtgggccgcccaagccgcccctccctctctccccgggacgccgacaggtgggccccacctgttggacccgtccccttcctccagccggcgccgccgcgcctgcaaccgccgccgcgcccacgcctccgccttctccgggccacgtcagccacgtccgcgcgtgcgccgcatctcccgcacccacttctcccctctcactcccatccgcgcccgcgccccgcgcccgagatggccgggattcgattttcgaatcccgcctctctctcctcccccactccccacgttggccggcgaaatcccgccccttccggccacatccggggctcccctcccctatttaggcttccccgtcaccccctctcgctttttccccatctcgccgaactccctcgtgctccccatcgctcccgcgccgtgcaaccacccgccaccgccgtttccgctactccggccgccgctagccgccgctagggtcgccgccgcgccgcgccgtcaccgccgtcgggttcgcgaggctaagctctaccccggccgctccttccccgtcgagtttcgtcgccggaattcgcaccccctcgcgctctggtgagttcaaccgctatcgccgccttcggccatgaatgccggtcgccgtggttcatctccctctctctaatctctctctcttccttccttagggcaccccgaaacccgtccgccggttgccgtcgtcctcccgtggcttgcagccgccgttcgccatcgtcttcctccgcgccggccaccctcggtgaggtttcctctcccatccattcccctccctctccttcctagccgccgcttagtgccgccgccttcgcgtcgcctttgcgccgtcgcctccgccgccggatgccgtcgccggcaacgcgttcgcgcgcgcacgccgtcgccatcaccgcggccggtaggccggccttgagccaagccgagccgggtcgtcgccgcccgtccgatcgaccccgagggcgatctaggccgtttagactagagattggactagggattgcttagccatgcttagttcaactagtgcacaatggggagaatcctattaatgtttagactgttggttctaatggtattgttggattagtgccaccgctttggtgttggttaattaaaagaaatcacatggtgggctgtgggtgcatggttttactggtcgcacccatggcagttaaggaccagttcgtgggatgccctggaagaacttatcgtacttaccacaagccagcatgggcaacggctgggcttgtaacgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacggaaacgtgtcgtggggctgtgtcttgtgggtacagttgtacacctctgatcagagtaaaactattcgaatagccgtgcccgcagttatgggcggtcaaccagattcaacgtgattagtctcaccctagtgtaatcttttgaatttggatagtttaggttgaggtttgggcctgttgcaatgtgggatagcgttggacagtggatagttaatattaattaattattacaactgtttaaatctttcaacttctgttttttttaatgctcgctttatgcaaacgaaccactttagctcttctttgataattccttgcatcatgcctctattccggtatgacttgctgagtatagtggatagtactcagtcttgctctatttttcccaaccccagagtacgagtatgtgtcagatggaggtttctctgaggagtaggcttcgtccgtgccgtcaaggatgcctgtggagtggtgttcccgctgcagttctagtcaaggcttagctcctgttgtctttctttctttccgctgcatttatgtgagacttttatgatgtttgtaagacgtggatctgaatgtcaacattgtcgtttgtgtaccccggccggtcctagacggggattttaatgcacattctgcttggaattctatttggaaatttctgggcgtgacaagttggtatcagagccaggttgaccgtaggacaagccaaatggaaaaacctaggagccctctgaatccttttcattgcatatgttctttgcaattggatttgttccgggaaaattgggatctgttcttgtggttcaaggggaaaaatcttggtcgctcgtttaagtgagatttgtcaaaacaagtcagtccagggttttagtaaaactattgagatttattcgtcagtcagttgggatttgatgggtgaaatgcattagatcctagctcgggaacatgggttgcaaggtatttatgctcttactgttattattagtatgtatctaatttccccaatattttatcgttatgtgagtctgtcttatttattcgctctcatgcaaaaggatctatgcataaaatttcgctcttattcgattctcttatttgagtcctttattgctttatttaaatttggatttgagcatgcattgatcctactcctttgtcttctctagatggccggccacccacccaaccaccgcggagaaggcatgattgactttgtggcagagttggcacgtatgacgctggtggtgggctaccccaacgcgccagagtacacgactgttccaccactcagtggcgagcttcctcaccgtgttcgcctggaggtccacggctacgtgggtacctgcctagctaatatggtggttgaggcatccggaggcacagcagatcacgcctgttaggaggcagcatacctgatgatggccagactacgggagcgccacaactacatcttccacgacacggcgtaccgatttcaccctcgtcgatttcaaagaagtttgtcgggatgcatgggttaaggaaagaagagcttagcacaccaatgagggttcataccccggaaaatagttcaacctcagtcagttttagcccttcagtgctaatagaaatccaaagatcaccatttctagccaacctcattcttctcgaatccaaagacctagatgtcattcttgggatggattggctaaccaagttcaagggaatcattgattgtgcgaatcgcacagtcaccttgaccaacaagaagggagaaacagtagtgtacaaatcaccagactcaccaaagcaaggggtctccttgaatcagattgaagcggaaatcccagtggtcaccgtggagaagaatttgaggaagttggaagatatccccatagtctgcgagtatccagaagtgttccccgaagacctcactaccgtgccacccaagagagagattgaattccggattgacttggcaccgggaaccgctccaatttacaagagaccgtacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaatcaagaacaaatatcctttgccgcgaatcgatgatttgtttgatcaactgaaaggagctaaagtgttttctaagatagacctgcgatcaggctaccaccagttgagaattcgggaagaggatattccaaagacggccttcaccactcggtacgggctatatgagtgcacggttatgtctttcggacttaccaacgcacctgcattcttcatgaatctgatgaacaaagtgttcatagaatttctggacaagtttgttgtggtattcatcgacgacatacttatctattcaaagtccgaagaagaacatgagcaacatctccgtctggtactcgagaagttgaaggaccaccagctatacgccaagttcagcaagtgtgacttctggttgacggaagtcaaatttctgggccatgtcattacagctcagggtgtggcagttgatccatcgaacgtagagtcagttaccaaatggaccccaccgaagaccgtgtcgcagattcgaagttttcttggacttgcaggttattaccgccgattcatcgaaaacttctccaggatcgcccgacccatgactcagttgcttaagaaagatgagaagtttaaatggacagccgagtgcgacaggggttttgaggagctcaaaaagaaattagtatccgcaccagttttgattctgcccggccagatgaaagacttccaagtctattgcgatgcatcccgccacggacttggatgtgtcctaatgcaagagggcagagtggttgcatatgcctcgtggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacataaatctccgacaacgaagatggttggaactaatcaaagactatgacatgagcattcactaccacccgggtaaagccaatgtggtggcagatgcattaagcaggaaaagttactgcactgccctatgcatcgagggcatgtgtgaggaattgcggcaggagtttgagcatctcaacgtgggaattgttgaacacgggttcgtagccgctctggaggcacggcctacgctcatggatcaagtaagggcagctgaagtaaatgattctgaaatagcagagctgaaaaagaacatgagagtcagaaatgcccgggatttccacgaagatgaacacggcacaatctggttgggagaaagattgtgtgtacctgacgacaaggaactgaaggatctgatactcaccgaggctcatcagacccagtactccattcatccgggcagcaccaaaatgtatcaagacctcaaagaaaagttttgatgggtcagcatgaggagagaaatagctgaattcgtcacactctgcgatgtttgtcaacgagtgaaggcagagcaccaaagaccagcaggtttacttcaacctcttcaaatcccggaatggaaatgggaggagattggaatggactttataacaggactgccccggacatcatcgggtcacgattcaatctgggtagtcgtggatcgactcactaaggttgttcacttcataccagtacataccacgtatacgggcaaaaggttggcggagctctacctctcgagaatcatgtgtctacatggagtacccaaaaagattgtatctgatcgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaaacttgccatatgcggaattctcgtacaacaacagctaccaggccagtctacagatggcaccgtttgaagctttatacggccggaagtgccgcacacctctctcttctgggatcagacaggcgagcgtcaactgttcgggatagaggtattaacggaagcagaagagaaagtcagaatcatcagggaaaggtttaggattgcccagtctcgacagaagagctacgcggataaccgccgaagggaactcacttttgaggcagggattacgtgtatcttcgtgtcactccgctccggggagtacaccgttttcagacgaaaggcaagttggcaccacgcttcgtgggaccctacaaaatcctggaacaaaggggagaagttgcttatcagttagaacttccatccaatatgatcggcatccatgacgtgttccacgtgtcccaattaaagaagtgcttaagggtacatgaagaacaggctgattcggaacacattgatatccaggaggatctaacctatgtggagaagccggttcatatacttgataccagcgaaagaagaactagaaacaaggtcaccaggttttgccgagttcagtggagtcaccattcagaagaggaagcaacctgggaaagggaagatgagttgaaagccgcccatccgcacctcttcgccagctcctccgaatctcggggccgagattccgtttaaggggggataggtttctcacaccctgaagttctcctcctaagcctaaaagtgaattaataagagaccctaagaaaataccggtgcaaagcaagagtaaaccctattaaagaaatgcaaacaataatcaaaattggcatgtggaatttttcttgagttctacatgtcgaaaatcactaataggatttcagtggaatttcagagctctcgatataatt

SEQ ID NO: 61580 - DNA, 10475 bp, Oryza sativa
tgtcgtttgtgtaccccggccggtcctggacggggattttaatgcacattctgcttggaattctattcgggaatttctgggcgtgacatctatccgcctcaacagcaagtccaatttgtcttctattgccatggcaccctacttgatgagaactttctcaactagaccaagagctagatgggggaaaccaggctggctctgataccagattgttaggaacccactacttccaactcaacaacaagcatccaccatagaagcaacaactgctttggggacaagagaagaagaagctatggaatacaagtgctggaaacttctagaaccgaggggggggggggaaggctggagattggaggagaggtagagtagagagatcgacgagggtgcccaccgaccgcccaagtcgccgccgccgccaggagcttcagctccgccaagtccaaatgatctttcgatgccccctagtgttgccgatggtgccgcttatatgctgctcccttccgtttgcttgggcctcttggcgatgggctgaccagcccgtgtgcggcccacccgggatcctgacatacattcattgtggattaggtgcaagaagaggccgtaagtcaagcaattcgattaagatgggggaagtaggaagatacagtaaacccattcatcatgagcagagatgaccatttcatggttattgagatcgtagagagtaatcaaattagttcactcagatcaaacacaaagacaacaggccgtgtaggatatggaaaaatggtgtgcccattaatctaatcattttatcgaaaggagtaacgaattaatttatactgcgaaactgttgtttcagaacaggtccatatcctgtcgtgtggtaacacaactggatggaatcataagatgaaaaggagcagcaagaccgtcttgccggaaattttctggtaatttctgaacttatttgtgcataaaatcctcgtccaggaatcagctgaggtacataaactgacaatttaatataccaatccatcataataatatcgttacatacttacaaaagaaaagaaaagctgcggcggaattacggtctagcgaaggttcggctccactcccacaggcagctcaattggggtataagccaaacgttttctccctctggatcattttaatttcttcaactgaggttgattgattattgcaagatgagtacgtggaatactccacaagccacacagcaaatatgtgagtgcacaaggattccgaaggatggcataatataggctcatttgcaaaagtagcatttagcaaacatttaggagtagtaaaacaatagagtaattaatcatcaatattaatcaacactgaacagcacaaccatgctgcacaggcccaaccatcctaaacaaccatacccagctgtacagatctaattccaaactaggagctaagcaaattattacctgctatagcatcaataattattatgagaggtgtgagactaataacgaaaaacattgctcaacccgcccataaccgcgggcacgactattcgaatagttttactctggccagagatgtaccactgtacccacaagacacagccccaaaacatgttaccatgccctcagtatcaccacggtacctcgaaacgggactgtgacaatacccctcatacaacacaatccaccacagcgcaccatacctggatcataatcaccccctcaataaccagaggcatggactccgcagcgatccccatggacttctcgctacttcacagtctggtgccccgcaacgaactatgctatacaaaaggtaaagctgttgcccacgctggcgtggaggtactggtccacggtgacggcgacattttggcgatcttcggcgaaggaaaaccggtggccgggcttcagcttggcgctgcgatgctgaggaagacgacggcgaaaaccgaccaccacggagtcatcgacggggctcgaccggaggtggagtagatcgggttcacgttgatgaggggattccaatgggtttcggcttcgggaagatggctgtcgggcttgctcttgaccttgcggagccgagggaggaagaagcaaagaccgaggacggccagggcgacggcgagatgtggctggagcggcggccggcggtagactgagaaggcgaacgcggcggcagcgctacaagcgatggtggagatagggagaggtggcggccgaaagaggagagggtggggactttatttataggcgtgggaaagagagatcggctcgggaacggatggattcgttgaaggaaaattagggtttgtttttgcagagataaactcaatccgagctcgattccatgtcgaattaaaagggataaagtctagggaaacggaagagaaccaattcaagaaacggctgagagaatcgagcgaatcaggcggaggaaacgacagcgtctcggcagctgcacgggctctatctggagctggaagacgacactgtagctggagggaaaacgtatagactttcagctgggcttcatcttccaaggcctgattaaagagggaagcaaatgcccggtttatgggagcttctcccagctgcagcttttcccaaaagctgcttctgttagaagctgcctcaaacagtccacagcttctgagaatctgtagttatagattctgaaaaatgaactaagaagccaaaagctggagaagatgggtttcagagcttttccacattctcagaagctggctaccaaacagctgcttctcagaatctaaagctcccccaaatagccccaaagcagacttcgacagagagaaagaggctgctggatcggctgggctgaaggggagagatgggccagattaagacctgagctttcgaaaggattttaattacttttccaactaaattaatcactgaaatgatatttgaattgttaaaaatacttcaaatactgaaatatgttcaagaaaaatctcgcaactacttggacacttagagtatttaacaaacttaagataagatcatttaatgactaatttaatatttaaataattcctaaaatgttctttgtattattaaaattagtaattgagctctaaaaaatccgagaaaatttcagagagtataattaaccatgtagaatttaataaaatttaatccatccatgctttatatttaggaaattttatttcccacatttaacttcacttgtttattaatgtacatttaatataaattttaataataatttattaaataatttataaatcctaatacgaaaataaggatgtgacaaagactgctagaagaaatcacaagaagaaagatagtgacttgactcctacaaatgaagggatgcatcttacacgcagtgtggagattatgggtagttgggtaccacatacccacatggcacgtatatccgactggttataggtaatagcttgtacagatagaatatgtttaggaaatgactcgggaattatgttaacttgtatgtcaaggaaatatccagtagtgccagttagttacagttgtaatacatattcgttagcctagtacgtaagccatatgggctgtacattgtaatcttggctcctccccctatataaggtcgggtccaagtgtacctaggggcataacttttctcccagatcatcagatcaataatacactcggtggaataattcccccgctgtataaacctttgcctcctacgtcctaacctatccacttttccagcttgattgctaccccttttagtattgccggaatcttgttttgacagttggcgcgtcaggtaggggttgcgccatgtttttcgccgactagtgcgatgggattcgtttcgggcatcaccgacttcgctttccctcccgggcagacgtgctggttcggcggcccatggacctcatcagccacccgtacatgcatgcaaagaagacatcgtacgacagatcaatccatgattataaatcaagctaataatactatatagattgtgaaagaagttcttctgtatatgtgcagaatgaaggatcccttaaagcaaattgtttttgattggttgcaagctttatagttttatttagttccttcgactgtaactttgtaaatattttttgagttatataaaattacactgctcggcaaagcgacggcgctcttcggcttgacgacggcgacgatgctccggcggtcttcgacggcaacgaaggagcggacaaggacggcgacgacttggcgatcacgacggcggtcttcccgagcgacggcgacggctgaaacgacggcggcgcacggctggagcggcggcggcgacggcgaagctagggcacacggcgctagagcgattccgacgacgagaggcgaaggcgaaggtggcgacgggtagaggagacaccgggggtccttttaaaggggctcggaggcggcggcaaaggcccacggcgacggcaacggcgaaggaaagctcgggcttgaaggaaagaggccgatccgaatcgaactcgattccacgaacttccaaaacgaattagccgatgattccaaaggagaaaaggtagaggagatcccggagattgtttcccctctaacaattcggccggagaaggaaaggaacggccggatttggaaaggaaacggcggcggcgcgaaactagggtttcggcggcggcggccgaaggtagacgacgactgacaggtgggccccacctgtcagcgagcgagggcgcgcgcgcgggcggcggactgggccggctgggccgaggagagagaagagaggttttgggccgactttcggcccaaagccaaaagaagactttttaaaacctttttcaatttaaattatttcttaaatgcaattccatttattaaaaatactttcttagctcaaataaaccccagaaaaatctaggaattatagaattaagcaaagtatttaacgaaattttatcttgccccattttatattggaatttatttattaaaattaaatcttcttttcaagacttttaaaattatttctaaaaaaattccatttaaacaacaatttatatattttgaattttcagggtgtgacattagtttatttataatcagtataatcttagtagttaaaccttctgggatttgcattgatgctggtataatgtctgattaccaggtcataagtctgctctggctaggccgagaactatgccccggggactcagatgctctacaccgattgcaaggctgtagagtaataagtagtaacttaagcatggggtttaggttatcacttatcattattttgggatatattcaccgggagagtagcaggccgctgatggtgacagcttaatacgtgcgtcttccccacagtttatatttctacgtacaatttccttgggtaggatacacctttgtatcctactttggtttgagggttatgacaggttgtcataagaaactcgtcaacccagggtaactttgcgatgcatcatatcgggagggcatagctgtcacgccctgaagtacccctcccttgctctaaattcataaaataaatcgttcgaagaaattgtttaatttaacctagagagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatccctgggaaaatcctttttcctttttatccttcctttttccccctcttttcctcctttgggccgccggcccatctctcccgacccctcccgaagtccaggtcgcctccccctcactccctcgggcgctgacaggtggggcccacctgtcagcaccttccccaacctccagccggagggacggcctccctcctccctaccgccccgcgctccctgccgccccgggccacgtcgcccactcccccgcgcgccccgcactccccgcgcccacgccccactcccgctcaccccgcgcccgcgagatggccgggattcaaatttgaatcccgcctctctctctctcctcctccacctcctccactactccggcgaaattgcgccattcccggccacgactcgccgcctcccctcctatttaagcacgcccgcaccttcctctctctttttcctttctcggccgagccctcccgagccctccatcactcccgcaccgctacacccgccgccgccgccttttccactcctccggtcgccgctcgccgccgctggagccgccgccgagccaatctgccgccgccattagcttcgccgccgccaaagctaccccggccgccgcatccccatccaatcccgccgtcgggacccgcttctccccgcgcgccggtgagtaccaccatggccgccgccttcgaccggcgaatccgctcgccgtagaccacccctctccctctaatcctttccattttgttccctaggaggccccggagatcgttcgcccgtcgccgtcatcctcccgtcgctcgtcgtcgtcgttcgccgtcgtctccactcgcgccggccaacctcggtgaaaaactccccctcctccgtctttccctctctcccgtgtgcgtcgccgtcctccgcgcgcgcaccgtcgtcttcggccgccgacgccgcttttcgcgccgtctgccgtcgccgtccgcgccgccggttgccgtcgccggtgaccgcgcgtgccgccgtcgctcgccatgcttggcctgccggctttgaagccaagccgagccaccagcggcgcccctcccgccttgtgccactgccagtggggcccacgtgccggcgcccctccctctctctcttgagccgccgctcggtggggcccgcttgccagccgcccctctctctccttgagtcactgacccgcgggtcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaattcataaaaatgtgtagaatccattaaaaatggttttgcttcctgtttcagtagtcttatagcatgttttgcttgtgtgctttgtttgtcgcgtagatttcggccgtttcgtcgattcgtggtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagctagcgtgggcaacggctgggcttgtagtgtagcttttctctagccgacgtacccaggcgagggtgggcgtgatggagttgggtcggccggggtgtccggttgatcggctgctggattcaccgcggcacgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacttctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccatagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaataattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgttcttttgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaatgttacgcgcaccatttttcatgcatctagtttatgcattaagctatagtttagtcagtcgcattagtgtctttatccgggttcatgaaaaatgttctatgcataaaaatcatcatgcttggctagttgtttgggccagttgttgcttggtttaaatttggatttgagcatgcattgattcctatcccttgtctaccttagaagtcagacatgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagcctttattaggagttgtgtgcctctttttcagtgttttaatcaagattaagataattgcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttctctgtatccagccacccactttctcaaacaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagtttcaggaaggcacagattcctgaagggattatggcacaacagaagagagagttccgtgcgctccaacaaggaaccatgtcagttacagagtacttgcatgagttcaaccgccttgcacgctatgctcctgaggacgtgcgcaccgatgctgagaagcaggagaagtttttatttgggctcgacgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcaggcacaacaacagtaagcagcacaaccacaactcgactccacccccactaatggcaccagctcagtcagatccgccagctgtgtcagttcagtcagaacaacccaagaagggggctgtaggaaagccaggaccctgcttcaactgtggcaagcacggccactttgctggcaagtgtccga

SEQ ID NO: 61581 - DNA, 8841 bp, Oryza sativa
atattgtttagtgattgcagtgacctgagtagcacctcaagctcccgagtttaaatataagaattggatttgtatcattaaactagcacataaatataagaggggtaatatagtcaattttaaaaaaattaacggtcaactcatgttcaattaacaaaatgggcataaaggagatcaaaatgaaaactcaagggtatataaaggatgaggcaaaattaaggggtacataagggattggacgaattctcaagcgtatatagaggattttctcattatttgaagtcaaaacagtacaactcatttggcattaagctcaacagcgatcattttgtttaggcttataacctcttataagcaaaaagtctaatcagaaataaacaattattttttgttttgctttttgaaatccgtaagctcattttacaatgttaaaggtcctctttattacacttataaaccagcctataagtcgatacgtctaaccataaacaaacaaacaagaagtttattcatttagctttttccaatccataagccactcttaaattattaagccgtggagaagccttttggtttatgtgaggtagatgtatgactctatccttaatcttagaactttaaattcatcggcttgttaattatataagcaaaaggctaacttaaaagtctaagccagtaaacctaagcataaacaaagatgccctaagcaaaatctaggtcgcgaggtacttttttttttcttgtttgaagtggatgtagaacttcaccattaaatttaattctttaaaaccaccaacttataaaacacaaaagaaaatatcggcttaacagtctaaaccaataagcctaagcctagataaagaggatcttaagcactatggttgtttttcaaggtttcttttgaaggtatcttcataatatatcttgcaagattgtggacgagtgatactcgtggaccggaagaatagggtattggggtacgttggaacagggatctgtgtagtacgacatcaaaatagacaaaagacaaggattatactggttcatgccccatatcaggtaatagccctaatatagtttatatgggaataatgacgatgagaacagattacaaagagagtaaccgaacaggcgatgccgatgagatcgtagtcgagggattcgatgaaatctcccggcgagttggctccgtagactttggcttcataaactctggtgggtgtgttggcgatgagatgcgatgccctttgcctctccctaggggtcccttttatatcgtgggataccttgaccctcaagtaagacttggagatatgtaaaccgacacgatatactagagattttaccctttccaagtaggacttctgcaattccttaacttcgtggagatattccttaacttgaggcgaattcctaacggcatatatggaaaccaaccgtatacgtatacgtgaaggtatatcttatcggtatattccatatgtcgtaggatagaggatatgctttatctgtaaccctgacaaagatattttcaaaaacttatttttaagaggaaactttatacggataaaatttctagacaaaatagttttgtaagactattttacctaagatatttttatgaattttgatgcacacacttgatttttttggccaaaaattaggattttttttagaaaaaaaggaattgctaaaaaatatcacaagttttctggataaaacaatttcaagtgtaactatagaataaatttgagtataactacatgtaattctgtcagggttaaggataaggtataccctctacccttggatgaacgctatacggcaatacggtatatcggcgcatatacggacgttctctgaacacgctaaggaaatccatcacgaagtctaccaatgcaaaggttcctacccgtataggactgggtcgttactatatcgtgcagggtttgatgtctccgagtcctacttggagaccacctgacctgcgatataaaagggaccccccgaggggacctaaggcatcgaatctcaaagcttacacaacgaccacagcctacgaagtcggagactacaagggccaagtcgccgggtgatctagtcgaatcaacttgactacgatctcgtcggtatcgccgagttctactattccctttgtaatcccatatcaactggattagggctattacctgctaaggggcctgaaccagtataatctttgtcttttgtttccttgatgtcgtattacgtagatcctcgtaccagcgtaccccaataccctctatatccggtctacaggtacccaccgtcgacagtggcgcgccaggtagggggacttggtgctcaaggttctattactatgacatcgagcttcgtcgacaacagcgtcaacaccggccccatccaaggaatccctgcttcgacaatgctgctgtggactcaagtcggcaaaatcgtcttcccggtttacaccacggtgccaatctcgggctggtccatcaatgaccggaaacgagaacgccgtggttgtaaacccagacgatcccatgtcgaagaattctcccgccgtggcggagaacggaacatcgacgtcatacgagcccgagaaggttcctagcgcggccaagccttgtccttccgacaagtactacgagccgacgaggacagcttccgaggtaaccaagtcctgttctcctatccacaagtccaggaagcacaacttgcaagcttgttgggtttttctcaacgtacaagctgaaatccgtgcttgcaaagaacgtggaatccagcgtacttctccaactcgtgatatctattgtcctattcacaagacgaagaatcacgacttctcaagctgcaagatctttctccgtgccatgaagacgacgcttccgaaggtccaacagtgaggaacctctctcaagggtacagacaaggaacaaggagcgacgttgacctcggatcgattcgttggagtaattgacatcgatccccgcgaaccattagtcctacacttgctcgaagactatggctcgtcatcttccagtacaccacgcgacgtgtttaccatcggtgggactagcatgtctgcacaggctaacgcagaggcggagaatcagacggccatgccagctcaacatctcggcactgtcaacgcaatattgagacaagctccctatgaccccgtgcttaacgatgatctcgcacgatggacggaacgactacgggaatcggtagccaatctcagtaacgcgttcgaggaagctgctaccagagcacaaccggagtgactgacagctggcggtgccgacggtgaaccaccggagcagcgaacattgcctgcacgagctacccgtccacctcgcggcaccggcgatctccacgatcatctgaacggccgccgagaagcacgacgcacgcgagacaacgagaatcgttcccgacatcgcgtgtcttcacgacgttgcgagaacaaggagcgaggaggtcgcttgaacgaggaccaacatcaccgtgatcgtcataaccaccgcgatcgcgataaccgcgagcagcggacaccggatgatgatggtcgggggcgttagcatgaaggtgatgataatggtgaccggcgccagaacaacaacggtggacggcgatagaattctcgagaacctgaatgtcgccctcggaatcgcacgctggagccgactaagccatcgtcgtcgtcgtcatcatcatcttcatcttcgtcatccgatagacgtccacggaggacacacgatcgccgacaacccactgcccccagcgctgggtgtagagctttcaaccgttctctacgtgatgtccgatggcccgagagattccgacccggagcaatagagaagtacgatggaagtactgaccctgaagaattcctctaggtctactccatggtactgtacactactggggcatacgacaacgcgttagcaaactatttgccaacagcgttgaaaggttctgcacgttcgtggttgatgcacctcccaccttactcgatctcttcatgggcagatttgtggcaacaattcatcacgaacttctagggaacttacaagcgccacgcgatcgaagacgatttacacgcgttaacacagaatcagggtgaatctttgagggactatgttcagcgctttaatgagtgcagaaatacgatccccgatatcaccgatgcttctctgatccgcgctttcaaaaccggcgtcagagatcgctatactacccaggagttggcaacaaggcgaatcactactactcgaaggttgttcgaggttgtcgatcgatgtgcccatggagacgatgcgctgagacgcaaaaacgacaaacccaaggcgggaggagagaagaagccagccaaagacacacccgaaccaagcaagaagaaaagcggcaagagtgggaagaggaaagctcaagcagtagtcctcgcatctgaatacgagcgcccgcccaaacacccagacccacaaggcaatgatacaaagagaatatggtgccccatacacaagtcggacagacattctctaaaggagtgcctcatcttcaaaaaatcgttggaaaggcagctggctttggagaagggcaagcgagtacgtgtagtcgagaaggcaactgaggcaaccactcaggactcggactccgcgtacccagattccgatcttcacgtctcacacatcttcagaggttccacaatgtactcttcaaagtgagaatacaaaaaagtggagcgtgaggtttgttcgacatggcaggggactgcatccaagatgaagtggtctgaacagaagatcgagttctcagatgaagaccaccccaaggctgctgttataccaggacgatatccgatcgtggtcgaacccactatttggaatgtcaaggtggcgcgagtcctcgtcgatggcggcaactccatcaatcttctcttcgctagcactttggacgcaatgggaattccacgaggcgagttgacacctaccgatcaacccttccatggaatcacccctcaatcttcatccaagccattgggcaagatcacgcttccgatgactttcagccaagcgagcaacttccgaacggaacagataacatttgatgttgctgagttcgacacagcatacaatgccatcatcggaaaaacggcactcgcgaagttcatggccgcatctcactacgcgtaccaggtactcaagatgcccgggccgaagggaacaatcactattcaaggaaacgcaaagctggcggtccaatgcgacaagcggagcctcgacatagtcgagcacactcccagcccacccgccacagacggccacccaagaaagtgatcaaaacgattaagacgccgaaaccagacggtgcaatcaaaatcgttccactctccagtgccaaccccgacaagacagtcaagatcggggcatcaatgaacgagaaataggaactcgcgcacatcaccttcctccgcaacaatgcagacgtattcgcttggcagccgtccgacatgccgggggtccccagggagatgattgagcacaaactcatcgtgcgacctgatgccaaaccagtaaagcaaaaactgcggagatttgcaccagatcgaaaacaggccatacgagaagagctcgataaacttcttaaggctggtttcatctgagaggtactccatccagagtggctaaccaacctagtcatggtgcggaaggccaacgggaagtggaggatgtgcgtcgacttcacggacctcaacaatgcatgccccaaggatcacttccctctacctcgaatagaccaactagtggactcagcagcaggttgcaagctgtcaagcttccttgacgcttgctccggctaccaccaaatcagcatggcaaaaaaggacgaggagaagacagcattcatcacgccgttcggtgtattctgctacgttaaaatgccgtttggactcataaccgcaggaaataccttccagcgtacggtccaaggggcacttagcgatcagctgggtaacaacgttgaggcctatgtcgatgacatcgttgtcaagaccaagacagacgactcattgattgacgatctacgggaaaccttcgacaatctcatacgatatcgcctcatgctcaaccctgagaagtgcacgttcggggtaccgtcgggcaaactgctcgggttcctcgtctctggcagaggaatagaagcaaatcccgagaagatcaaggcaatcgagaacatgaagtcgctcacaagactcaaggaagtatagaggctaaccggatgcatagcggccttaagtaggttcgtcgctaggatgggagaacgaggacagcctttcttcgcactgctaaaaaagcaagacaaatttgtatggacacaggaaaccggagaggctttcatcgcactcaagcgctacttgtcaaatccccctgtacttgttgctccccaacctaatgaagagttattcctctatatcgccgccacgccctactcagtgagtactgtcattgttgttgaaagagaaaaggtgcaaagaccagtctattacgtcagcgaagctctacacgacgtaaagacaaggtacccacagatccaaaaattgctctacgcagtaatcatgacgtcaagaaagctacgccactatttccaagcccacaggatcacagttgtctccgccttccctcttggcaaagtcgtgagaaacaaagatgttgtcggtcgcattgcgaaatgggtagtcgagctaagccagttcgacgtccactttgtaccacgaacagccatcaagtcccatgttctcgccgatttcgtagccgattggactatgcctgaaaacaggttagacagccagaccgacaacgaaacatgaacaatggcgttcgatggtgcgctcaacagccaaggagcaagtgaggggttcatcttgacatcaccttcgggagatcagttcaagcatgcaattcacctcaacttcagggcgactaacaacacagccgagtacgaaggactactcgctagaatgatagctgcagctgcacttggagtcaagtgactgatcgtgaaaggggattccgaactagtcgcaaaccaggtgcacaaagattacaaatgctctagccctgagctgtccaagtatctcgtagaagtcaggaagctggaaaaaagatttgatgagatcgaggtccgacacgtatatcgcaaggacaacatcgaaccggacgatctagcacggcgtgcgtccagacgagagccacttgaacccggcacttttctggacatcctgacaaaaccatcagtgaaagaggcaaacgacgaagatagcccagtcacccccgacatcagctcgggggctacagaggtagagcgcgctgttgccgacatcgagaccacggatgactggcagaccccactcattaaattcataagcagcgacgagttgcccaaggacgacggagaagccgagaaaataacccgtcaagcaaaatctactatatgatcggccacgatctatataaaaggcgccaaagggggtacttctaaaatgcgtctcgtccgacgacggcaaacacctcatcctcgacatccacgaaggagtctgtgggtcacatgccgccggttgcacattggtcggaaaagccttccgacaaggatttttttggccaaccgccctcaaagacgcttgcgacatggtacaacggtgtgaagcttgtcaatctcatagcaaacacacaaagctaccagcgcaagcactacaaaccatccctctcacttagccgttctcatgctgggcgctcgacatattcggtccattcctacgaggacagggcggctacaaattcctgttcatggcgatcgacaaatttaccaaatggatcgaggcaacacccacgggggaaatcaaggctgacaacgctatcaaattcattaaggggatattttgccgatatggattgcctcaccgcatcataacggataacggctcccagttcatcagcgccgatttccaagattgctgcgtcggactgggagtcaagatatgtttcgtctcggtttctcaccctcagagtaacggataggtcgagagggcaaacggtatagtactacaagggatcaagacctgtgtctacgataggctcatgtcacatgacaagaagtgggtcgaggaactcccctcggtactatgggccgtacgcaccacaccgacaacgtccaacaatgagacacccttcttcctcgtgtacggctcggaggccatgctccctaccgagttacgacatcaaagtacacgagtacagaagtactccgacgaggatcaggagcaacagcgaaacaacgacgtgaacctactcgaggaacatcgagaacgggttgccgtcagagcagctagctaccaactggcccttcatcgatatcacgagaagcgtatccgagtacgcatactttcgagcggtgactacgtcctccgacgagttcagagccaagctgggcgaaacaaactctcgcccaaatgggaaggaccgtacacgatcacacaagtcttgcggccaggcgcatttaaaattgcagacggcgatggtcgcgagttagcaaattcttggaacattgaccaattacataaattctatgtataagtcaatagtgtccacacttgtaagacatcttacaacttcaataaagtctgttttaaggcacagatttcaatcacagtgccccttcccgatgatcccttacccagacgacacctagcgttgaaacccatcctcatgtccctttatgccgttttgataaggcctccgaggaacctaagggaacttcggctggggacgtccagag

SEQ ID NO: 61582 - DNA, 14336 bp, Oryza sativa
  unsure (1)..(14336): unsure at all n locations
gtagcaccccttcacacaccgaacattaacaatattttacatttttttggtcattggtgatcgcaaagagcaatcgttacatccatgctgtattacattatacatagagatagtacatgttgtggataatccctggcccctcttgaaaatacgaacataccaaaattcactcaatttcaagacaaaatggacaggaaatttaacctggctacccttccatttgtcacccttctatgtcgtccaaatgtttaattttctttccccattatattttttttcttgatgatgatgatctccgtggtcgctcatgctgcatgcctacgtgacgtcatctcgccggcggatcagcacggctcgccgggccggcaggagagcgcgccggcgaagcgtgtgagcctcctgacgtaggagcctggcttgggcttaaccatgtcggagcccttcaccttcctgttgatggcgccgttggacgcctggaagtaggcgccgttcatgaacaggtctccgtccgagcgccacgcccagttcttccactcccactccggcgcatagtgcctcgtgatctgctccatcacagcatcgactgtttagacgatgacacggtctctaaaatatggtcgatggtttctttttttaatatcaacatggtctttagaatacgacggtattgattttcgtgtatcgacacgatctacgaaacatgagactagtaggtgttacttcctccgtttcagcttatttgttattctagcaaatttcccataaacaagtggaaaattacatcgttacctcattaattacttcctaattgtttcccaaagcttatttataaaccgttgtgcacggttgtattgataaaggttagagatggaaagtactctctaaaatattttgcattccggaaaacggttattactattttgataaggaatttcaatgctagctagaatgataagtaatctaaaacgaaaggagctaatagtaccagttggcggcgatgttgggaggggcgatgtatcggttgccctggctgaggatggtagggctcatgccgccgccgatggcgtacatgagccagtgcgtgtagtcgttgttgacgacgtggaagaacccccaccggcatcgcggcatccgctgcacgagcccacggccgaagtggttgaacgccacggtgatctgcatcaccttatcctgcgggtagggggtgataatggatcaagatccatggtttttttcttttcacaactttacctaagctctcatatatttttaggtcaaatacaaattaaattttagcacaccctattttgaactcagccctcaaatttcgcaaattttaaaagttggaccatttattagcaaccttaattacctgcgggtacgagtcgctggcgcaaaacagcatgacgtcgttgtggttggtaaagtgcttgttgagatgtcacccccgtcgagccctgcangacgtcgatgagcccgtcctcgcacatgaacatgaagacgtggtccacccacacgtcggtggcggcgaagagcgagatgccgtcgccgtcggcccgcgtgcgggggccgatgtgcgtcggcgagtcacggaccgcgccgccgtcgctgtgcttcacgtcgtggacgtggaggctggtgatgatcacgttgcgggcgaactggacggtgatcccggcgccgccgcgcgcgatgtgcacctgcgcgccgcggccgtcgatggtcttgtcgctggcgacgaggagctcctgcgtgaggcggatcaccatggacttggcgaaggtgatccacagcggcgccgcctgcatggcgccccaccggagcgtgccgtagcgcgggttggcggcgtcgccgtcgccggggtcggtgacgacgtagatcttgccgcggacgccgccggtggcgccgcggccgaagcccatggcgcaccgggcgagccgcttccggtcggtggcccagtccttgcggcagcgccagcaccggtcgatcgggttcgtcgccaggcacggccccttgtacttgctgttcttcccactcaactctcgccggagaacgccgcgctccgtcgatctacatcgtcaaacacatgggggtaatggattctaatatctcgaggaaattaaatatcccctcgtgcatgcacatttttcaatcaaattcaatgcgaatggctgaagaaaattctaaaaaataagttgacaatgtagagtacggtgccaaaaggatatttactggagggattaaaatagttttattgaacgcatgcgcttttgtcatgcaacgataatggcaatctaggattccatcccccgatttcaaacgtaagtttgaaagaaagctagttcaaaattcgaacaaaaacttaaacataatacgaattccgacaaaatttgaacgaaaattgtgtgaatggcatgcctgatgacagcgtggttgaactcgttggtgacattgaaggggtccggtttgtacacctcctccgccgccgcctccgccgccgccctgcgcttctcccaatgctcgtcgaactcgcctatgccggcgttcgacacagcggccgccgccgccaggaacacgccggcgacgaggaggaaggagccgggcttcctccactggagcctctggtcatccatggatatatatcttcctatatattattctctttgtctataactatatactatttgtcatgaaactttgtttctctttttttcttttcttgattgtttaaataaaaaaaaaacttaatagggttggattttttttggggaaaatgaaagaaccctattgctaacgtgcgtggattgaggaaggagagggttatatatggaggatgagatggtataattagagaagaggtgtgaggcgaggaaataggcaagaaaaagctctgggttttttttttgtgtgtgtttgtgtgatttaattattggtggtgaagaagcttgtaagaacttgtgtgccatcaagtgacattactttgtttttttattgtgtaatatttggcgctctattctttgtagggagagacagggcaaagggttagttcaaattaataattcctgttgatcattttttttagattaattgatttttattaattcagcctctgtatccacgaaggatatacacagccattttttttaggaatacacatattattgtattataaacacctctcaaacaaagattgaaaaggagataaacacctctcaaaggtctaattggattcaattcgtcctccagtatatcccgggattggacactgtcatcgacgtcgtcctatttctctgaagctgaaagataaagaccacccagatgaatcacaaattcgtcgaaaccgatgaaccaaattaaatgggaaaattcttcatctaagttcatacagaaaaaggacctgggtcttttcatcacgagctttgaaaagattgtagacctccgagtgatcataacacttggccatcagctggtacagctagctttgggattctaggcgaaaacggaattaaatcacaaactgataaacaaaatgcaaaaatttgaatttcttttatgttgatttggataatcggaggagatcgttgaataggcgaactgaccgtgctgcatcacaaccggtcgtgtacacaatcatttttgcagaatgtgggtgacgtacggtgtgtgacaatcagaaaaatctgacttttttttaaagatgcggacatccctctaaatattttttcaagaaattgtgagcgtgttggggattaaacatagaacctcggagttgaaactacacaccacttaccgctacactatcaaatgcatctcctactcttatcgtatcaatgtgcttggtagagccaaaacattggataggcatgtacatgaaatgtgctttcaaatcataaatttgacacgagtgttcgtatttatagctaattattctttcaatggtaggcgatgtacccgtcgacagcgatacgcccgtggtgacttcgttaatctcaagatatactgacccagtctttcggatgtcctcatatgagtagggtgtgcattcataaacggatgagtgtgcgtgtgttatgagcgtctacatttgtactgtgtttatagaaaaaactttggataggcataaacatgaaaggagcccccatgtgatatttacgtctcgcgtgggagcaacacaccctagcaaggattgcgtggtgccaccaggacatccgtttctatctctttttgcatctcttttctcaactcaacgtacacgcgtaagagttggttttaactttttttcgtccaaattgctgaaattgccaaataggacattacatgtccaatgagtccctccaaactccgttggcaaattgcaacttttgcaaatcaacctgtacatcgtacaccacctgtatatatagacagaagcgcacataggacagatagctagaaagaaagaaataaagcatatacttttaagcaaaaacaaatgtaaagagcatgtcaccttgtcgattctctatggtgatagggtccagggcaatgccatgtcatgctatcttatccctgtgctttgcacacagctttttcaccaaatccctgcaagaatcctcctataaatacccacccaattgatccatcaatttcccatcacaaaacacataaaactatatcatcatcttccatagctgtacacatcctatattttcattcatggcgatgacaccgcagctagcattttctcgcatgcctccagggtttcggttccagccgacggacgagcagcttgtcgtcgactacttgcagaggcgtaccgctgcgcagccatgcgttactcccgacatcaccgatatcgacgtttacaacgtcgacccgtggcagcttccaggtgctatatatatgcgcactttaatttgcatgagcctcactacatacggtgctctctactggtagtagaaatcaatctaaaccgttaatcttatttgaccgaatggttcagagatctatttatattatggtagtaaaatcgtggatgggtgttatcgtcagaaaaaaaaataggggtgaagggtatagtcgtcatttagcagtggctaaactcttttttctccttttttggctttttcgatgaaatatgagcgatgccagcgcaatagatgatcatagatcaatttagctgagaaaaaacataaatgacaaaataatttctaatcattgtattagtaaattactaatttaccttaataatactgatactagtagtataatactaccagtagagagcaccagagcgtcgatttgcatacgaggcagggcggaggcaggcctaggacaggtagggcttaagccctaggcttgttgcctccaaaatcatggttaaactctcttaaatcatcatttaaatttgggaaaagaaatgaataactaattaataacaccctacctttgtcctactcttagagtccgtcactgcatacgccgaagttctattgatagagcagaaaaaaattacaaaattataaccctgaaatgtcgaaaccaggaaaaaggaaaaaatatatattgattgtgaccctgatagatgcgatactaatgcaacatatattgactgtgtttgtagccatggcgatgtatggatcggatcatgaccggtacttcttcacgatggcggcccgagaggcgcaggccagacgaacgacaccgtcgggtttctggaagcccaccggcacaaagaagacgatcttcgtcgtcgccggtgggcatgaggtgcccaccgccgtcaagaggaggttcgtcttctacctcggccaccaccaaccatcgggcagcaacaacaacaacaaaacatcatggatcatgcatgagtaccgtctcatgaactctccaagagcggcagtgccgtcgtcttcttcggtgaatcgtcttcccactgatgatctcacgaaagagatggtgctgtgtaggatctccaacaaggacctgcctaaaccacccttcatccacaacagcttgttgcagttctcttcagtggggttgaatggtgatgggtataattacttgatccttgatcaccttgagcctccagcaatggagtatcctaatgttggcattggtaatgttgatgatgctgctgctggtactgatgatccgggtgaccttgatgaggagattgatgatagcatgcaaagaaaccatggtggctagaattaaccagtagcatcatgagtgaatggttttgcgggagatttgagttaaatatcagataataaaataataatacaaagaataaaaagaaaaacaaacctgtatagttagcaggttttgattcatttcgttgaactttgtgtgcttgttagctagcctatataccaaacatgccttggcgaggctttctatttgtatatagctttttttcttttttctattgtaaggttcgaactctattgagttgattgaataaacattatgcaatttatgtaacatattgtctataaagttctattggcatgcatattcatatatagttacagtcctttagttttaaattgaaatttcattttaaaagttcattatttgtcattgacaataatgacaaaatgctctagtatgttgtttccatttacaaatggaaagtccgtttggtttggctgttactgtaacaccccaggtaaccacgtacatagaatgccacaccaaaatacactcaaaaactaagtcctaaaattattagaaatttcggcagagtctcccttaaaaatacggacatcacgacaggcagttataagaaaggtcaataccgatataaaccacacaatccaaaccatcctagctccataaatcccacgtgaaaaataagaatcagaaccttaaatgacctttacaagttctatgcaaaacttatgctgagcaaaaattatagtctaaaactaatttcaattgtgtgcaataataatgtgtagtccaagggtgctactcccaccccatgccgatcgatgtcattaggtacctaaaaaccaaattaaacataagagtgagtaaagaatactcagcaagtacaatcttgaactagtaaaacatacgcatgatttatgcattaagaaaccaacatgaagggttggatttactttatttttaaaccaaagaagtcaaaagatagtagttccctcccgggcaggtgtgaatatcctcttagcattaccggtaagccgagcaagcgtgatcagcgcttcacaaggatcatgaataaagatccaaattgcactcccatagctacgcatggttcttgaataatgtaaacagaacattcggaataatgaaacatgaataacgtcatgaatttgaatatgggtcgaaacacgaataaatagcataacgtcatagccatacaatcagtaataacaagcaattgaataataattatgcaagtaaagccaaacaaaacaactcagttttgtccatcacataagtccgtcttgtacttactttaactcattcgatactccgactcaactcctccaacgttggaaccctccacacctgtggagcaaaactacgcataaaccactatattcaactaacgatggttacaagggatatttactaaaatcgaaacctagaacatataaaccttttaccgatttatattaaataacctatagctgttccattactgttttatgagtaactcacaaaccgtctaacggaaactagcaaataatacaacttcggacatctagacaaaattgtctacaactttcatgttgagcacaaaatcagattatgcctctgaaaatcccagattaaggaaaaacgaactgctgtcctgatttccggacccggtcagcagtactgtttttgctgtttctcctaaaccgtttatcggaatcgagtgaaactagcaccgttggaaagatattgacaatgactacaaactttatttaggacaactaacctgattcctgatggtttaataccagatttgaaaatacggtttcagcctagcgttcgatataaaataaattcgaaaaaaccggaaacagatcgtcttgaatataaattagaaacaactatagactaaaacggattacctagcagtactaatgtataagaaaaacgaagaatttggaaatattcaccaaattccccaaatttcccttcttctatcaaatttccccttctttccctccttcctgttcttttctgccttctctccctccttcctgttcgttgcaggccaacagcagcagcagcagaaacgaatatcggcagcaacagcaagccgtgcaccaccagcaaggaagagatcagatcggcaacagcagggttcggcagcagcagggaaattaacagaaacaacagtagctcacaaacgaccggctgcggacgacgacggctgtggcgaccggcgacggctgcaccagcggcggcaccggcgaagagaggaacagcagcggcggcggcagagtgcaggaggtgcggcggctagggctacaggagaatcgctcctgtttcttttttttcgtttgttttttttggttggttatataaagagactaaataagatctaacggctcacatctattcaatcctcgggacttcgttcggactccgattactataaatttatagtctattttgcactactcggcgagctctacgcatccacggttcccgatcgcctatacgaacaatggtttaaaagttgaacttttgcgcgtttgctctaatattccgcgagatatattaatttaaaactcggggtattacattcttccccccttcgatcgaattcgccctcgaattcgcccaatcatactctagaacacgggatattacattcctccctccttcaatcgaattcgccctcgaattcgtccagttatacctcggacaagtatagaaaggaactcataggtaggacttatataactcaccagacgtgaataactctggatacttctcccgcatctgtgactcaagttcccatgtggcctctcgctcggtctggtgcgtccagagaaccttgacatacttgatagttctatgcctgagcaccctctcagattcctccaatattcttacaggatgagactcaaatgtcaaatcttgctcaatggtcatcggctctacggtaatatgatgttcagggtctctcaaatattttctcaacatggaaatatggaatacataatgtacacctttcatggactctggtaactcaaggcgatacgctaggattccaactctttccactatcgagaatggaccaatatacctagggctgagtttgcctttcgttccaaatctcacaacacctttggttggagatacctttagaagtacttgatcgcccacttcaaactctaattctcgtcttctgacatcggcgtagctcttctgcctactttgagctgcaagcatgtgttgtcgtatttctgctatccgttctgtggtctgttgtacccaaccgggtcctaaaatagctctctcccctatggaatcccaacacaatggggatcgacactttcttccataaagtgcctcatatggtgccatttgaatgctagcatggaaactattgttgtaagaaaattctacaagcggcaaatgatcctcccaactgcctttccatgaaaggatacatgatctcaacatatcctctaaagtttgaatagtccgctcagattgaccatcagtctgagggtgaaaagccgtactgaatttcaattgagtatcaaatgcctcttgcacagattcccagaacttagaagaaaacttagcatccctatcagaaacaatcgagcgaggcacaccatgtaacctcactacctcgcgtgtatagatcggtgccaagtcactcgcagaataagtggtgcggatagaaatgaaatgtgccaccttactcagacgatctacaaccacccagatggcgtcctttcctcgtggagttcgaggtagcccaaccacgaaatccatagcaatatcatcccaaggccatacaggaacttccaatgattgcaactttccagcaggactcttatgttcagcctttactcgctgacataccccacatgacgccacgtacttggccacatccactttcatcctcttccaccaatagatcttcttcagatcatgatacatcttgttctccccaggatgcacagtatatggtgttcggtgtgcttctcgcaaaatctcttccttgactttagctttttgtggaacacataaacgcccatggaatcgcacagctcccgaggaatccaaagtgaaatctccagtttttccttcctttacacgtttcttaacttgttgcagcaaccgatcgtgttgttgggcctctagcactcgttggggtatggcggactcaagaatgactcgtgactcggtacttgccactccaacataacaataggagatatccatccgttcaaaatcagttatcaaacaactcatagttggaggaacgaccttacggcttagagcatctgcaaccacattcgccttacccggtgtgtattgaacgttaagatcatagtctttaatcaactctagccacctcctctgccttaagttcaaatccttctgagtgaagatatatttcagactcttatgatcagtgaaaatatcacaagattctccatacaggtagtgcctccaaattttgagagcaaagaccactgctgcaagctcaagatcatgagtggggtaattctgctcatgcttctttaactgcctagatgcataagctataacattgccctcttgcataagaacacaaccaaggcctactcgtgaagcatcggaatagacagtgaaacgtttaccaggttggggcaaagtaagcaccggagcagttactagcctctgcttcaattgttggaaactacactcgcattggtccgtccactgaaacttcacatccttatgtgtgagcatcgtcataggtttagtgataatcgagaaatccttcacaaagcgtcggtagtaccccgccatacccaaaaaactcctcacatccttaacattagtcggcctttcccatccgacaacacttaaaactttgcttggatcaaccgagatatcttgctgattaattacatgccctaggaaagccacttcaggaagccagaactcacacttcttcagtttagcatagaacttgttttctcgtagggtctctagtaccatcctcagatgacgctcatgctcctctacatctttggagtaaatcagaatatcatcaataaacaccaccacgaaattatctagaaaactatgcaacatgctattcatcgcctccataaaataggccggagcattggtcagcccaaaggacattactctatactcataatgcccatacctcgtggaaaatgcagtcttctcaatatcctcttctcgcactcgaatttggttataaccagattgcaagtcaattttagagaacaccttcgctccctttaactgatcaaacaaatcttcactacgaggcaatgggtacttgttcttgattgtcgcagcatttaaggcccgatagtccacacacatacgccaacttccatccttcttctcagtaaaaataacaggtgcgccccatggcgacacactccgtcggattaacttcttagataatagatcatctaattgtttcttcaactcttcttggaaaggacgagctaaccggtacggggctctggagataggttgtgttccaggaacaagatcaatacggaactctacatcacgctcaggtggcatccctggcaattctgcgggaaaaacatcaggataatctcgcactacaggaacatcttcaatcactaaaggcttggatgacttctcggctaaggcccataataaccccgtctttacagcacgctgcccaggaaataaccttgacatcacgaaaagagaatgcggaggcgcgctcccttggaaaaccatctcctcgcctgatggagcttccaaggtaatagtcttccagaaacaagagattacagcatgatatcggttcaaccaatccatgcccaagatcacatcaaagagcggtaagggaatcacaattagatttgccacaaattcctccccatcaatagagattgcacaacctggacatactactgaactagagattataccccctggagagctgacttggacagatcgagagacctcttgactaaatagattagctcttttcgcaaactcgattgaaacaaagcaaaatgtagcaccagaatcaaacagaactagggcatcatgcgaatcaactgaaagtgtacctgtaacgacatccgggcgaccaagggatgaagctacaggcatgttgtagactccagccatagctggggtagtagaggctgagacctgctggtgaggtggagctgaagcagaaggatgcgccataggcggtgcaggcaactggagtggagcacgtggagcaaaagattgaggcatgggccaatactgtcctggtaatggtggtggtgggtaattatgtgtgaactgctggtaaggaagtggataagttgtcatcatctgaacggcaccacggggagtactagtggatgaacctgaacctcgaggatagctagctgtcgaagaggttgctgaataggagctcggcttttgccacttgatgatagaatttgggttacgcttacataccaactccatgtgtccagctttgccacacccacgacatgccccagtaaacccacactctgctgaatggtgattctttccacacttaaagcaaattagtccttgccctggcacagggcgaatcaactgagactccgttggacgtgaagctgcattaggctgagaaccccactgcctaggtttagatgatggttgagtgacctgattttgtttgtacttcttgaaatgtggtcgctgcgagttctcacccccttcctaatgagctctcttctgctcattaccagtgacattaccagaacgattcttctgcgcagtagtaatttggagctcaacctccatccctcgagcctcctcaactgcattgaggtatatggtaggcaggtttcttcccatcacttctctataccgagcattgagccctcgaaagaacttcctagccttctcacgctcatcacttgccacgctaggcacaaagcgtacaatactgctgaactcccgttcatactcatcaacggtcttgcttccctgttggatattgtttaactcatcactcatcttgtccctaaatgattatggataatacttagctctgaactgctgaagaaaaacttcccaagtaatagcaccacgatcagggttccacgcttcaacaactccatcccaccaaatgtccgcctgaccagtcaactaaaaaggcatgaaagtaaccttctcctcaggagtcattctagatcccctcatatacttctccatcttgcgtaaccagtctgcagcattaacgggagtaccagacccatcaaatgtgtctaagcgcatggatgtccatctagtgagtgtcatcccctgagcagctcgaggagcatcatcagagacagcagctgagtggctaccaccctcctcctcttccatgtgctcatcctccatctggttcgaggatgctgcctcattatggcgacctctaccacgacctcttccacggcctccagcacggcccctaccacgacctccacgattaggaataggggattcagcaaccgagttgttcccaacctcttcattatcctgagtattttcaacttcttcattatggtggcccctaccacgacctctacctccgcctctcccgcggcctctgttagccaaccgaacactcactctaggtggcatagctatatcaaacacaagcatttatacgtcattagtttaacaataggttagacaatggcatgcaaggaaacacaatcatacacatatatatgcagcagaaacataaatgctaggaatgacccatgctcccattcctattgtgcaccagtgtgtcaagttcttttagatgtttatatataacccaagttctactcttattatttcctaccctaagagaaagtattttttttaattggttaggaactctagttcaaaattttatgttgatttatatatctcattacccagtcacttcccatggacctaccgcccgctctgataccaactgtaacaccccaggtaaccacgtacatagaatgccacaccaaaatacactcaaaaactaagtcctaaaattattagaaatttcggcagagtcacccctaaaaatacggacatcacgacaggcagttataagaaaggtcaataccgatataaaccacacaatccaaaccatcctagctccacaaatcccatgt

SEQ ID NO: 61583 - DNA, 21234 bp, Oryza sativa
cggctgggggctaggatcagtgcttattcaactaaggcaagtcgaaggtccaagagccttatcttccgagaggagctctccgacgacaaggctgggggctaggaagagtgtataactcaagtgactgatcgaagtcgcgaagtgagaagacacttgagcacaccgcatccagagtaagaaagcttagttagatagatttcccttctatttcacaagcatttcttacagattgcaaataattccaaaatatattacatttttcttaagatgtttgtcacagatatacaagcactaccaggaaggccaacgccagtccattgaccgaaagattttctccgctagcggagccatcgactttgctaggttgtctatctccgcaggactcctccgagaacgggaaaacccttcgtgaaggaactcgaggtgcaactgtggatgatgatctcgtatacacgccagcacgtgccctccggcgtatcggctcgatcaacgacactcctcctgtttcagggcctcgtcgatacgcccgccgatgccttcaagctgagcacaagccccgttcagccacgagatgtagccagccgctgactcctcgggatccccgcgaggtacttggagctctctacagacaattctatgacatcttcactctcacattcactaattctattggatgcatgcattatatttattaagataacccaaactacaagataataataattatttcttggtctttggatcaagggtggttgtgccttatattttggaatggatggagtatatgattatactccgatgtaaatatagtttttcttgtttttgttgtaatagattgtgttaatgttgcatatggtgtagtctgtaaagtttctataagcattttctgatatttcactattattatttggaaatggtacacatgttttataatgttttgtttagttttttatgtttcaatgctttttgaaacatcttgatgtttcatgcgtaatatactaatgcttcaataaaattatatatttgcaaatatattttatgtttcaattttctagctagttggaactcaatgtttcatatagtggtttttggtgttgcggttagtattatttttgaatgttgtatatctctaaaacatttcacgaagtgaattgaaacatttgaccaaatgatgaaacaatttttaatattattttttattaaaatataattgtgcaagatcttattgtaattatttaattgtaatgaatacaatgatataatcggaatatagattaggtaagtggtttagcataaaaagtggcttgaaacttactactaaaaaattagttttattaaaaaggagatagatgaacaacttttgggggcatgtagtgaagccaagtacagcagcacacctaggggaaggtggggccgatacaagcagcaatccagtactaaatagatcaaggagccgcgtagtagtgataaggtacccgatttttggagaaaaatagggcgtccgatccgtattctcctcgacaaaatggtgatggggcaaggagcggcgtcttcaaatgatgctcaaatcttagtttttttaggactctcagaaaagaaattccacaagtttttcctagaaaacttttaaatgtaactaaagtataataattgtagtttaactatttataactacatctttttatgtaacttatatacaagtattaaagatcttctgtcctataaaaaaaccaaatctaaagatgattctggacataatttaattatactatagaatttgtcaacggtgggtacccgtagaccggatatagagggtattggggtacgctggtacgaggatctacgtaatacgatatcaaggaaacaaaagacaaagattatactggttcagtccccttagcaggtaattgccctaatctagttaatatgggattatatggaaagaaccacagattacaaagggaatagtagaactcggcggtaccgacgagatcgtagtcaagttgattcgactagatcactcggcgacttggcccctgtagtcttcgacttcgtaggctgtggtcattgtgtaagctctgagattggatgccttaggtcccctcggggggtccttttatatcgcaggtcaggcggtctccaagtaggacttggagacatcggaccctgcacgatatagtaatgacccagtcctatacgggtaggaaccttcccattggtagacttcgtgatggatttccttagcgtgttcagagaacgtccttatatgcgccgatataccatattgccgtatagcgtacatccaagggtagagggtataccttatccgtaaccctgacagtgagcccccgacttcttcttaaatgaactcgtgtaaccaatcgcaacttctgatgtcaaagttgttgtcgttctcgactggtcgatctcggtgtgaggaccgtagagacaaagagtgatcgacaaccccatgcgaagtccaacggttatgagtgaatttaaattgaagtccaagaaaccgcttcgcgcaatggacccagaaatttccggcggccatttctctcctttccttggaattcgcaccgtcggtagtgcgcctatttaagggagttttgggaatccattttggggtccggctgttgtgagaactttcttgcctccaaatgctcttcgtcttctccgtttccacacaaaccctaagttcgtctgcctcagcttcttctccggcgatctccaacggcgatggacctcgacaagtccacctccagcaacgcgtccttgaagaaactgcagaaggagggcactctccccggtcacgggaccatggagagggaaccgggaggtactgaacctgaacccgtcctaggccgcatggttgcgattgaggactacattctctgtggttttcttcctccgccttccgagtttttccttctcgtcttgaacttctacggtctttctctgcttcatctgaactccaactccatagccttcctcagcattttttctcatctctgtgaggcctacattggggtagagccgtttcttgaccttttccgcttttactacaagttgcgctggatggaacccaaaaaggtatccgggtgtgtcggtttctgacttcgggatggactgaagtcgcgatacattcctttccagtgcccctcgtctcgtagcaaatggcgggggaggtggttctatcttcagatagaagattcggatccaatcttcattgttcatgaggagcaaccagacaagattccatcttagaccgccaaacccgccttgaccccatccctccaatctttcatcgatattattgatgacctccgagtacgagggttgtcggggtatgaagtcgctgccgactttgttggtagacggacccagtcgctccagactcgagcccatccagcctttgactactctgggccggaggacgcgacccgagtttctactcggggtatttttcttgtattttgggtttctctccttttaagtgcattcctcctgacttgtcgaaacttggttctcgatctgcaggtctgagcagcgcaaccgtggagcaccgtgttgcccaggtgatgattagcggtcccacgatggcagcaacgtccccacccctctttgcgagagggaggcggctgagcgtgaagccgcgatcaatgtgagtgtagtcgatggtcctttacccttcaattccttgatcgtatcgtgacttcatgttgtgcaggctctccccctgactgacatcatcgggccactcgtggaccaccagacggcggcctcgttgaaggagggcgttgcccaggaggcgtccgacgcagccgttgccgctgctgctgccacaaccagtggcggcaaggttccgaagaaggggaggaagttttcctccgtgcttggcaaccgccggaagacgcccgctccatcggtaagcttcctaggttattgatttacatagtcggagaatgtcgccctcatgtcgtactcggtttacttaggcctcggatgcgtctcgcccgcctctgcgacggcagaggctggtgacgctcggcaagaagtaagtggacgaaatttgaggctcttgacttgatcggattttatcgtcttgttgcgatgaccgacatggtcgtctttcgtagggcgcaggcgaaggcggcgcaagatgggtctggagcaaactccagcgcgtctcctgcagtggcctcgaccgaggtcgtggtcatgcctaggagccgcgaggtgacacccaacggcgcagccagcgacctcgcggctggtcggggtccgccagctgccgtcctcacttgggaggagctccaggtcgagatggggtgcatcctcgaggctggtgctcgcggcattagtcgcgagatcgcggaggcgagggcggcggcggcgtcgtcggcgaatgagcgcgccgactagctgacgtgtgatctggcggaggttcgcgaggacctccagaagatgagggagctagtggccggcaacaagcgacaacggcaggggctcgagcaccgtatgtcggacgtcaagaacaacctgtcaaaaatccgtggctcactgcaggtcacctacactggtctgcaccagctcgtcggggagtgcggtgtcacgaccaccatatcggcgaatcccgacgagttctcgctaatgacctcgcttgcggaactggcgacagtgatggaggcgatcccctccaagcacgcgggcaggatcagagaggagacatccaacgggatctataccggggcgtgccacgtccttgcatgtgtgaggctggcgcaccctgaactcgatctccataagatcttagatcagggggcggctagcgacgcgcgcaaggatgtgatggaagaagtcggcgatctaggggagtccgtcctcccgctttttgaagagtagggccgccgcttgtctgtacctcttaaccaatcacgctttgtaaaacttttcgttggttccgactgcttttgtgtgtgcaatcgtcaccttagttttctttggcgttttgattccgggtactttgtttgttgtttgtagagatgccgatgtcgaggatgtccagtagcgcgggcagcctgaattgcctatagtcgttccggcacttgagcttgagccgtatgtgccgctggacagcgtagaccaggatcttcccggggagatggacgtggcgacgactcctttaggttggttcttgtcgtttccatttcctttgcctcttctgtctcgattagcttgacttagatatttgcatgtcaagcagacctcgaaagtgcgcttgctgatcgcgaccatcgcatccagtactggaagacgaagttcgatgtcgccgaacttgagaggactatattggaagtgaagagggaccgggccgtggaggcgctccgaggtcgcgaggtatggttcaactcgtacctcaggagctgctgtgtgaccatggccgttgtctgcagagagctccgaacaacaaaaacaagaaaaactatatttacatcgaagtataatcatatactccatccattccaaaatataaggcacaaccacctttgatccaaagaccaagaaataattattatcatcttgtagtttgggttatcttaataaatataatgcatgcatccaatagaattagtgaatgtgagagtgaagatgtcatagttaattgcatgtatgactttatattatgaaacatctaaaaaaagtggttgtgccttatattatggaatggagggagtaagatcttgttgtgaagaattaattacaataaacacaatagtcattgtgtaatcgaattgtagatcggatatatagtataggagaaaaagtctaaaaatttgcgaaatcttttatgcatgcatgtattgtggtagtcaaaggagacaggtgcaacatggtactaatgtgcatgcagagctgctaacttacagtgctatgtatgcatggagagagaaatagggaggtaccgctgaggttatcaatatcgggatcctaggtaatatcgttttgctcaatgtagtattgtatcgtagtatcgagatactatgagattttttcttttaagtttaattaatatttgtattaattacatatagccattctatataaaaaatatagtaataatatatgccatgcaaatagagatatttatcaagagaaaccacatattcaactgatttttatgtaaacttgagcataattagatggtttaaaaataatgtaaatagtagctaagattatttacattatttacaatcttaaggattgttgaatcgatacaatagctaagattttgtaagatcgtgtggtaataaataatagaatcgagatattatgaaagttaagatattagatggtgtcagtatcgctttgactagtagaattgtagtatggatacggatcgggagacaacctcgatttttcatatagaataatttaatcgggtacctgggggaggattgtagtcggagaaaggccatttctgacatcctctcatcatttgggcccccctcgcatttcgggcaacaaaacggccttcctgacctcgatcagtttgggcccccatctcagccagccagacagcccatgagtacattctagagacacggcggaaggacgacgacgtcagtttcttacccatctactatggcctatttaaccctgcgcccaatccaccctcatctcggtctcctcttcctagtactagctgcgcccccccccccccccaaccccctcgggcgcccgcttcgctccggcgactccacccggccgcgccgccgggatccgcccccccgcaggccgcccctcgtcgtcgtcctcgctggttccccgccggccccggcgccttttccttctgatccagccagccgcgtcgcgcgcggcgccggggggcatcgaattcgaatccgcgccctcgccgtcgtcgtcgccgccgccgccgccggacaatccggcgcctgccccctccgtgctccccccggccagaggtgagacccccccctctcctaatccgggttgtggcggctccgcgggttgctttcgcctcacgcgggtgtcccagattcgcgtcgctgtacctgtcgaaaccctagatgggttggtggggggagcctgctgctttgcattcggagcggggatttccagtggaggggtctgttgcagcgggaattttggtcgattgttgcgttgttcggtgtatatttggttccgatcggggtgcttaattggttcgaggttgaacgcgccgtggagaattctcgacgagttcttgaactgaccaagttgttggctttgattcagggattgcgggactgatacggccgggatcttgctggaaatggggggttacgagtacgcgaccaatgtaagatctgttcttttgcacgatatatcctgttcagttccattttggatgcgattcttataaacagtaggaatcaaactttgctgaatactacgtttataatcatgagtatagtacctaaatcctttgaaagaacaataggaacttgagtcatttcaatgtgaaagcgcttctatttcccatgctgatgacgatcgatcatcttgaagggttatcatcggggaatggaggatgactatgaagacgagtactacagtgaagatccatatgatgaggaaggggagggtgctggtcaagagtatgccgaggaggatgacgagccgccggagggacagcaagagttccttcaaattagagaacgattaaaggagcagattaggcgaaaggcgcaggctgctagtgctagcgctgctggccgctcatcttcctcacatgatagaaaacctcaatccacgtaagtgttaagtatgtctcttctacattttgattgttatgcaattttgtctctaggatcaataaacctctgttaaactttctcaagcatcatatttgattttctccaggaacttgaataatgctgaaatttttagttgattgaaaaaaggtagtcaatgtatggctcctttatctacgtcccatcacaatctttagcatgttaagtttagttcatcaaaacttgctgagtatttttcatttgttggttacattgtttattactattgctttggagcctgagagttatcagttaatacattccccggtacatcctttttgaaatgttgtatttgaaattggattgtttcatcatagttgttttttaatgcgaacgtgtcgaatcaattttcgtttggattcctgcaggaaacaaaccgtagatgcatttgggtgggggtgttatttttaaatactacaccacacttgtatacattatgctattgctctactctgcatactttgtattttctgatatgtgaggtcaaatatcttttatgttttctccaagacctttgttatagttatgttatttgtgtagttttggatccttctttgggccatccaagccggtgatttcccagcgggtaattgaagaaagaaaatcactgaaagaactacagaacacagcgtcaatgtccagggatcgaaggccttctgcagtatgtagccctacatctgaccctaattatctttgattcaacttttgtaataattgtgtttaactatgtgtagaaggagataccatcatcatctaaagtgcaatctaaaacaaatggacatcaccacaaacagaagattgtaaatgaggtacaatgaacttctctttcattggatcatttttatgtttgctatgttaaaacttgagttgtgtcataaaatagcagctggaatttgcaggcaaaaagaaaggctgaggcacttaaggataatcgagactattcatttctactgtcagatgatgctgacatttcaccttctccaatggagaaacctgtggctaggtcctccttgagtcagaagtctggtgagtgaattgcgatttcactgaacttgttctttaatttttagtgaagtaatgctaatagttggttcgttgacatcgaagatcgcgagtcgacacattcagctgtgaagagcagagcaccgacaggccaaactgctagattgtctaatggatatggattgaagaacacattgtccagtcagaggcatactgaaggtagggtagattccaacagaaaggtggctggtgcaaacagagaaagggttgtcttgcctgacaatggaagaatgcatagtgtggttagaaatggatccacccaggctactacaagcaaagctgcaagtcaaaagcttcctagcaaggctcctattgccaacaggcctcctataaagagtgtaagtgatcaatctcttagggcaaatcattcagcttcaaagcaacttttgtcacagaatgggagaccacaatcctcacagagtcagaggatgcagtcgacctcgcatggtcagaggccacatcaacctgtgcaaagtcagtggccgctgcagtcattgcagggccgaaggccacagcagtcaccacaaaatacaaggccacaactgatgtcgaagagtcagagaccgcagcaatcattacagagacagagaccacagctatcctcacaaaatgagagattggaatcctcggagaggcaaaggccaccttcacaaagctacaggccacagtcgtcgcaagggcagaggcctagttcagtacaaggccgccagtactccgagcaaagaagaatccaggcaaatgatagagtaaagtcggcagaaaggcagataaggcctccctcgaaacccatggtaatacttctgcgaagcaaatttgtcagcttttcctttgttgtcatgtttcacatgcatttgggcaattatttaggatcatatgtttctctgaagcttatttcttcgctatcatgttcctgtagccatcacgacaaataccttccaacggaatgcgtgatgcccatgcaaagaaaaagcaaccgatgaaacgaagatttaatgatcttagcgaagatgaggaagatccgttggcaatgatcaggagcatgtttaggtatgtcagtttatgaatttcttgtatgtggtcctttctgcacaagctgggctagtcttatatactttgttggctagtgttttagttgttattgagtgtctacaaagagttggaatgatactctgaacagggaccttgcactagttatgctaagcattgttttctgatttcaagatctgctgaaaagatagatcaggcttgccattatgcatttcagtttggtgatttcttgaaatcaagtccatttgctttaaattttatggcatgcgaatgagctaattttggactatgcttccatactattttttgttttgaaggacactatatgaaaactttggttgtcctgtgcaggtatgatcctagtaaatatgcaggcagagatgacgatgatagcgacatggaagcagattttgctactatagaaatggaagagcaaagaaggtatgtactcccttattgctttctaacacaataccttcttttcatttagaacattataatctgttaaactatggtaagtgaagaaaaatagggatcattaaggattatcttatattctgcctcagtgaggaacataatggaaaaagaatgcttattttcgctataatattgtactatcacatgctaatttatgcatgattttgcgctgcatatgcacttgatcaagatgcatttgacatcatgattgagtatcatttccagaaacttgaactgcaggactgctgtacattcaaattcacttgtcatatggatattttgcttttaatctcttaacttattagctttttttttgttacctcttagcgcgagaattgcaaaggaggaggatgacgagcaacttcgcctgattgaggaggaagaaagacgtgagcaggagaggaagaggcgaaagatggcgcgtggccgatagtagcagctaagttgtacaaatgcttgagttacagcttgagcaaggcttgaactgcaattccacggtcgtacgggccatggtgcttgcagatgatagcacgctttacccccatttatttgccgtgcgatttctcaagagatctatcaagaaaaaaacggcagggatcaagcaaaacggcaggagaacgatgctccaacgtaatgtgaagtggtgtagcttgtgctgaaactgttagctgtgccaactacagatctttttgatgctgacgctgatcgtgcagaaacttctcccgtgagggtgtggtgatgccaacgtccctacaccttgtcactttgttgggttgtacatgatattcttcctcatgtagctgattcgttctgttggtcgagtactaaagatgccagaaatcaactggcgcctgtccgtgtttggattcgatttggatataccggtgttctaataaacaatgttttagacaattattactggactggttgaatgaattattgaagcgattatcggttagccggaattatcgccaccgttttctgcatataaatgataaacgtctgattttatggtttgtccctaacgaggaaatgccattgtataagcaattttgttaccgtagtattttggccctgcgaggaggaccacgcaagaacggccgacgcagtagagtgcaacggtctcccagagtatgaaaccacggttctgccattttgtccgtggatagcgctgcatcagattcactagaaaggactttgcccaaatttttttcctctttgggcccttacatcttcaagcgcgcacctctctctaccagatgtttacggagtttgctggccaaaacaaaacaaaatcgattgtaccatagcatcttagagaacttgcactagcctataatgagggcgcaatttaagggcgaggtcaaactctaaataacccctccatgttgttattttccactaaattctcatttcataagggtattaatttctgtattatagtggatagcatgaaagaaatagctaactatactcgttccagtttcaattttggagtttttgatgtacgaatagtcgctaggatactgccagcgcaagaatgttgtaacaattcgatatttacatgttaatttagctattcaccgattgcatcactgcaacaacatgcccttgttgagtaagcacatgctgcgatttcttcacattccctaagttaaagtctaacttctttcatgtatgttagtacttctcatcctttatatttgaactttaagcttcttccttttctttctgaaattcttattcttgctgtttttatacctgtaggcgtggaatcatgcatatgctgctctacccgcggtaagggcctacttagaaacacagttttagagcttaaaccaatataaaatacaggcacataaacatttttcagttgggcccataaaagcgcacctggataggcccctaaacagttttaggtgagtcacctctctttgcactgccgctgccattgtcacttatctacgttgcttcctcctaggtgccgccatcaaggagcattcgatctgtaccagagatgtctgaggggatcggaagatcacttgatctgcagtatggcctaggggaggactcatacaccaacgtgttgttagcattgagtcgctactgtggcgatgcagatgcatgagagcaagtactgtaatggtaatgtttgatgcgttgcctctaagaatatcacatctgattgggtgatgagatggaggctctgatgcgaaagttaacaaccacataaactccaaaaaaggtacgagaggaatagaggcattggtatttatatatttgaggtgaattactgtatacgttgcttcttaatttattggtggatgatatggataaaattaaaggcagtagttacctctattatagaacttgctctgatcgatgcatctactcccgtttgattctttcgctgtcatcgatgcatccatctcttgtcaattctttcgtaattatgtttcggtgttgtttttttatttttgatttcagaaatatgcggatcatgttcagaacttcaggtactctgcaatgccccgtaggttttaactgtattttacttcgatgtaaacatggacatttgtactcaaattggaagcggaaaaacagagtaggaaaaatataagattttaataggaatgtaagtgcaaaatagaagattgcaaaacacatgaatagtcgtttgattagaccgcataaaaatactgcaatcgaatgagagagatagatactcaaaggaattttccatgatgttgaagcacttgctaagtttcttctaaaatctacatgcaatgagttattttataggattttcataggatttggacagctccaatcctttgtgtcaaatagccaaataggatttgaatcctttaaaattccatcgtaaatcatttgattcaaagtagtcctaatagtctttaaagtgttctatttccggtttggtgaaatactattgactgaaacactccgcctgttgttgatgttgaatttactggaaaaagagaaagatggaacatattttttttattgaattcatgtacatacagaaattattccacataacaaaattactaagtttacaaccaatgttttccatgtacacactgttcacaggcaggttcagacaagtacactctgatcaaactgttttgcattttatgacaaacacttggcacaccattgaaagtagaaaagtagtagtaaaggtgatactagtaccacacttgctcttttcagatttgttcttcctgcttctgcagaggtttgcgagccaagacgaagaaaaggggtgtaaatatcccttccctgggaacaaaaaaatcaccattcaatcagcaatgttttgtttcaagttggacatgaattcaaactttattgcttcaaatttgctcgaggatggcagggctgatcgacttacttcccgcccttcacgagggaatcgaccgatgtcgcaaggaatctgcagattctcaggcttccttccggggcaagatggaggaactcaagccacttcaactgtggatttttcgcaggtaaaaagaagtcaattgtactgtacagtctctcccaagaacatgctaaaaattcagttgcttcagtctgggtgatgaactgcttactaaccagtgtttgaccgaggaagcggccgatacgggtgaactggaagtgtgtgagcgagagctggctgggatcaagaggctggtaccatggcaacggcgattcctctgccatatccttcgccaatataaccttcataaacacaagatcatagagttaagaaagctttaatctgatgatctggtcataaataaatgatttgccaatttgcaggtttgaagaattcagaagctttaatttgctgggctctgaaattaagatgcaattaagttcatttgcacctcaaagcctgcatctttcagagcctggatgcactgcctggtggttctgatgtccggcaagccattgccgagctagagctcccccttgatgctcaggtgcctcgcgttgtcaggatcatacttgtcagtcaggcaccactcgtccatcgcgaacaactttcccggtttcaacactcggaagatctcactgtagacaccgacctgaacgaactcacacaccgagaacgattttcattttaccaaatctgctggagatatgataaattaaagggaaatttttttttctttgatctctgtgagctactatgcatacagcgtcaggggcgtggcacgtcgcgtcgagggcgtaggctgcgtcgaaggtacaatcagggattggcatgttcatgaagtcaccctgcatggcaatttgttttttttgttgctgaaatgatcctagaatattgaaatggtggttggagggtacgtgtctaccttcacatagttgcaagtttcactcaaaccgacagaaaagttgagttcctgaaattgaagatcaaatttcaactgtttatttcgccatggtggcagtttcattttttttttccacttgaaggagtatattatgactcccgacaaaaaagttaaaaaaaaaagaaaacaaagaaacaagaactcattacctggccccttgatatctggtagtcattgttgttcaatccagtcaccgatgctgagctaaatttgggtagcattgaattattgttttactaaagtcaatttacacatgagcataaatttgtgtggtgattatagaatcttcattacctgaatctggcaattttctcaagggccctccaattccacaccccacgtctaggacctgcagtatatacagagaaggaatgcatgattcaactgtgtcatcagtagcaataatcacattgccatgtcccatcgcatgcaaggttgttaattaacagaacattgaccttcatccccttcttgaggccgagttgcagggccagaaaatgctcccggcgcttaaggctttcgcgtaaagtttctccatgccatctgaaaaaaagattcaagcaaacaaaacttattacaacttgaaatccatctgtgcataaattctcaagcattttattcttgcgtgtgtacagaatatttggatcagatataaacatctctctctatcttatggtcacacaggatggtggagagaaaatagaggcccacaaaacgcataaactatattgaccagcacttgcttgattgttggataacatcagggttcaccgaaatgctcacgtttcgcccgaaaatttcggttttttgcaatttctttttttgaatttggtcaaattttattcaaattctgtcaaaaattcaaaaaattccgtagaaaatttttctgaaatttccaaaatttcagaaatttcggttctatcgcccacctgtggtagaagtgtcagtttcaaaatttgaaaccctggataacattgacataactcaagttgctataagtatggacaacaatttattggccacaagtaaggcaatgtctggctagacaataggtatatggtatacaagccaatggaggaacaaagtgtggcttatcacaattgaaacaaacaaataaaaactaacctaataaactataacatgtctaacatttgacgtgatactgtgtgtctgtgtggcacttaaccaaataacctctcaagtgcattgggtgcagaagagcgatagagcctagcttgtttcttgtgctagtgctccacgacagatgaatttccgactctcttctgatcgctccttttgtttctctcccttccatataggattgtgctaatgtggaccaatttgtatagcctgctgatcagtgatcactcaaccttactatacttgctgtgcaagatctctcttacgctgtcacaatcttcacctgttgctatgtttggtatgggcctaccaccaataacatctatctatcttctattatatactaaaaatctattaagtattctataaatgctccaaagccatcacgtggcacttctacaagcgctcctaggccgccatgtgacattctacaatcccaccatcgattttcatttaaaatggtggactcattattttaaaccgtcggattagatctatttgaaaagtttatgctttctatatccgagcaatttaccaaaaatacttatttacatgaaaatagttacgtaggatggaaatacttacatacgtgtacgtatgaaagtaattactccatccatctcataatgtaagactttctagcattactcatatttatatagatgttaatgaatctagacacacatatatgtatagatttattaacatctatatgaatatggacaatactagaaagacttaccttatgaaacggaggaagtacatacatatatgaatctttaggtactgtttattaaaaaagaaacaaagaacatacgtgtgtacgataaaaaacctatagagacaaaaaaaacattgataaactgttcacttggatggaaatatacaaaggaacatgcgtacatatgtacggtgaacgcacgataaaaaaaaatgctataaagccttaaaggaaaatatatgtacgatgttataaccatcggaaaaaaaatagacggtctttttaaaataagatcttctatactataaaaaataaaatttattactctataaatatagtcacatggtgcttccataagcgctcttaggtcatcacgtggcactgtgtaatctcatgtagcactatatttaaatttatggatccgttattttatacctttacattagcttgcttcatcttaacactggtggagaaaccatctttggtcggtcgaccaaattccacaatagtcccggatgcaataaaaaccgggactaaagatcatttttagtcccagttaaaaaatttttgatctttagtctcaattggtactaaagatcatttttagtcccggttcaaagaagttggtgggtggagtcaagctccaattatctttagtcccagttggtataaacaaccgggactaaagatctatttttagtcccggttgtttatacaaaccgggacaaaaaatgaactgccgagccgcgcgcatgccgctaccctctcctcggtacccggtacccctccccttttttctctccttcattttaagactccctctccttttccattgtttaattcctcggtataccagcctcctctccttcatctccccttcctcccccttcccctctcctccgattcccctccccgcctcctccgattcttctcctctctgctgcgggccgggcggcggcgacggaggtagccggccgcacagcaggcgcccgtgcggtggatgggtggcggcggccgtgcggcagccggtcgggcggcggagcgaggtggccgcgcgacaggcggccgtgcggcggacgggaggcggcggccatccgggagccggtcgggcggtgacggccgtgcggcggtggcggagcgaggcggccgtgcggcggccggtgaggccgcgcccctcggcggcgggcaggcggccggcggggccgctggtggcggccggtgggccgcgcacagcagcggcgggcaggcggccggcggcagcggcagcccgtattgttttttttaattatttgtgatttcactgatgtacttttggatgaataattttgtgattcattgcatatttgtatggatctgcgatgtatttgatttgtttgtaatttttataggatttgtgatgtatttaatttgtgtgtataagtaactttgatttgtgatgtagatttgagatgttactttgagttttggattgggggtttgatttgggagaaaatgaaaaagaaaaaaaaagaaaaaggggaccatctcactgccccaaccctctctttagtctcggttggtgttactaaccgaaactaaatatcgatgtttagtcccgggtatttgaaccgggactaaagatagattggtagtcccggtttgaaaaccgggactataggggggttgcgaaccgggactaaaaagcacttctccactagtgtaatatcgtctattatatactagtagtccattaaacatcctacaatcgtactcaggacaccacgtagcactcctacaaatgctcctacgtcgccgcatgacattttaataaattagaaaaatcacaaaaattttgagaataaacaaaacatttggccgtcgattttctgtaatatacggtggacccattgttttctactattaaattatttgtccaagtaaaaaaggaataccacctatttcttttctctcctattttcctctattagaaaggtggaaatatttttttaccaattatattttgtcattatatttatttcaccaaaaagaaaatgacaaaaaaaggcccgcatatctcatccccgccagtccagtacgtacgtgcgtgcatacctccacacctatttcctttctctactattttcttcttttagatagatggaaaaaatattttatgataacaaattttaaacaactgtattatctaaatcatatagctaattttttattggtacactccaatagattatttactattatatattttaagattgaagatccaagtttgggacatatattattaaaatcatatagctaatattattatagaaattcattaatttgggacatatatattctacgaactagctatggttcactcatccataaatttttaagaaaaaatcaaatagatttttaaatcttctgattaataacatgcacttaaattataaaaatttaagtagtttaattagaaaatacaatacccaaagtatttctagtagccgtaagataaattgtatttataggatccattcgatctatcttgaaaaacaataatctcctcgtatcctcttgccttaaatatacctctggccctccctctctgactctcccatcctctcctctccagctcaattatcccatcttctattttgttttaactaacataatataaaaacagtcatagctattgttttattttataactaaataaataaatcaagatcacattagctatattttactatacaaaattaaaaatgcatcatttgaaggtagacactatcgtttgcatgccaattaaataacaacgaaaaaattaattaaaaatatgtaacatgttgaactaaatcattgtacataacaaaaatcaataaccgccctctagaacgctcatgactcattgtgtatcatatcctaaaattctaaaaaaaaatccaattaaattgttgtatccattatttttaaccattataagatatataaattttgtgaataatgttactatcactttatcggatgaagaaatgaccaaaataaaagttatagatattgatgagttgtagaactttaatgttgatgacttcttcagttaaaatcatttagtatttgaaaatattgtttgctcttgtcataatttgaaattcaaattcaaattattgaaacagagtcatataccaaaataaccaaaacaaaagttgtagataatgatgatttatacaactttgttgttgatgactttttcagttgaaatcatttagtatttaaaaatgttgtttgaagttgttataatttgaaattcaaattcaaattattgaaacagagtcatatagcaaaatgacccaaacaaaagttgtaaatattgatgatttatatagctttgttgttgatgactttttcagttgaaatcttttaatatttgaaaatgctgtttgaagttgttataatttgaaattcaaattcaaattattgaaaccgagtcatatagcaaaatgaccaaaacaaaagttgtagatattgatgatttatataactttgttgttgatgactttttcagttgaagtcatttagtatttggaaatgttgtttgaacttgtcataatttgaaattcaaattcaaattattgaaacagagtcatatagcaaaatgataaaaacaaaaattgtagatattgatgatttatataattttgttgttgataactttttcagttgaaatcgtttattatttgaaaatattgtttgcatttgtcataatttgaaaattaaattttatataggtcaattaaactcatatggagaaataaccaaaataaaatcggtagacctcaataagttatacaactttgtttttgacaactttttcacataagtttatttagtaagacaaaattcgatttgaaggtttaatatttttgaaataattgaaaatagggaggcagaatggacttctcggcgagagatgagcaaaagggctggcccgtaataggccttttgctcctcactcaccgagaagtctattttacctcccttctttcaattaattcaaaatattaaaccttcgaatcaaattttatcttactaaatgaacttatgtgaaaaacttgtctaaaacaaagttgtacaacttattgagatctacctatttgattttggttatttctccatctgagtttgattgtactatataaaatttgaatttcaaattatgacaaattcaaataacatttttaaatactaaatgatttcaactgaaaaagtcatcaaaaacaaagttgtataacttatcaatatctacaacttttgttttagtcatttttctatatgactttgtttgacagtttaaatttgaatttcaaattatgacaacttcaaacagcattttcaaacactaaatgatttcaactgaaaaagtcatcaatattaaagttatataactcatcaaggtatataacttttatttgggtcatttcttcatccagcaaagcgacttgtaacattgttcacaaaatgtacatatctctctaatagtatatac

SEQ ID NO: 61584 - DNA, 7933 bp, Oryza sativa
ctttgccggatgaagaaatgacccaaataaaagttataaactattagagagatatgtacattttgtgaacaatgttacaagtcgctttgccggataaagaaatgacccaaataaaagttatataccttgatgagttatacaactttgatattgatgactttttcagttgaaatcatttagtatttaaaaatgttgtttgaagttgtcataatttgaaattcaaatttaaactattcaaacaaagtcatatagaaaaaatgaccaatactaaagttgtagatcttgatgagttatacaactttgttattgatgactttttcatttgaaatcatatattgcttcaaaatattatttgaatttcttatattttaaaattcaaatttttcatagttcaatcaaactcgtatggagaaatgtttaaaagaaaattggtagatctcaacgagttctacaaaaatttttcatatgagttcatttaataccataaatttttgattcgaagttttaatattttaaaattaattgtttttcccttctcttcccttcaaattttttcatctccccttctcactcactctctctttctatcatctcccctcactctctctttctctcctctcttgctctccactcctcctcgggcggcggtggcaggagctggcggcgtcaaggggggctctcggccgcctcgggctctggcctggagctggcggtggctggggcggctctgcctggagctaacggcggcgggggcgacgacctcggcgaagagtgggcggtggcgggcctcgtctcactcggatccggaggcggcaggccttgtcctgctcggatccggcgacggcgggcctcgtcccgcccggatccggtagcggcctcgggggaagagtgggcggcgacctcgttgaccttgggggaagagtgggtggcggcgccatcgccatctcctcctcaccgccgacgacgaggaggtggccagatgcagccccttcgtcgccgcctcgccgccctattcatccccccaccccccggggcgggtaccggcgcctcggctcctccgcctccgtgtccacgacaacggatgtgatttgggtggaggttgggacgacgaagggggataggagcttattccatgtcgattcggccgtgcttgagaccgggtcggtgcggcgcttcctcgcggtggctgggcagcgggcccgcggcggtgcggtggcggtcgccatggacgcgctgctgttcgagcacctgctgtggctgcaggcggtgggtacatgagctcaagcttgccatgaaggtctggatccagtgatgttgcattgccatgggctattgctgtgatgaattctccgttgtttagtagttctttgtctctgtaattcatatttggttctttttgctttgtgttctcttcagccggtgcaattcttctccagctccagtgggctggcgccccttctgcatctcgatgtggatgggttcagtggcctcttaccctaatcccccacctcgtgctcttttctctcgctcttcatggcgtggcaaaccagcgcccagcggtgccgccgtgctgcgcgtgtggtggcctgacgatggctcaaagcagaacatagcgccagatttggtcaagccctccagattttccctttacatggtgataaaactagctataatggttgtatttttttggtcgaactgcaaacatttcagtgttggtatcgttgcatgaattttgtttacgaatgttctatggttcacatgtgcagctgcccattgccattcttccttctctgacattatctatgaagtatgtattttttttccttgaagatttatatatcctgattgaccaatagaacgcctttttttttgcaaaacccataaatgataaaagggtttcatacttgccagatattttgaagaatatcttagctgatcaatttacctttctgctacctaatgccgaaataattagtttagtagagatgttttagggaagccaattaattcggttaatggctttgtggtgatcatttgaccctttgtgcttcgttatagatatgatcaggtgccctctgtaatgccattagtgtgccgcacaatgtgccaaaaatatgtttgccttttatctgtttacatgttcttgataagaactttttctcactgacaaccttgaaacaccacaagaaacacattggttcctatcaagtttagtctgctctagatgctttcacgttctactcatataagttctagttttacaatgtctaaaacaaacggtaaggcgccgagccatcgtcattagctaattaaaaagcagattactagatttgaatgtacattacagttgtgtttctatgtacaagaaggataaatattgctaatatctatgttcttttccagtttaccttctactctagatggtagtttgaaattatatgtagaatatgtttttagagagaaataagtgcaatctaattgtaaatgtgaatattgaatctgataattatttttgtcatatctgtataaaaatgattggttgctaccacagaaggtgctcaggcttgtgaagactgtaagtgcatgcttggctatcaatcagccttgagcttgtgctttctcagtcctaagcagttgcattgccatctcattttataacaatctttgtatatgtgagaattgccatttagcttaagtatattaagggtgtcactgctaattagttgcacaatagagctttgctgcacaaacagactgataatagagctttgctgcacaaattagttagctgggatgttcttatctacctgcaagtttcaagaaaaaaattgaaaatatactgtttatagatttgttttgctaaaatataccggatggagaatgatttgcacaaatatagtatcggtatcgcggcttggaagagcgataccgaggttcgcgacaacaaaatacgataccgccacgctatcgcactatcaactcgcgagggtgcatttgagctggcggtgtcgcttgtggaaacaacgagactgtcatgatatcgctctttcgtagagcgagagcgccacgtgaaggaattgatccgttgtcacgccggtatcacggtgtgcaagcgtgagagcgaaatcggtcttgtaatcccaacacgcgagaccgagcatgtcgcgggacccacattggcgaaacgactgggcgcgagtgggccgttggtctcgcacgcgcaaagtgcgagaccgatattggtatcgctgtcccaatgcgcgagaccgacggcggtatcgctctggcaaagcgagagagcgctttgctatcgctcaatcaaaaatcaataccggctataccagcgaatacgtgcatagccttagtgaatacggccgctgaatcgtgtccatgcaggccacaagtgaacatgccgtatatacgaatatgcatacacatatatatagccgtcaaatagatcatctagcttcttgttggctcatgcatgtatacgtatatacattagccaagcatgcatgtatatatggctgaacacacatatagatggacatatgccagtacgtgcatgcatggctcatgcattcaattagcaggtgggacacgctctcacgctgtcaaagcgcgagactgcttggggccccgccggtctgggttcgcgtcagacggccgcgaaatcgctctacgagcgtttttggaatgcgagaccgatgcattagcgctcccgcggtttcaattaacgataacgctggcaccttcactaatacattatgtgatatcgcgctctcgcttaaccaaagtgcgacggcggtatatttccgcaaatctttccctaatcagtatattcttacaatttcagtaaaaaaattgtatattttcaaaaaattttccaagtttcaagttgtacggtaggaaatcttactcctgttgtactcaacattgtcccttatattggctattccttgaaattccttcttttcatctattattatgctcctattatttgctttcctcaaagtaatctaccatgttagtgtatatttgtcccttaactgcatagccctaaatgaacagaggggcgcagcgaagcgcgccaaaagtcctagttcattttacacttggaattcctgccctaggaatcctgtgcattgtctgtttggaattccttttgcctgtaagatattaatggctgctaggagtacaaggattaggtctttctctaacttaagtgataagaaatcaaactcgtatggtttgatctttgatgattaattttcttttttataggtgcaaaaattagtggaaacttggtttgtttctgcttatcttcatttcagttcgttaacaacaggtaaccaacttcccatgctaccataaagcttcagtttaagacattgagtgttgccctctttgttgaaatcccattataaccaagttatgtatttgactatgttgcactcaccatattccttcaaacatattgtatctgctcacaaaaatattgtgcttgcaatgattgaagtactaagatcgcatacctataatctatacttaaaagatgcacaaccaatagtttaacttgacatattgacgttcacagtcctgtccattccaaaattttttgctgaataaacatcatgttggataaattatttggtttactttcctgattatgagaaaattactacgtgaacagtttagattgtttacctatcagttgtgttcttttagtatggataaatcattactttggttttggctggtacctttttgcttttccctcacatttagaaaaagaaaattaggagggaggactaatattgttgagtagtttagtgacttaatattgttgactcccggtattgacaataaaattgtatttttgcagcacatctcaagaagctatgtataagttgtagcaaaaaattccatttgcacatcaacaagaaagccttgctgtaattcaatcctctacttgctatgggtggaggatgagaagcatggagtgactccattgaatgtttgaaagatttgttttggttttctgttttcagatttcgttattaggttgaatctgagatgaactattgtttgaattctgttgtattctgattgtatctgttattagttgaatctgagatagtatctgttattatgtttgaatctgagatggtatgagaaattggattgaatttggtgggctcaaatttaatgggactgtttagtaggctttgatctgataattggttaacaaaatgggccaattttaaaataggcctattttaaaatggactagttctaaaaaaaatgatgggccgctgttaaataattaatgggccatcaaaacagttggttgccacgtcatcacacgtgtcaaccacgtcatcacacacgtgtcaacaaccacgtcacctgccatgttggccaccacgtggcaaccatatgtgacgtttaattttgtcacaaaggttgggcctgggctggactacacgagcccaaaagcatttcatgacggttaaaaaacgtcatagattgtgctgatccatgacgatttcggagaaaacatcggcagatttaatctgtgacgctcaatagatgacgataagtagaatcgtcacagacaaatttctgtgacgaattttaagtgatccatgacgaattttttcgtcacagattaaatagattcttgtagttgttgttgtggatggtttgagataatggatgatgattttgttgtcgtgaatgatttgggattgtggatgatttgggatgtcgggagatgatccgtgtatgagttcagccggaaaacaagtgcaaatagctaaaaacaataatctacaagcaaataaaataaaatgtctctactcccggttggtaacaccaaccgggagtagagatgcatcattactcccgggtatttaaaccgggactaaagatcatcatcatcatcatctctagtcccagattccttctcccggtttgcaatccgggattacagggggttgcgaaccgggagaaaagaggcattctccagtagtgagcatctcctatctctttaacgcaatcttgtgtataccctaatatcatcttgaatattttataaataattacattcagttttcaaatgaacagtcggaaactgctggactgggtgaaggattggcctaaaaaagttatgttatagttgaatttcactgtgagctgtccgttacattcgaccgtctgtatgttgcttgagacggttggtagccataactgtcacgcccaaaaattctcgaatagaattccatgcagaacgtgcattaaaacccctgtccaggactggccagggtacgcaaacgacaaagttgacataaacatccacgtcttacaaagttaacatcataaatgcagcggaaaattaaagataactagagctaagccttgacttggattgcagcaggaacaccacttcacaggcatcctcgacgacacggatgaagcctactcctcgaagaaaccaccatcggacgcatactcgaactgtaagggttgggagcggcggttgcggggtgtgtgggaggtggcgcgggagcatgggcgacgtatgcgcaggtgcgcgcggagagggcgggagcggcggtttcgggcgcggcggcgctggccggaggtgggagatgggcccgacaggtgggccccgccccacctgtcggtgacccggagaggggagggggtggcgcggcggctggctgggcctcggcctcgggccagcccagctggcgtgcgggaagaggagggggagtgggtcggcgggggaaaggagggaactttaatggatccgaccgttttttgctcaatataaactaattacgaacctgcacctcacaggcggcaatttttgaggtggacttaaagatgctggtttaagaactataccttagtggttcctaaaatgaaagaaaaggtatgctcaatgcatcggctcgaattaccatccatccatcccacatccatccacagcacaaattgaagaaactaaatcacatttttttggtacaaatgaagaattccatcactccaattacacgaattatttatatgcataaaaggtaaagaacaagatgaacagatcagaaaaaagatataaagtccatctgcacctcgcttggtgggtgggtggtggggggcaccgaatccggctacccccgagcaccaatgggaagggacagagaggaggaggggccacgctggatccgaccgcttgccgagcaccggatttggccgttcccatgtgctggtggggaggggcggagccggatctggccacccccgagctccaatggatgatatgaaggggcgagaggaaggttaaggggcggagccggatctggccacgccgccatcgccgtcatcttgcagcatggagggttaaggggaggaggaggaagaggaggtgcggcggtagttacagagagaggggtgagagaatgaggggcttgagagggagaatgaggaggggggagggcacgggagcaagagaggcagagaaaaggataaggatgactgggttggttccgctcctcacctaaaagttgtgattttttttaaagaaaattggtcacttttatcccgaccctactaacaactgctcccatgggacaacattctcagttggttttaatagggaacaacacttttctctgcaaggagttataggtgtcggttcatgaaggtatcggttttaatttaccgtatggtgtcctgcagttgtgcgtttctggttggaaaaggtaagtgttggtttttcttaattactgatgggtgaatagccaatatggtccctgaagtttcgcttcgggctcagtttagtccttgatgtttcaaatcgtccaaacaagtcctccaaattaatcatttgggttaatatagtccttggactcaaaaaagtgccacgtga

SEQ ID NO: 61585 - DNA, 7414 bp, Oryza sativa
atctaagttccttgtttttttcagtctctttttgtttggatgacaaacagctatacaattcttgtgtgagtttgtttgtttagtttggatgtcaacaactatccgattaatgtgtttacagttatgggagtataaccatttcttgcattctggcaggagaaattccagaactatctttccgttgaaggtcaaaggcttaggcagcaggacggagtggcgatgggcaagaactaatgaaagccatggtatttatctctctgtaccagaccaaattttcttctcctagagctatccctccaatggctttccctctaagctatctccaataaatcttgatgctcatggctgaagcttggaatgagctttagctctagtttttggctgctgcgcagcatttgtgtaaaacgattgacgatttcgctttaacctctgatagcccttgttttatcatagcttttaacttcgttttgatcaacttgtgtgacatgtcgatgtccaacttgtgttttgggtgctctgaatgaataaggtggtttcatttgatgggacatgtaaatatgttaaagggggtgtttagatcaggggtttaaagttttggcgtgtcatatcgagtattatatagggtgtcacatgaggtgttcggacactaataaaaaactaattgcagaatccgtcagtaaaccgcgagacgaatttattaagcctaattaatttgtcattagcaaatgtttactgtagcaccacattgtcaaatcatgaagcaattaggcttaaaagattcgtcttgcaaattagtcgcaatctatgcaattagttatttttttagcttatatttaattttttatacatgtgttcaaacgttcgatgtgacatggtgaaaaattttatagtgggatctaaacaaggccgaagttctagtcggcacctcctatgtgcattgtgctataatgggaagtcgtccaacaagcgccgtccgggtaaattgaaacgtttttcacgggcagcttacatcatctgctgcctagtgtatttatagtttacacggggcagctctttaaagccccccaccccaccccacccacccccctcccccacaccaccgtggtaaccataaagaaagcgtttcatattttatccacctaggaaattaatggtgagggcttgtgaaaattgtttttttctatgctacccctcttctctcgacgagacatcgagtaaactcgagtcccttgcatacttctcctacagtctgtttggttggaggaagtttctaggagggattgggagtttaaagggatgaggctattaactgttttgtttggttgggggacatgggaattttggtgggatggggatggggaattgaggaatgaactccctccttttcaatacctaggtaggggcaggtaattgggagggaattcctcctttacttcgcctaaacaaatctcagccatccattttcattaatgatataatctccaactaaattccctatcaatttccaccacctctaccaaacaagagactgggatgaaaaatcaaattcacatcttaatctcaccatcaattccctcatgtaaactcccaatcccctttcctcaagttgccaaacaagccgctagagcaagatgacggcatccccttcatgctatcacagatgaggtgcatgctggatcttctttcgtagatcctgccacagacaagctccacgccaccctcttccaccatttaattgtgcacactttgacaataatttctggtttgaaagttttgtaactaggtttaaaagtattttttttaaaaaaaaatgagtttgtaacggtcagatttgagttgaaagtttaatgttgtgaatagaaagtttgaaaatttgatttgaaatgttaggttttgaaacaaagtattaacagctgtcaatgaaagttctatattttgaatataaacttttgattgaatgtagaagtttcagggtgctatttgtaagtttccagagtttgagttgaaattgtgcgtgtagaaaaagaaaaatgttggttgaaacttctaagatttctttcgaattgctacacgcaaggcgttagaaaaaagggttaattagatccatactattaaaaatttactgattttgaaatatactattactatttgtgttttgtaacgatgccactgcaacgtattttacatgtattagacaaaaatgcccttatcttctacctctctctctcttccccatcttctacccctctctctctcctccactgcgctgctgcggcggccgcatcgctgctgcagctgccaccgccgcgccgccgctgctgcagcctgcagctgccgccgccgagccgtcgctgctgcgctcgccgcacagctgccgcgtcgctgctgcagctgccaccgccgtgccgtcgctgctatagcctgcagctgccgctgccgcgccgtcgctgctgcgctcgtcgccgagccgccgcgccgccgctgctgcgctcgccgccgagccgccgcacgccgctgctgttgctgccgccgtctcaccgctcactccgccgccatccccgccacatgctgctcgctcgtgctgccgccgcgcgcgctctttctgctgctcgcgccgccgccgcgtcgctactgcagctggcgccgctgttgcttctgccgccgccgagccgccgtcgctgctaccgccgccgccgagccgcgccgccactcacctccgtgcgcacatcgccgctgctgcgctcgccgccgctgccgccgacgcgccactgagaagaaagagaggaggaaggtgaaagagagaggaggaaggagaaaggggaagaaggaagaaggaaaggtggtagtttgatccaatttttcttggaaatgcatagaagagtcaagtagtggtatcttttgaatatatatgaaattatattggtatatttctaaatatatgaatactaatgatatattttaaaactggtaaatttttaatggcatgtatttaattaaccctagaaaaaaaggtttgcgttggggattctgaacaatttgaacctgaaacatcatagatggatgtgtgggtaccctggtatggccattcaccctgggccgttgtatttgcttaacaataatgacacattgtgtcacatcatcgaaaaacacctcggtttttttaaggatgggatatagattattttaaaagttgaggaaccaactttaattggtttcacatctaaaggaccaaaactaaaccaaaaccataattaagaaatcaaaatgaaccttttccttatatcaaatataggtatatacttcctctcaaaaattacaggcatataccacccatggaatcattcactctaagcatcacggtttttcttttattactgaataatgaagcccatgccacagtgatataagtaagaaaatcatagcatcgtaatgccttatttaattctcataaaaatttaggtttttatcagatgattagagccgaggtcatgggataaagccgtttgcaattacaatgcattgatataaatgatacaagaatattaattcgtgtatatgcgctagcagtcgaactcacacgtgtggttttgaccgcgtcacaactatagggtgagggttagtgtttcaggggtaggtgggggaggaaggccatgatgatgggaagtgagggatcgggtttagagggatagcattagaggcggtggaccgacagtgggcagtgcacaaagatggacaatgagctagtgttggtggctgggcaaagcggggtgaagaggaggatgaggccgggcagacagggctcgctggcacgttggcgtctttcggtgccagcgaggccagccaactacacatgaccaagataggggatgagtataaaaagaattgacatagtttccggatgatctcgtcagagtaagctcgcagaacgagaaggaggggcctcattggggagaggtcttcgccaaagaaaagccgctcgactacattctgttcttctttagaggagttcacgttcaccggagaaagggggactcacaagatcttatcctatcttactataaaattataacccactaaattctaaagctcaacatgcaaagatgctacatcatcatccactaacaattattacatttaaacatcatgcaagcatgttatattatatataattttataatttattaaattttagagttttaagatataagcatgttaaatcatcatcccatataattcatataatatttcaatatatctcttcatcattttttataatatcatatatacctatatgattcatcctcacttagttagtgttatttttctcttctcccattaaatcatatcacatcaattggttttagtcttagatgattaatctatggtccaaagtatctctctttcttctttcataaaaccatatcatcttacttttacatttgaatcatcattctatatactatttaaatttaaattattataaaccatattaacttattaacttatataagtttatgtagtttagctatcttacacattatttttatttgttataattatattgaacacctgcagtaacgtgcaaggttttagctagttttattaatccctattaggtgacattctaatcctattcaatccactttaaaccgaacaaaacaagacctaaagagcaaggatcgagctcgccgaaggggctgtgttgccgttcgtacggtgtagaggaagagaacgaatacgatacggtgaggggaagatgggataaggcatccgaggagggacccagtggggctcacccgccgcgccacgtgcagtttacacgtctcttcgcttcacccacgcgtcttcttcttcttctccttcctcttccgcatcgcctcttcctcccccccctccctcccccctctcgcgcggaagaacggaacggaacggaacaccagccgctgctccggcaagcgctcgccgccggcgaggcaaaggtatgcgccacacgctctctgtacctaccaccactcgttgtcgttttcctcctctcgcggggggtgttttctttgcttgcccgcgcccaccggtggatggcttaatttagcttttccgctctgcgcgcgaggaggatctacctgctagctagacggattccttaccccccgtgtgattgatcgatgaggggctttacgctgatgcggtgaatcgaaccggcaccgctctccgtcatgggctttggaggctggaaatccaaccaccgatggatgcgttgggggagaaaaggaaattggggaatttggtactaggagagcttccttgctgtagagaggaagctagctagcttagacttgttgagaaattagtggagagtgagttcgtgagtggttttattgcgcattgcaagggaaatggaaagagggtgtctgatgaagcatgcgttagaggtgcacaaagtagagattcacatcgttgctgaagagtataggctactagtttgatgtatgctccgcgttgctaggagacatctcgcgaagcaaaatttggagaaatgagcgcactgaaactaggaggttgatttttttttttaacaatagtgtagtcaaagtgatgttggatggttgatgtttaaatgctgaacaaatgaatatgtgtacatccattcaaattaagctcgccattgtaagactaaaacacgacaaaatgacagagaaagtggatgacaacaatttaggaaggaaaaaggttaagcactgcattacgttacatatggaaatatttacttgttaattttcattagtttgcaaacaatctgtagatcctaacacatgtattatatatgcgatcaaattacaggctttaaattgatgccgctgtgactaaataagttttattcagttgtacatctctgatatccattcttcaatgagataagcactccttttgataattttcttttttctataatctctaatggttataaaagaaatccgttagaaacaacacatcattactaatagttcctaaccttcttgacaaagtcagatgattttcctttagaaccatctgacgtcacataatcgcaaatggtttccatatacacctgtttacggtagtaatgccagttatgttttgacttgctcatgtgtgctgccgtgctgcacctagtgaacctataggcactgtatttttgtggcaagaaggatttttttttcatgaatgttatgcaagtcttttttttttggtcaacttgcttcacttaagcagttgactaattcctcattagccttaatgttttcgcttggatgtggtaacaattttaatcaacttcgtagatggagaacactcaatttagccgtccaaaggcggtaccctataatgactcctgggagatacccaattctgactatattctcttgtatctcaatgacaaacaaactgggaagatcacttgcatggtatgtgggaaagaaggacactacacttgtgagtgccccatgaagaataaagaaaaatatgtcatatgtactctttgtggcaaggttggccactgtcacttatggtgctgccatcagaatgagagtgagaggcgtgcttgccgtcgttgtggagaaaaaggacactatgataattggcatcacctaggttgctccagctgtgagaagcatcatccactcgggagatgtcctatgggaaaaattacatgttttctttgtgaaggcaatggacatgtccctgttcaatgtcatttgagtccaatgctcactgcaataactcagaatcaacgagagagtttccgagctactctgagacaagcattgagagaaacaagcaacacagcagtcacaccaattacattgaccagagaattagagccatataatgataagaatggaggccaacctaaaggggacaatgaaatggtgcccagggtcttaggcttcaatcaaggagaggaaggccattctgctttgaggaaccctaacagatgccatgtaccatcctctgacaaggctaacgttgctgcagataaggcaccaaaccaatctttaggagtaacctgcttcaactgtgggggcaaaggtcactattcaaataaatgtcctcaaaagcaaaagcaacatggagtcagatcaaccaatgctgcagctatgaaagataagacaccgaacctaacaggagtgacctgcttcgactgtggtgacagaggtcacttttcttatacatgtcctcaaaatctactagaagtcatgttgactgcagaactagagccacatgatgatacctatgaacgccaacctaaagcggataatggaacagtaccaactgtcctaagcctgaattgtggtgaggcaagccattgtggtaggaataatcccatgaaaagtctggaatcatcctctgataagatcaattctacagctatgacata

SEQ ID NO: 61586 - DNA, 12322 bp, Oryza sativa
aatctttagtcccgattcttattagaaccgggactattgtggaaatcgctcgaccctcgaaagatcatttctccagtagtgtttcctccgcctcgccgtcgcccgagtggccgccggcaaagccgcgaggctgcaaggacggcggcagggggcttctcgctccccaaagttcaggcggtcaggggacctgccctggcggcggcggcggtgaccgccagatccatgccgctcgaccggatctggtgggatggcgatggcggcggcgacggggacggcgacggcggcggggttggtgacgacgaagatcggggtgagcggcgctgggcggggatgtgggcgatggcatcagggatggcgacggtgttagagcggcggcggtggagtccacgaatccggcggccagcgacctgccccacatctcgcgcttggccagcaatggtggtgaggaggacggccggttctggctaggtctagatccggtacgtcctcggtcgggtcgggggtggcatggaatccggtcgttgtgcaggtggtgtgcatagtgcatataccttcggtgtgtaggtgcaggtgatatttggtggcttccactgtaggtgctatggttgagggggactccgaggcgaaagccttgctccgcttctggtgctagcaacggcgatgccctcgggtgccgttcaccttcttgaaggcgttgctattggagccctcgttcaacgccactaaaggatatcctctgggtgaaaaccttagattcgttaggatcggacgatgtcgccattctttcggcgtaaccttcttaaaggcttcgttttaggagttttctcccttgttggactgctgttcttaggatcagtacgtcaatgtcagggttttcgccggttttcctttaattaaccatgttgttgtaaggtttttagccccggttttccttataaactggatcaactctcttcttctatagtaaattgcaggaactccctgcatgtcccctgaaaaaaaaaaacatggctgactagctagctgtgtatgtgtacctttacatgtgtaatctgtgctaaccccactatcgcaagcctgtttgagaatactaatttcgatctgcagaacagcagcatcaaagagatgatgagaccggtgaattcgatgagataagctgggtttcgcgtcaggttgcaggcattcctactgatgtccctcttgctaatgcagatgccatttgattctgccttgtacgcttgccatcggcagctttggagacagggagacgcatcatggaggccatcatcatctcttagctccaagcaaatcaacactgtctcgtcgaatcctatcaattgtttgcattacaagtgtcattaccagagctagagatcgagaggcaacctctgacgagcatacatatcgatcactgtcgttttcttttgcttgcacgatttcattaatttgatttggagtttcgtacgttttcaggcggcccgggcgggtacacaacgaccctccttgttgctaggaatttgagagcagagagccaaggaacaaaggatgcaattgttattgcatggagcaatattggatgtaaaggattagcgcagaattggatgcctatgtgatcgagatcatgtggaaattagtatcagttgggtccatgtattttggttttatttgaagtttgtcaagtgtggatcctttggacgattgtgcgtgttttacttgtattgactaacataagttaggtcatgaaaatctaagcatgtaaggtggttatttagggcttgtttatttttttcttttttgtcgctttcaaacctaccaaattttggtagatcaacggtgtcaaaaaaaaaatggtagatcaacaaaccaagcatatattatcaatgctgtcctacttaattttggtaattctagaagtttctactcttaacaattatgatgaaatcccttctttcaataaagttaaggccaaaagctcaaacctcgtgcttccacgtcatcatcaaattgtgaaccgttggatgaatgcattagatcgcttttcaaacgttggatagaatgcagcatagagcccaatccattagtcaccgggtgagtctcttcgcctccttagtgccaaatgtagcccatataaacacaatggcccatctccacacacatctatatgtatccagcccatcaatccgtataaaagagctttatggctgaacaccccttcagttgacatgtgctacctaaattatctacaaaattttggatagggctactaaaaagaatttctccaagaaagctatttgtttttctgtttctccttgagattatacctcctatctaataaattaatgttaaccaaatcccgcagcaacacgcggggcatcctctagtttggtaaggcttaaaaccaaacatatctaacactatcaaaatttaatactaacacaaaatatgtcaaaattttggtagtgttaaaagtggttatgaagtgaacgctctgtttctgttgatgtacatgatggttggaactatgacgaagattgagactatgcccattgaaaatgcaaagatagaagcttcaaactagaagataaaaacaggggctttccaatcttcaaatcattttgattggttgaatttgtgccaaggagtagaggaggagcgaagttatagtgaatgtagtaacaatttatgatttaagctctttgtcaacaataacgactctgccagagtttgttcagtcaattcaattgaatttacaccgaacaaatataactgtactagcatgactttcaaacaagaagacattattttaaaaaaacgaaccatcagaactaatttatttttaagataatggataaaaattcgccaacgaaaaaccaaattagctccaaaaattatctacaagagttacccacggtcgccggctcgccgccgagcagtgcagtccgcccgacgccatgatttccatcctgtccacgtcgagaagctccaccgtgtttgcgcgttgcctcgcctcgccggcggcagcggcggcggcggcggcggtgatggccgctggataaagcgggcccaaaaaggatcgcggtgtacggtgcggcttgggccggaacgggattgcagcctacgtgagtcctataagtgttgggccggaacggcgttgcgtttattaataagtctatttagcccctctcaactcttgccccgattcagtcagtgggtatgagttgagggacaaataatagacttatttcttatccatgcggcccatacatttgggccgggacgggattattgccgcctccgtgaggcccgtgggccctggtgatttgacaggtgggctgggctacaacgagcctgcgctgcaggccgcctcggcgtcttcttctccggctctctccgccgccgtctcgtctccggcgcgcatacggcggcgagtcgccctggctggcggcgatggtgggggcatcggtgatcgtctccgccgcccgcacgcctcatgctccgccaccacgaggcatatatcgagcgcgcattgcgatttttcctttacccttctgggtttttgttctagctaggcaaggcagccggctaatcacgccgccgagatcgccggagcccggaggccgccgcccgcgtaggcccgtctccacccagcgtctcaactggtcgactcggtggtgatgctccaccccccgcctctgctttctcctcccccgctttcatcgaaggggtaaacgcggaaactttttttttttccttttgtgaatacactgatactctcttgtttgcttgggatgatgtcgatgcatttgagtttgcaacttctcaaccaaatggggaaacataaaacattatactttgtggtaatggatcttggtaaatgtccattcctttaggttagtttagtgcagttgcagtactgaaccattggaattgggatttttcaggagaggagctgtttgctgtgagtctctgaacttgcgtgctatcgaatgcttccatcaaaacagtttgtaggttacaagcgaaaaaacaaaaacaaaaaaaactgtatgtgcagttagtcgatttacatattcttcctgcaaatgctaaatggttcatggttcttatattttgttcagtaacagcaccctgcatttggctgtgtacaccccacaaaggtgtagaggccgggtttgataatcctttatctaaaaaaaaacagcaccctgcatgtgtgaacatcatgaagctactcatacaacctgaacctatgctgataaggcttcggttgctcggctgtaaatatctattatagcctggggattattatgccaaattattcagagatttgatgcttcaacgcagggacacgctaaacttgtcttttgttctctgcaactctttcaaagcatctccgatatgcatgcgatctgctggagattcctttgagcaggaaactccaatctgcagaattgatatgatgcaggctattctcgtgtctctttcttttgccatctgagtttctttcttctccatcattgttctctgatagtaagtgttggtctgcaatatcgatcacattgtctggaagtgccatctttacataattatgaaggctgagagcttctttaaattcagtgccagttggtctttttccggtaaacatctccagcaacagtataccatagctgtagatatcacccagaattgaaacctcattgcccaaaccgtactctgtaatcataagaaaatgttacataaaggaaattgttgcaagtttaagcatttatatttaaatttatatgtaggcttcagtctaataatatataatttacactgctgcataattatcatttgcaagaatttgagttttttcataacaaattgcacacatctgaatagcaaaacgatctacttaagtatggatcaatggaaaggtttctgaataaattagaaagaaaaccgtggattgtagctgttagaagcatacctggagcagcatatccattcctctcattgtagcccagccacttgatttctctaacatgtcactatggtcttgatgcaggactcttgcaagcccaaaatcaccaacgtgagcaaccatttcactatctaggaaaatattgcttggcttgagatcacagtgaataattggcaatggcctatgttggtgaagataatcaagtgcagaaaccacatcaatggcaaatgtcgagccttttgatgatatttaaaaccttgtcttccccatttgttttgacagcgcaaacgaaggaagccttagccacttctactagtggttgggaaccttcccctttagcacacaaagcgaaacaacggtttagggcataataattaagtattagctaaaaaatcttgaaaaatatattaatactaaaagcaattttcttataattttttttcaaaaacactgtttagtagtttgggaaacgtgtgtacgaaaaacgaggaaatagaggttcggtaagtgtagggaagaacacaaccttaataattatatcctaaattatgcatatagacccctatttggatagcaaaattttcaaattagccttcctcatctcattcccttgctcggtcggtgatctgaaccaaaactctgggtcgcaaccaaccatcaaaataaaggacgattttgcaaaatgtattaaaatgagagcgtgtgtgtgagagagagataatcaccgccgttggatcaagcaggaatggttcagatgccactgccccaatccttcctggccagtcgccgccttacgcggccttgccggaagtccagccaggagcaccgccacattgtcggagccaccacctccccctccttcccgtcgttcgtagcacccctgcatcttctcccggatccatcatcctatcttcatctccttcccgaacctctccttgacaatggaagcaggtgtcgagtacatatccttatatatttacattgttcaacattatctaaaaaaaaactatttacattgttcaaatcctttatattatgagacaaacaaagtactcagttaagcggagatggctgcttgttcaaatcctcaacgggaggtggctgcttgcaccttaagcggtaatccttgagcatttgttgccttcttctcagttactacttgtttgcttttgatttgtgtcgattaataaatggagaattaatcaggtaatgataattaaaataaccttcttatattttttttgcaaaaaaaataattgtttaataattcaagaaacgtgtgtgtgaaaaatgagggaaatgagggagtaaaaattaggaagataaagagccgaacacatcctaaacattgataacaactacgctaattatggttccactgataagccggaaaaaaatactatactagtaaatctgttatgaacacaacacaatgtagagaacacacaaggcacggggttttcgcctgaaattccatatctccatctaacagtctaacagactgtacattttaacttgcttcacgttacatgttttgttttgtactacattggtcagtcagactaatgcctccacgtccagtattgcctgaacattatggacttcttcaacaaaagaaacaatggtaaactcctacagaagaaacaatcaaacagtgtttgctcttgatttgtgtcgatttttaagtttgaaatgtcaagatgcagtatacagatcaactccagtttctgccaacttaagagcatgcaggaaaccttgacagagagctcgtgtcctgaaggtagctaaatcatggtcttctggtgcatagctgctggtgggttcggtcatttgggtgagcttcccggttcattcctggcgttgcctggcgcgttgacggccaccgcatttgcatccgcagtctatcgtcgacaagcaatgtgaagatgaaaaatacttgttagagcagattaaccatggtgttagataattcgatatccatataggcattaggcaacgcagagcttttgctatggatttgcagatggatagagaagacgacgacttcccccgcaaaaaaaaaaaagagaagacgacgacttacaggagcttgcttggaggaaccaagatcctctgccatcggttctggtcctttatgttcggttgttaatctcttaccatgctgcagaatgtgtaaatcagaaagtgttagttcaacaaaagatcacacaaagataccacaaagtccaagctgcaagaatttcaaagggctccgaaggatgaacacgacgaccgaggttcgagaatttatcctgctctggcacttgatacaacaggtacaactggatgaaaacagggaggacaacctaatgtggaaatggaatgcgaatggaatctactcagccaactcggcctacaaaattcaattcactggaagcattcaggacaatcgtgttaacttcatttggcgagcaaaaacagaaaacaaatgcaagttctttggatggctcatggtccaaaagaaagttctcacgtctgacaaactccaaatccgaggttgggacaacagtccaacttgctccctctgtgggacagaaccagaaacagcgacacatctcttcatggattgccccttcgcgaaacaggtatggacaaacatttggttgaaactaggactcaacatgcctaggtcttcttccttcaatggaaacatgatggattggtgggaagcttgccggagagaaatgatcaaagagcagagaaagaattttgatggcctacacgacatgggggatttggctacaaagaaatgctagaatttttaacaatgactatggtacagtgttacatgtggttgactccatcatcaacatgtgcaaagccttcgatgaagcgcaaatcgtttagatgaaaaaacgcctacttttgttgttagtggctttgcactttctcaaagtgctgtaacctcctccaatgtaaaaatctgaagacacctcttggaggtgtccatgtacgtgaaactgcttctttctcctttaatgaataggcagagctcctgccattatcccctcaaaaaaaaaaagaatttcaaagggctcgtttcgcataaatgcaaggtatagattctaaataatttgtatgagactatgcacaaccaaaaaaaaatcctgtgagataaggaaaaggtacaaccaatgctgccttaaatttcattcagatgaaaaggtcaatacatctatggtaagcaaaataatttcatcagcaccacagtctttctccacaactcaacagcacaagagaatttcgctatgtttctagcaccgatatggataaagattataattcacatatagcagcaagccagcaagaacagaactctacaatgaaaacctcattgttactccatcaatttcatacttttatattataagtcgtttgacctttttctagtcaaacttggttaagtttgaccaaatttatagaaaatttggcaacatctaaaataccaaactagtttcattaaatataacattgaatacattttgataatatgtttgttttgtattgaaaatactaatataatttttctataaatttgtacaaactcaaaaaattttgactagaaaaaaaatcaaacgacttataatacgaaacgaagggagtacataaataagcacaaaaggggaatgccacttctttaaacaaaagggcgcatgttaataaaagaatggagtaagtatactgttagttctaatgattcaggctcagctagttctaaggattcaggctcagctaaaaaggagacatctcaaattaaaatggtggacgtcgtgtcttgaattttataaatgagacaggacagaaccgctcattggaatgaactgagaggagaaagtacctgatctttggtctctgtttcagtaatttctctctttactccgatgttgtgaataaggcttctaaaatgaaaatataacatgaggcagggcacataattatacaaaatttaatacagcttttaaaaaaaggaaaaatagataccttgctgagtgtcccgtaggtttgtgatcatccaacaccatatcagagtcagggtcgtgcctttcatctggatcctcttgatcttcatctggctgaataatgagcacatatgcacaggacacaaatacattcagtcagcccttgagttatcacttccaagacatcatttgcatgcttatattaggaagcctggagactcacctcaggtagctttgtttcaggaattcgctcttgaaattggacgctaggtgcatgttgaagttttgaaagattgtccagaatattgcattttatttcctccagttgcttgtttgtatttctgttctccatgttacttgctgcaacgtaaagactgtattctggaccaaaatattcataatactcattgtaaggcaacttctcctgtagctcttcaccaagtgcaactcctgtctggccaaataaaaaaccaaataaacaatcagaggataaaaccatagctgtagcaacagatgttcctgatataagactccagcaagcataaggcactgccattcgcacttgttcgccatgtttagcctgctgtgtgttcagatttataaattcacaaaaggaaacgaaagcaggcttgcaaggtccaaagagccaccagattttgggttgctaatttattaaacacacctttgatgaaagctaacaactgaggaacaggtggtggcctgaagcatataattttgcaagggttaacagttagctagtagcgttttccgggattcatcggaagtaataatgttaagcttgtctatgaaagctctattgtgccttgcctgatactatatctgttttaaaataaccaccctttaatgctttgagaaacacaggatgatttgttactgcacaagttctcacaaattaatgcatttgaatgaaacagagtagaaaataaatagattaagcattacatgtaaatgggcgataggtgttctgtgcatttcagtcatctgctcagcagaaaccaaaatcttagtttcgtgattgtaaaattacagcagcatggatcaataaacaaagccaggtagaaggtacagaccactatagaagacaagttcttgatgctgagcatcgaacacagttgaaacacaaagcaaattaggttctaacacattaccgagctcatggctttgctttatcatccataaacaatagaattaattgtatgttaaaggcacaaaggaaaaaaaaagcggggggaaagatatatatcagttttgtcttctgatcagattacatacctcgtaacaccagcagcgtgcaacatttcttatggtatatccaccaccaccaagaagaagcaacggaacattgaaagacctcatgaacttaacacattcagcatgacctttccctgagagattgaaacagcccaacctatcaccggacaacgaatcagcgccgcactgaagcacgactgcaccaggacgatacatctccatgactttgctgatgatcggcttgaagatggactggtagctgtcatcatcaattccatcatccagcgggacattcaggcagtaatacttcccttctgaatacccaatgtcgcggatatcccctgttcccgggaaataatccccaaacttgtgaaatgagactgtcataaccctgtttgttgtgtagaatgcctcctcaactccatctccatgatggatatcaatatcaatatacagaactcgctgtaaatatgaagacagcatattagtggtttagcacaagaagacaactagaccaaataggggaaaaaaacatctgatctgttttcaaactttcaactgttcatgataatctaggattgtctttacgcaacatccattcttcagatctgtgtaatcagtcacctcttgttctgaatacgtttcaatcaaatcaatctcttatcatgaatcgtccaatgaaaattctgtatgttgtactccctccgtcccataatgtaagcgattttgagatttttcttgcaacgtttgaccactcgccttattcaaaaatttttgaaattattatttattttatttgtgacttactttattatcttaagtacaacttttcgttttttatatttgcaaaaaaaaaaatttgaataagacgagtggtcaaacattgcaaacaaaaactcaaaattccttatatcggagggagtatatagctttaacagtatacatcatgggcaaatttaataacaaacacagcaagttcgtcgtcatatcattctctctctttggaacatcattatatcaactagaaatacatatacacattcagaatgattcatcaacgtacatgagcttttatccaggaaaacaaaaatctgaataaaattgttaatacataattctgcacgtgccaatatgccatactattcagacaatgtgtaatcgcgtaacgaatagtatagtatgagatttaagttgagcaaaaagttaatccaatttctgtctacagatagccatttcatttacatttacagatgattaatatttcctaccgatccaaaatttagcggaagatcgatcgaactgtacacaacaaaatcagagcaactggagagaaagaagtcaagatgatttttgcttccgtcttcattgacccacccaacttacacatcaagtaatctatctattcgaaaaattaaacaaaccacccatccaaatagtactactcctaatctattcgaaacattaaacgaaccaaaaaaaaacaagaaaagcagaaaaaaattgaaaaaaaaaaggaacacaggtacgagcggaataggatgacgtcacctcatggagcttgaggagctcgaggatggcgaggacgatgtcgttgacgtagcagaagccggaggcctcggacttcttggcgtggtgcaacccgccggaccagttgatggcgatgtcgtgggtgccgtggttgagcttgacggcggcgccgacggaggcccccgcgtaggtctggcagtaggcgtagaggccgtcgaagacggggcagtccgggccgatgttgaagcggcggagggcgcggacctggccgagctgggtctccggggtgacggcgcggaggaaggcgacgtagtcgtcggagtggaagcggcagaggtcgatgccgcgggcggggagcgggcggagcaccttcatcttggccggtgcgaggaggccgtagtgggcgagcagcgcgtgggtcatcctcaccccgtggggcttcatcgggtggccctgaccgtagtagtagttgcccaccttccggtcgtagaagtagcacacccgtcggttttgcgcgtccgcgcacgacgccgactccagtgagttgacgccgcgcccgccg

SEQ ID NO: 61587 - DNA, 35557 bp, Oryza sativa
aatggaagggtctacaagtatataagccgcatacagagggcagggaagacggctgtgtcaaacaatgggctctcggcgcctcgccgttttccctgtacaaaatcaccgattattaaaatttaaaatttaaatttaaattttaataattttatgaattttcaatgtatttgtttatatttgttttaagtttttaataacgcacatataaaaattttgctcataaattattttttaaatcgttaataagttgttttaacttgcaatcagctcacgatcaatcagtggggccctagatattccatgaattaccagggtcaaggctaatactccctccgttaataaatgtttgacaccgttgactttttagcatatgtttgaccgttcttattattcaaaatttttgtgaaatatgtaaaactatatgtatatatgaaagtatatttaacaatgaatcaaataataggaaaagaattaataattctttttttaataagacgaatggttaaacatgtttaaaaaaagataacgacgttaaatatttagaaacggaggaagaattgtttagtccaaagctaattataagtctaaagtgatagtttttttatatgtgtgctcttagtaaagtcatttctaaaatataaactataatgaagacaaaatcaaccctaaacttaagtgatattcgaattttggttgtgacacaagttgcaacacaaacgatggagcttaatttaatttcttagatagtttttttttgtttctgcagtggtggttaacatattttttatttgatattgcgcaaggtaaatacggcgcgcatgatggtattggaactataggtttaagaaatattttgcaactataatttcctatacactataataaaatcacacaatttctagcgcaaatcaataactttgtagcccatatttttggctgacaggtagacgtagagtcatagactaaggctgggttcggaacccctcctccccgacatgcacaacgaagtacgtattattggatggttaattaagtattaattttttttttgaaaaatggaataatttgattttttttaaaataactttcatatagaattttttttgctaaaaaacacaccgtttagcagtttgtaaagcgtgcacgcagaaaacgagagagatgagttgggaaaagtgggataagaactcagcctaaggctgtgttcgctgctacctcttcacaactcctctccctcgttttccgcacgcacgcttttcaaaccgttaaactgtgcgtcttttgcaaaaaaaatttctacacgaaagttgcttaaaaaatcatattgatctatttttgaaaaaaaaaaagctacttatcactttccttttctctctccctcccccctctctcttcccctcttttctctcgagacacccataggccagccatgccacgccctccaccatcagcctgatagtcttatcggacatgaccgtgccacttgtcgtgttgaaggcaccctacatgaggtagagcgctggggggatggcccgttgagacagcggcgctgctgagtcgcgataggatgcgcaaggaacacatccatatttgtcatcgttgccgtgatccatgcacctcggagacgcggctagtgggaggatgggggtggtcaaagaagaggagtgctatgcgagggcgaggcgggcggcggtgtagaggagtaggagtgggtggtggccgccaccgccgtagccatggcggcgaggagatatgtgtaaacggtcgttaagtactattataataaataaatagagaattaacatttcttacacatatatcaataataaataatatagttgtactaaatttgaagagctaacatggatatagagattatacaccaaagtaaaacaaaaatgaagccgtcatgcacacctccgatgaatcacgtacgagaccgtgatggttagaccaatcgactattcctaccatcagaaagtcatgaaccaaaatcaaattaaatttctgtacatagtatatgcatgtcagtgtaatgccttgtttagttgacaaaattttttgtccctgcgtgtcatgtcagatatacgaacacacgttttaagtattaaacgcagtctaataataaaacaaattataaattccgccagaaaactacgagacaaatttattatgcctaattaatccgtcattagtaaatgtttttattgtcgcaccacattgtcaaatcatggcgcaattagggcttaaaagatttgtctcataatttacacacagtttgtgcaattggtttttttcgtctacatttaacactttatatatgtgactttatatatgtgttcaaatattcaatatgacagtgaaaaattttgttttgagaactaaaccgggcccgacagatatgcatagttgaaattggagatcgatttagacagcgaacgcggagtgagttgaatgcaagatatatagaaatgcgagacgcgactggagtttatggaagacacagcaggagacttcacttccaatgtttgaaatggtacactttattgcctaaggccctgtttagttcccaaaacaataacttttcacccatcacatcaaatgtttagacacacatatatagagtattgaatggtacactttatactcaaactgaaaatcaacagtactgaaatttcagacaggtatatatggctcttcctaccatgtgccttgtatttatagacatcaggctgcagtcataataagtaaagactacatgataagaacactactacaaatatagtactactctggaaaacctctatattaaataacaagaattgagcatttctgatagtgctacattctatgggggcgctttttaactagcagcctctgggtattgggacagcttacagatacaacagtgccacaaatctgcattccccgttaccttctgtttgtgaccaaaggggtacacatggacaaggcacaaggccggaacaagggctctccgtgaactgtgtgaatggggaaattgggaaaaaggagccaggcagcagcagtacattccgagccgcagaattgcaacgaagcaaaactgattccgaagcaaaactgatggccaaaccatgcctagagtatcctgaccatcgagagaggccattggaggcttcttgtcgaggatcactcgccatctccgttgccaaaaactccgacgcgctgcctcctcttatcgaaaactgccctgaaggattcaccttcgtcacgaagttgttcgctgaatcgcttctttgtatcggtgttgattaccccctttgcctgcttggaattatcttcagccaaggggttggaaacctgcaagcaatgggaaaataaattgaactgcccaactgtcaagggaggggcttcctgcatgcattatctatgggtcttcctgtaccatgtggctaaagcaggaaaaacaaccatctaataaacctttcagaatcctaaccaaatatgagcatgaggatcttctaacttgcaaactaagaaagatgagtctgaggctatgttcgaattagatgttagggcttgtgcagcataaaaaacgagacaagtcattaggatatgtttagttaagtattaaatattataaaattgaaaaatatatttatttacagaaacttttgcacaaatcacaccatttagcagtttcaaaagcgtgccctctataagcaagtgccagtgcccagtagacgaaaagaatttgcttaagccttgttatttactagcatgggttctacttctacagcagcttcaaccgcgcacaaaaaggcctctgctacatcatctatgcttacaggtttttaagagccaacgtgctgccccaagccctcaactgtaagcactgacaagaatcaattttcataacattagcacttggagaatgaatgtaatttttttattgagtatgcagatgaagaagtttctaaagttaaaagtgttaaaatcaaagcatataattgttttctctacatcgcagagccttttagaacattgtctgatccattattaatgactctcatgacccacgttttctgcaagaactaggataagatggcaaagagatacaaggatagaggatcaagttatgaaactacgtagggcatgcagaaagattaaagactgcgaaagtaccaaactttagtaataagtcaattagaccactgaccaaattgtaccctgatccgggtcctatgattaatgaagaagtgagtcttcttttagctgcaccaatagaaaaaccacccttttctagctgcaaggaaagaacagaaaatatgggaggctagttaaatgatgcataccaataagaagttgcagaaggacaataagggcatcacttgtcctcttctttttataagtatcatcaaatatgtgtttgtaatactaagtgagcaatcaaatacgattagttatgtactccatcccataaaaattgtatttctactaatgcaggaccaagcaaattaattacatcaaaatatatttccttgtaatatccattccttccatcacatctctaacttgttgtttcaactctcaacattccttttaattaagtttatatatggaatgtgtgtatgtattgtgttcattaaataaggttattgtggtcatttgtctatcctactaatctgtccttaattccctagaaatacaaggtagttgtttaatagtgattggtttattgcaatgacagaaatataggccgctaatatttgatattaacaaaatgcaagaaaacaatgcattttttcccttgaagcaaaaaggcatacccgatctccccaggtaactgtttttcgatgcgtgctgtaggtttgagccaatccagaaagagcatgcgtacttccttctgcatggtcagacttctcggtatcctcatcaaaatcttttgaccatttactctgtcctagctctttgtagccatccaggtcgtcttcttctgacgagtcccacttcttccctgctcctgagatgtctaaacagaattttacaggtctgacttaacatgtccttaatactttcactaagaatccgttatagtgtttcttataattttaatgcttaaggataacttccaaatcaaactaacagtctgctactgctgatgcatgcactacaatatcagaacagtgggtccacattcatggtacagtgaatagtacaagtttactattattgatattcacaatggcagggtgtctgttgcacttatttaaccatctatttcaaacccacagtgcttgttttgcaggggatttgatctctccacatttcatcagtattgccaaataagtatttggttgtattataagtactaactaacacaacagaacaagaaaaaggctttctacatttatgtgtaaagtaacttacagtatttcctcatagttttgaaggtttaaatgttacaataaattgtggcaaaggaatgccaacactaatcactgaagaataataggaatctgtaccttgatcatgtccattatctagtgattcagacacagccttctgtgtgttttcagcttcagtactagttgctgtgttactggccccatcagtgtcttctgtctccatatccacctatttgaagtacaatagattttgagcacatagatctctttaagtgactggtagggtagggatatactgatatgggatacctcttgaatggaatgctcgcgtagattgtcatcgttgaataatgactaaaaatattaatacaaaacatgaaaaacacgattaatcatgtatctaatagcatgtcttaagtcttaaccgccaatcatatgaatactatcagaaaacatacatggatgtctagtcgaagatatagtggtggagcctcttcccagtctgctgccatcttgttcacatcatctactgtaaacccatgcacattcctagcagcacagccctgttgttcacaagatatcacatcatctactgtaaacccatgtacttactggaactgaaatacattctcagatgtttataatatatggtgtaaatattggtaatataactaatgggagtgcaaacaagattttttacagcctgatacatatatgaatcaaataaattcaatatgattttcccaggactgcctagatagcttatagttaagaaaacttactgttggatccttgtatggtgcctccagcaggtacacttcatagcctgatttctacaaaaggaatagaacagtgaacttactttcaaatgactaccaacaagataaaatgattcagagaataaaattccaaagaacaaggtataggaacagagtgcctcctgaaatggcaaggtataatccaacaaaatttgcacagattagtctagaagttacaatcatatgaaacggtcacttgtcatatgggcatatcatctaaattctaagaagtcaatagtgccattaaagtggaagtcaaagatgctttggaccaactgaagcatcaagaaccacacggatacacaaataccgaattcattttagcaactcgacagttgattcagggcatgtaaaacaagcagataaccaaaaacccttgaaaataaacgagcaaaaggtttatattattgggcaaaccatgtaatattgaaagaaagcacatatatgcagttaattgcatacagaaaccagaaatacagctagcgataagtctgcactaagaaacaaccaaataacccctctggtgtataggtacattcaattgcagcaaagaagggagagaagggtccaataaactggactgccttagtgtcttagtggtaataaatgcacagtgctattaattaaggctttgggacgcgaattcttgtaggaattatcaattccagcaggaataaagaaaaaaatggtttccaaacagggcattaatttatgacagttacttaatgctatgcctctcatactatccactacacatatgtcaagggggtgctagcaggataactataatattccctccttttcaaaatataaggcatgttttgtttcgttaggacaaggctgtgacccacaattgctctattaggatattatttatgtgatacagaagcataatcataattaagtgcttttgaatacgaatctaacaaattcaatttcgtgtcacaaaaattatatcctaatagagtaattgttggtcaaagtcttgtgctagcaaaaaaaatataccttatattttgaaacaaagggagtagtattaagagaccattaataaaaaaggaaagagaaaatagaagattcgtagtgtatccaagataagttaatagtgttttccagccttataatttgcactaaagtatgcttttcaagtgcaggccacctcttgttctaaggggagaaaaagcagaacccctcttaaggattcaaaaccttaacaaaaagctccaacaagcaatgtaaattctcacagttgacgcaacagagactgagagtttaccttcgcacttgcccaaaattgagcaaaatcagctacccgcagattgcggtcatccactaaaaacgggcagggataccagcaataaacaagtcagttaccacaaatccagcatcagccattgctaagaatgaaggcatcacccggtacaatgccattgtaggcctgttgcttaattgaatgtttcaaacagtacaaaacataaaccactagtacaaatggatgtcctgtcatcctcccaatgtctaggaacccattgcctatgtcctaatcccagaaaatggccaccaaacattgaacttaataagacaaagatccaatcatgaagaaaagccaatagattgaaataatatgatgtcaatgaatatatgataaagtttgcatagggctttttccgtactcaatgaaatttatgataaataatgaggcagaacataatcataaccaccaaagtaattaccaccaccatgaattaaatcattaaatcattaattcatcctaaagcaacaatatttaaaataactcataccaatcacaaatgtaaaattcccttcatcaagggtcttcttaaatgcgttcaacatgcttgatctgtacgtctgtccaataaagaagaaatttagcaaaattactacatcaaatgataaatagtgaaatacatgaaaaaaacaattactcatgctgcaattatcgaaaatgtgaatgatggacaatactcccatgtacagtatacagattccacaacagaaacacatctatgtgggttatgaagtatactgcagtctgggagatcatatcctttcaacatcaaaatgcccagtgctgcaacttctaggcgatgtgctctgatattgttatttaaagtaaacctggggaatgtgacatttctaaaggtttacattagttctaatgagtaaagactaatttttcaggcaaatgaaacagtttgccataacatagctccaataattggcaatagcattcataataaatgagataaaggaatgaagtcaaacaaaaactatttcatcacctcctccatctcaggctcataacagtactcgatcactttcttggtcagctgctttcttcctttggatgtactagaagattttgacccttcattgtcttcaactttctaagagcattaaaccaagttacaagacagaatacccatcaaataaaacagaaatgtaataagcaattctgagtatagtgtgacaaattagtgtacagggttcatgataggttctgctattcttcaactgaccttctcaacctcaatcatgaaatagtcatccatcgaatgaattctaggtgcatttccaccattctcaacttcaaggtcacgcaatgcctttgcaagatagctctttccactacctataaattgtaacagtggtaacacagatatatatatgaataaattcccagagtaaaaaatattgacagtcttgcagactattaaatcatgatcataatgcttgcgtgcaataagaggaaaaaaagttatgtatcaaaatcagataaaaaaatgttacgagcactctggacagtagacaatgtctacaatcttcatggtccaatttgaccacaagtttctgatcgtctactatgatatgcttgtaaaatgttacaagaataatagcactatgaaagtatttcaaccattggtttattattgatgttattttagtagtttgatcaatataaatgcctctattaagatcatgattgaagtcagatgaagcagtgtgcatttctagaaacaacatatatttatgaatggaagagtagtaaaagagcttatcatgtgtattgttttgtgaactgaaaaaataggcatttgataagtataaaagaaacatcagcaactcccaggtgttatatgcagagaaggtcagatcaatctcaacaaacaacaggtacagtaaagctaccacacaaaagatgaacgctttttgaggcatagtataacaaaattagtctaaccaagcgctgtggccactggctagcatacaaaactgtcaacagtgtcggcaatgttctttggaatgcttaatcagccatatgggacataaaagtggttgtgagaaaacctggcagcccacggaggatgataacaatatgatcaggccgtgacccacgaagtggctgcttgaacaagtcacaggcactaattacactgattttagcattgttgatggaatgctgagcttgggtttgccttccacctcctaaatgttgctctaagtgtggttgatatgccaaacctggtacctgaaacattcgtacaacaacaagtactgctttctgagtgcccgggaaagtattgaatcataaccagtgaacacaagttcacagagagaagaagataaacctcattgtggataggtccattgtaacgatttgcattaggcatcaggtgagcttgatgcaaagtatgagaactaggtgggcgcgcagttgcggctggagaaccggaatgaataggaaacaaagatgatttcacagcctgcaaaggtggcttggcatggtaatctgaggaagacggtacaggaggctccagtggtggtggtggtggtggaacatccgcctcaggatgccaaccgtgggaatcataacggcttctcgcctcagggtatcgagccggtggagggagcggcggcgcaacaggcgattccgagcgttggaagcgattgtagcggtgatcatggttgaaatacccctcctgaggtcctccaggcacaaaacttgaacctaaggcggcaagcctttcatgcgcaggtggaaacctcccggcgtgctcgtaatcgggaaaactgccttcatgcgcatagggattgtcataatttggaggaggaggatagcctctccctcctccatagccgaaccgatcaggaggtgggtacggttcgccgtgcaacatcccaggcggcggcggaaacggagggcggccgtgatcccggatcaagccgagcagccggtcgccctccacgggaaccatccccggcggcggcggcgggggcagcgggggaggcatcccgtcgccgtacggatcgcccacgcgcatccgcttgtggggggcctccatgtcgaggacctcgtaggggtgcggccccgggggggcccacatcggcggcggagggtggaaggggacgtgatactccggcgggggaggaggaggaggaggagggtggaagggggcgttgtactccggcggaggagggggcggaggcgggtggagatcgtaggggaaggggtggggcggaggcgggcagaaagggaagtgcggcgcggcgcagaccgggcagagctcgtcgccggcggggaaccgccatggatggtccatgggggagatggtggcggtggtggtggccgaatggggttagggatctagggttttgggggaggaggaaggatcagggagcttcgagaagattcgagaagcttccttcctgggcttggggtccgcgggggtggacggctgcggcgccgcccgcctcgtctgggtagccagaaaaagcctatggaaccagaagggctatattggaaattgacgtcgtgcggtgccatggttattccgttttggttgttttgcacgtataaccctcccaggttcttaatttgtaaaagagggctgctcgagaggacaagcccttgtgaaatgataccgtgaaaacaaagaagttgttcaatagtactggtagaaaatgtacgagcatagacatcaattgcgatgttttaggtgtgcaatgtgtgaaaatgttactgtaggagacaacgatttcatattgattggctatagctgttgtggctagtataattgtgctaccgcctgccgccaacatatgaacaatctaaagaagaaaaagtcgtaatagcgttgtaacgttcaaaattagttctttttgccgaagtatctttgctactatgatgcaatgcttatatttttgaggaaacccacttagaattcatggttttttacttgtttaagctagtttgaattagtatattctgtaatattctacaaaatttgagcgaaagcaatatatttggacaaattgtgatgatttgatgaagatcacattctaaaacaaacaatcaaatatacatggttgttttgttaatattataaattctagtgttaccaaacaaatttcaatacttcctctgtaccgtaaagcatgacgttttaaggtttattacccagattaatgtctactaaaaatgaccaatttaccctcattaattcaatttagctctgatgtgcatgcactctagaaggccccacagaataatagatattgcagttaaatagtaaacgaagcacaccttgactaccacgtgggatttgcataaacacattagagccatggccataaaaattacacatgagaaaacaaccattaccatagtttaaacatttgaattagcctatgtagtatgtgctttggtgcctaggaatgcccgtctatttctgaaagtgggccacttctttgattatggccaggacgatatttttcctgggacattagttggacgggccgggggaacgtccaaacttttgggataacatactttctccgtcccataatataagtgactttgaggttttgcttgcactgtttgatcactcgtcttattcaaaaattttagaattattatttattttttttgacttactttattacccaaagtattttaagcacaacttttcgttttttatatttgcataaattttttgaataagacgagcggtcaaacactacgagcaaaaactcaaaatcccttatattatgggacggagggagtagtaacaatattcaacttgcttcaaatcaaatactcctcttatacttatatgtaaattgaatatattcactgacaagatgcaaaagtatctagtatatgaaatttataacttctgcagccccataactgcaaatttatctccccgttcgaagttcccacgcgaaccgttgccgtgccgccgccgccgccattgacgccatgggagcagcatctccgcgagctcgctcgcgtttccaatggcagacgccccgcggccaccatcgcctcctcctcgtggaaagaaatcatcagagctcgtctccgacaagaaaccctcaccgcctactcctccagcctccgtcccgccttcacctaaccctgcttgctcaaggccttcacctagtcgagctccggcccgggacgaagcctccacgatccaggtccacgcccgcctcgccaattcgggctttctcctcctgcgcctacgctacgagctggcgccgaactcgcgagctcctccgcctcggggtcgcgcgcagggtgttcgacgaaatgccgaagcggaccgtcgcccgcttcaacgccctcttcgctgggctcgcgcagcgcggggaagctgatgaggcgaggcgcgagtcttaagcccctccgggaagaagggttgccagccaccgagctctgtcatggctgcctgccttacttatgcggtggtcaagcacggggagcagttgcattggcttggcttgtttgaattgctagcgttacaatgcgatggattctgggttattgaggaatgatgagcacaccatgcccttggatactgttggagaaatgatatttgggttcagtgaagaacctaatgggaatgatttcgctggtgttctcagcatgcacaagtttgtcagcattgtcacttggtaaacacctgttgtcatgtatgcaaggtgcagttagtgcttatcggcttttatcagccgtggaggaacaaagcttggtgtcttggaataccatgatctcgggttttctggcacacagggttgttcatgataaacagaaggtttcaagcctgagtgccggacagttttacatggaacctgatgattaatgggtctgcagactgtgcacaccacgggagattgtccaggtcttttcatcttttagtaagatgcaaatggagggtttttcttttcctcgagaaactggcaggagatctgccttgatttatattaagaagaatatcaactgagtaggttcaaattacgtgtcctgatacaagaaccgaaagaaaacaactgttaggatctaattgatgtacataaatttctgcaggttaattctcgtcggcagagattggcaactccatctgtgtgatgttctgaattgccatgaaggcgatttgcagttgtctttctgttgctgctgaaagattcttctgttcctctccagccaaatattctgaaaaaaaacaatgacaagtgtgccgaatgcttgttcagccttatcaattttttcggcaatgctgggagttcaagtatgatgttttccaaacaacagcaattgacatgtttgttgctaatcatttactttcttctacctagtttgatcattaatggataatttttttatatatttattggtttacatttctttgtattttcttggcaggaaagttgtttccaggttgcaacactcaagagtaggaatgtgcatgaaagcctggtcattgcggggtgacatttgatttgaatttgcaccatccttattccctcgcaagtaaagatggtgccatggtaccaaacattacagttccacaatatcaagaacctgatattaggttgatatgctgcgtacctgtgttaaactctcgtagtgaccttgtgccatctcagcagaattagttttgagcttgcattttgccgcaaagccatgatcaagattgaccctgtggtcgacacgtgtcaagtggtgggagcaaagaaccacatgcactgtggaggcctagaggttcgcactgtgagtgccgctttaggcatcactgagaatgcaagctggagatggagaagttaaaatcaaatttgtcatcttttgcgagctgatggtcccttgtatcagtggaggatgagcccactggttttgctgggaatgttctttttgcagaatattttagtctgcgccgtagcgtgtgatctgctgagtagaatatactgcttgtactacttttcttagccacagtaatgatagaactgtaaggatttggtggatttacctgtagaatttcatagtaatcgacaaatgatataatcggtaattaaatggccttcaaaatcgatagtgttgtctattgtcgcatataacattataaaatgtacgttttataatgtacaagatgagtgtactgtatcttttacacgccagccatcggtgctaactcattttgatctgtgaacttaaggcaaacgaatactcgtaaaccttttctatataagattaaacctagaataaggttaacaaaaattgtagttagttatgctgcaactttagcatgatattttagttaatgcaaccatctttacatggttttttttatatagaattgtaacttaaaacgcaacgttttgcccgtgacaggtatggcatattcgtcaaactttatcatggaattgtaaccttggaacgttgggtcaagcttcaacacacatatgacatactcacggtttcacgcagacatagagtagctgtgttcttttgttggtgttggtaactaatcccttgcttttgttggtgttaggaactaatctctgatctctggtgcatgtaaaacggagttattaaacacatgactaattgcgtattagctatttttaaaaaatagattaatataagtttttaaagcaacattcgtgtgtgtatgtgtgtgtctatatatatatatatatatatatatatatatatatatatatatatatatattaaaaaaacacaccgttcggcggttgtttgagaagcgtctgcatgaaaaaggagaaatgtgaggtgggaaatgaggggaggaacacaaccttaggccatatttagttcctacacaagaatttttaaccctgtcacatcgaacgtttaaacacctgcatgaagtattaaatataggctaaaaaataactaattgcacagattgcgactactttgcaaaacgaatcttttaagcctaattgctcaatgatttgacaacacggtgctacagtaaacatgtgctaatgacagattaattaagcttaataaatttgtcccgcggtttactgacggatactgtaattagttttttttattagttcccgaacaccccatgcgacaccctatatacccgatgtgacacgccaaaactttacaccactggatctaaacacccccttagtctaaatctacctatcagccaaaaacatgggctacaaagttgttgatttgtgctagaaattgtgtgatttattgtagtgtgtagaaatttatagttgtaaaatatctcttgaatgccaataccatcatgatcgccgtatataccttgcggaatatcaaagaaaaaaaataaagctatgtgagccacccctgcagaaacaaaaaggaaactacctaagaaattaaagctccatcgtttgtttttcaacttatgccacaaccaaaattcgaataacacttagagttgattttttctgcattatagttatattttagaaatgattttactaagaacacatatataaaaaaattatatcattttagacttatgattaactttagactaaattatattagccttgaccctgataattcatggaatatctagggccccactgaattgatcgtgagctgattgcaagttaaaacaatctatcaacgatttaaaaaataatttatgagtaaattttttatacacgtgttctaaaaaacttaaaacaaatataaaaagaaaaattgcattgaaaatatcataaaattacctttaaatttaaattttaaattttaatgatcggtgattttgtgcagggaaaacgacgaggcgccgagaggcgagagcccattgtttgacacagccgtctcctctccatctctccgccccctgtatataaacccccccttcccctcctcgcccatcgcggcatcgctcgcctcctctgcttcgcttccttctccagcaagcacccgaccacaacacacacgcgagctcctcgacctcgagagagagagaaaacccaaccccgaattcggcggcggaggcggaggcagcggcgatggacccctcgtcggcgggcgccggcggcaactcgctggcgtcggcgtcgtgcggcgacgcgcagaagcggcgggtgtgctacttctacgatccggaggtgggcaactactactacgggcagggtcacccgatgaagccccaccgcgtgaggatgacccacgcgctgctcgcccactacggcctcctcgccccggccaagatgcaggtgctccgcccgctccccgcccgcgaccgcgacctctgccgcttccactccgacgactacgtcgccttcctccgcgccgtcaccccggagacccagttcgaccagatccgctccctccgccgcttcaacgtcggcgaggactgccccgtcttcgacggcctctacgcctactgccagacctacgcgggggcctccgtcggcgccgccgtcaagctcaaccacggcacccacgacatcgccatcaactggtccggcgggttgcaccacgccaagaagtccgaggcctccggcttctgctacgtcaacgacatcgtcctcgccatcctcgagctcctcaagctccatgaggtgacgtcatcctattccgctcgtacttgtgtttgttcgtttttttttttgggttcgtttaatgtttcgaatagattaggagtagtactatttggatgggtggtttgtttaatttttcgaatagatagattacttgatgtgtaagttgggtgggtcaatgaagacggaagcaaaaatcatcttgacttctttctcttcagttgctctgattttgtcgtgtacagttcgatcgatcttccgctaaattttgatcggtaggaaatattaatcatgtgtaagtgtaaatgaaatggctatctgtagacagaaattggattaactttttgctcaacttaatctcatatatattcgttacgcgattacacattgtctgaatagtatgtcatattggcacgtgcagaattatgtattaacaaatttattcagatttttgttttcctggataaaagctcatgtacgttgatgaatcatgctgaatgtatgtatgtatttctagttgatataatgatgttccaaagagagagaatgatatgacgacgaacttgctgcgtttgttattaaatttgcccatgatgtacactgttaaagctatgtactccctccgtccaaaaaaaaaaagtgaatctaggactggatgtgatatattatagtacaatgtctagattcgttgtactaggatgtgtcacatccagtactaggttggttttttatgggacgatggagtacgacgtacacaattagaatgttcattggacggttcatgataagagattgatttgattgaaacgtattcagaacaagaggtgattaatcagacagatctgaagaatgtatgttgcgtaaagacaatcctagattatcatgaacagttgaaagtttgaaaacagatcagatgttttttcccctatttggtctagttgtcttcttgtgctaaaccactaatatgctgtcttcatatttacagcgagttctgtatattgatattgatatccatcatggagatggagttgaggaggcattctacacaacaaacagggttatgacagtctcatttcacaagtttggggattatttcccgggaacaggggacatccgcgatattgggtattcagaagggaagtattactgcctgaatgtcccgctggatgatggaattgatgatgacagctaccagtccatcttcaagccgatcatcagcaaagtcatggagatgtatcgtcctggtgcagtcgtgcttcagtgcggcgctgattcgttgtccggtgataggttgggctgtttcaatctctcaggcaaaggtcatgctgaatgtgttaagttcatgaggtctttcaatgttccgttgcttcttcttggtggtggtggatataccataagaaatgttgcacgctgctggtgttacgaggtatctatactttcccccgtttttttttccttatgcctttaacaaacaattaattaattctattaattatggatgacaaagcaaagccatgagctcggtaatgtgttagaacctaatttgcttttgtgtttccactttgttccttgctcagcatcaagaacttgtcttctagtagttggtacctactgcctggctttgtttattgatccatgttgctgtaattttacaatcaccaaactaagattttggtttgtactgagcagatgactgaaatgcacagaacacctatctcccatttacatgtaatgcttaatgtatttattttctactctgtttcattcaaatgcattaatttgtgagaacttgtgcagtaacaaatcatccggtgtttctcaaagcattaaagtgtggttatttttaaacagataagtatcaggcaaggcactgctagctaactgttaacccttgcaaaatcatatgcttcaggccaccacctgttcctcagttgttagctttcatcagagatgtctttaataaattagcaacccaaaatctggtctctttggaccttgcaagcctggtttcgttgccttttgtgaatttataaatctgaacacacaacaggctaaacatggcgaacaagtgtgaatggctgcacttatgcttgcttgagtaaattatctcttatatcaggaacacctgttgctacagctatggttttatcctctgactgtttatttggttttttatttggccagacaggagttgcacttggtgaagagctacgggagaagttgccttataacgagtattatgaatattttggtccagaatacagtctttacgttgcagcaagtaacatggagaacagaaatacaaacaagcaattggaggaaataaaatgcaacattctggacaatctctcaaaacttcaacatgctcctagtgtccaatttgaagagcgaattcctgaaacaaagctacctgaggtgagtctccaggcttcctaatattataagcatgaaaaaaaaagatgtcttggaagtgataactcaagggctgactgaatgtattcgtgtcctgtacatatgtgctcattattcagccagatgaagatcaagatgatccagatgaaaggcacgaccctgactctgatatgctgttggatgatcacaaacctatgggacactcagcaaggtatctatttttcctttttctaaaagctgtattaaattttgtttaattctgtgccctgcctcatgttatattttcatttagaagccttattcacaacatcggagttaagagagaaattactgaaacagagaccaaagatcaggtaccttttcctcagttcattccaatgagcggtgctgtcctttctcattcataaatttcaacacacgacgtccaccattttattttgagatgtctcctttttagctaaatccttagaactaacagtatacttactccattcttttattaacatgtgcccttttgtttaaggggctattgcttatttgacccctttttgaatcctaactaccaatttgaccctactttttagagtttacttatttgaccctccttttcagaaacgaagctcccgtctgaccctgtttccattagtccgttaagttttaatttaaaacaaaaaaaaagaaatacaactaatattcataatacccagaataccgttagaaaaccctatgcatccaccaaaccctatccacatttctctccttgcggcgacggcggcgacttgcggcgagacggcgagccggtgccgccaccccctcagatcggcgccgccctggtgacgacgacgatgagccggcaccggccctagtgacgacgacgatgagctggcaccggccctagtgacgatgacgacgacgaggagtggcggcggcggctcatcgacgacgaagagccgaagccggcgccctgctgacgaggacgaggacgacgacgaagagccggagccggcgccgccaccccctcagatctggcgccaccgccgctgcgtcctccctccttccgcacgcttgcgccagcgccggccccctcccccgcctcctccctccttccgggcgcttgcgccgctgccgccgtcgccacctcctccctccttccgctcgcctgcgccgccgtcgttcctccctccctccacgagccaggacggccgctcgccccctccgtgcgcccccgccgcaactcaccccctccgtcagccgccgctgcctccctccgccccctctccctcagccccctcaaagcgccgccgccgccggcccatcagtcgccgccccgtggaggagaggagaagagaagagaagagagaagagaggagaggagaagaaggaactgcgggtgggtcccacatgtaatagagtcaaatgagtaaggacaaaagagacattttgtgcttcagttaacaccgttagatgcccttaacagaacagggtcatacgggagcttcgtttttgaaaaggagggtcaaataagcaaactttaaaaagtagggtcaaattggtagttagggctcaaaacggggtcaaataagcaattgtcccgtttaaagaaggtggcattccccttttgggtttatttatatacttgctccgtttcatattataagtcgtttgacttttttcctagtcaattttttttagtttgtccaaatttataaaaaaatatattagtattttcagcataaaacaaacatgttatcaaaatgtattcagtgtaagatttaataaaactagtatggtattttagattttgctatttttttctataaatttggtcaaacttagttaagtttgattaggaaaaaggttaaatgacttataatatgaaagtatggaacgtagggagtaacaatgaggttttctttatagaattctgttcttgctggcttgctgctatatgtgaattataatcttatccatatcggtgctagaaacatagtgaaattctcttgtgctgttgagttgtggaggaagactggtgtgctgatgaaaacatgtgctcatcatgtattgacattttcatctaaatgaaatttaaggccgcattggttgtacctttttttatctcacaggatttttttttgggttgtgcataatctcatccagattatttagaatctaccttgcatttatgcgaaacgagccctttgaaattcttgcagcacggacttgcatctttgtgtgatcttttgttgaactaacactttctgatttacacattctgcagcatggtaagagattaacaactgaacataaagtaccagaaccgatggcagacgatcttggttcctccaagcaagttcctgtaagtcgtcgtcttctctatccatctgcaaatccatagcacaaactctgcattgcataatgcctatatggatatagaattatccaacaccatggtttaatctgctctaacaaatcttttcatcttcacattgcttatcaacgatagactgcggatgcaaattcgatggccatcaacgcgccaggcaacgccaagaatgaaccgggaagctcactatgaactaacccacttcaggccaccagctcttatgccacggattcctgcatgctattagttacttactccgaggtgttgtatgactgtttcttctgtaggagtttacaaattacaactgtttcttttgttgaagaattccaaagtgtccaggcaatactggacgtggagacattagtctgatcaatgtactgcagagtacagaacatgtaacatgaaccaagttacagtgtatagtcttttagactgttagatggaactttcaggcgaaatgcctgtgcctacttgtgtgtgctctctgttggttgtttttcgttaaaatattttgttccggtttatcatgtacttcctacgtttttatgtatgagttgttttaaagagacaaataaatctattttttaatttataatagttaatacttaattaattatgtgctagtaaattttctcgttttgcgtgcgctgaaaatatcattttatactattgaatagaacggagctttagattgtgtcaatttgattgaatatagtcaactatttagaagcataatcagtggagacggaggtgcggttcagagattactgttaaaccaaccaattaatggggttcagagttagatctacacttgcaatgatgagaaagggaattgcttctatattattaatgtagactctgataatctagagagaatgaatgacttctatatgattaatgttgactcggataatctatctagaagatggggacttcagcagtataataagtgcaggttcagcgatggaaaaacaatatatatacaaaaaaaggttcagcgatggtgaagcaaaataaagatattccgatcgagtagaagaactagatggtaactaaaattacttttgatgtggtcatgagagcatatgtaagattttacttgtattatgcatgcaccagggaccaagattcatactgataaaggaaactatccctttagaaaatatattatataaattattttttgcggggaaatatattcatattattgataaacgaaactgttaggaaacgataaccgaacaaacgataaaaaacaatagatcaatcacagaagacacgagatttaacgtggaaaaccctctcaaaacaggagagaaaaaaaccacgggcgccaaccagcaaaatatcttcactatatctaaggtgaggttacatcgccgcacggcgacttacaagaggtatatatatagtggaaccttaaaagggatgacgatccatatcgctccgctacggcagaagctggcctttattaagtgcaaatgaatttggatcacaactcaacaaactccaccttgagacaaattccttcttgtagcatgaatcaatccttcaccctgaacacaacaaagacaaaaaacactttcggcgccaaatagcctctcgggctaaaccactataccaactaagcttgagcaaagctcaaacttagcaacaggaacatgctttgtcattatatcagcaggattatcatgagtacttatcttgcatacctttagcttaccttgcgcgactacatcacgaacataatggtacttgatatcaatgtgctttgtcctctcatgaaacatctgatctttggtgaggcatatagcactttgactatcacaaaacaagttaatgcaagaatcaactccacaaagctcagcaaacaatcctttcaaccaaactgattctttacatgcttcagcaatagccatgtattctgcttcagtggtagactaggcaacaacaggctgcaatgttgccttccaactcacagcacaactactaatggtaaacacataacctgtgagtgaccttctcttatccaaatctgcagcaaaatcagaatccacatatccaacaagccccttatcagtcctgccaaacttcaagcaagcatcagctgtacctctgagcctgaaaatccactgaacagctttccagtgttctttactaggattcgccatgtatctactaaccaaactcatagcatgagataaatctggacgggaacaaaccatggcataaatcaaagaaccaacagcactagaatatggaactctagacatgtattatacatcctcatcagtactagcacattgtaaagctgataatttaaaatgaggtgcaataggagtactaacaggctttgcatcatgcatgttaaaacgctgaagaaccttcttaatgtagctttgctgactaataaataacaaaccagaatttctgtctctagtgatttccatacctagaattttcttagcagcaccaagatccttcatatcaaactcactactcaactgtttcttcaatgtagtgatttgttccttgctcttggcagcaatcggcatatcatcaacatataacagcaagtatataggtgatccattaacaaatttaatatacacacagctatcaaattcagatctcttaaagccatgtaacaacataaatgaatcaaacctttcataccattgacgaggagactgtttcaaaccatacaaagatcttttcaacttgcaaacataatcttccttaccaggtactatgaacccttctggctggtccatgtatatctcctcctcaagctctccatgtaaaaatgctgtcttcacatctaactgctcaagctcaagatcatgcatagcaacaatactgaagaatgtgcgaattgaactatgctttacaactggagagaacacatcattataatcaacaccagcaatttgactgaaaccttttgctactaaccttgccttaaacctcggaggctcgctaggagataaaccctcctttctcttgaagatccatttacaacgaacatgcttcttctattttggcaagtgcacaagctcccatgtgccattcttctcaagagactgcatctcctcctgcatagctgagatccacttctcacagtctccagtaacaacagcttcagtgtatgtggctggctcaagagtattctccacctgttcagcacaactaaaagcataataaaccatatcacattcctcaataagacggactggagctccacaactcctctttgttctgcgatgggcaataggttcatcttgtggctgcaaaacaggaggtgagtgttgaacagtatcattaacatcattaccaacaatttcagtttcctgatcatccacgtgctccacctgcacgctaacatattgctactcctcatctgaaccacctggtatgacatctgtgggcaagctgtcattaaacataacagattcattgaaaacaacactcctgctcatgaaggtcttgttagtttcaggattccataacttatatccttttactcctgaaccataaccaagaaatagacacttaatagctctaggctctaattttccattatcaacatgagcataagcagtgcatccaaaaattctcaactgtgaataatcagcaggcttaccagaccatacctcaatgggcataccagaccatacctcaatgggagttttcttattaagtgggatagaaggcgacctgttgatcaagtagcaggcggtgttagcagcctctgcccaaaaacgcttgttcatgcgagccttggagatgatggttctgttcatgcgctcagctacaccattctgctgtggagtgtacgggatggtgtgatgcctaacgatgccttccttcctgcagtaatcatcaaaagcatccgaacaaaattcaccaccattgtcagtgcgaagtacttttacctccttttcagtttgcctttctatcataactttccactccttaaaagcagcaaatgtatcatctttatgtttcaggaaataaggccacacttttctagagtaatcatcaataatggtaagcatataatgagcaccaccaagagagggcttacgagaaggcccccacaaatcagcatgtacataatcaagtatacctttggtgcgatgaactgaggtattgaattttaccctcttgtgcttaccaaaaacacagtactcacagaacttcatgttaccctgagtgcagccatccagcaggttcctcttcatcaattctgccataccaagttcactcatatgtccaagacgcatatgccacaggttagtcttactaggttcatctttagaaacaacagcagcggtaacagaaccatgtaatgtacttcctctaaggacatataagtttgcagaattcatatcaccaatcatgtaaacaagagaacctttcgatacctttacaactccacctgaaccggagtatttgtatccttctgcatcaagtgtgctgagagagatgagatttctcgccatccctggtatgtgtctcacatctttcagcgtacgtgtcatgccatcatgagtcttgatctgaacggagccaatgcccacgatctcacgtgggttatcatctcccatgcgcacaacatctccattctgcacagacttgtaagaactaaaccaatctctgttaatgcagatatgaaacgaacatgcagtatcaagtatccattcatcatgactagcaacacaaccagcaaaaacaacaagacaatctcctgaatcagagttttcagcactagtaacaacagaggccttaccatcagatttccttttctccttattctgcagcttccaacattcttcaatgaagtgatttttctttttgcaatacttacagaactttttacctctggatttagaacggcctctactctgactcttgtcacgatcattgctgacgttgtaggttttctgctcagatctgcctctgacctgcaatgcttcgcccttagaggacgacgcatcagactaaaccatacctttcatcttctccctgttttggagcgcctcataaacttccgctagggttagttcatcacggcttaaaagtatggtgtcacgaaaatttgcatatgaactaggcagtgagcataacagtaaaagacctaaatcttcatcatcaaactgtacctccatcgacactaggtcggcaacgatctccttgaagaccacagaaccactctcctgcaacttgtgcgagaacaacttcatcttgatatgcatcttactggttagatctttagacatgtagatcgattccagtttgagccaaagttctgcaacagtcttttcctgcaacacttcttacaaaatatcattagatatatgaagttggatcagcgacagagccttacgatctttccgcttctcctcagcggtccattcagtcgatttcttcttcccgaagctttccagcgcctcatcaagatccgaagtttgcgccagaacagcctgcatcttgacttgccacagcgagaatctcgtcttgtagtctagcagcggtagatcatacttcatcgacgccatcgcgaaaccctaatgtgggaacaagctctaataccacttgttaggaaacgataagcgaacaaacgataaagaacaatagatcaatcacagaagacacgagatttaacgtggaaaaccctcccaaaacaggagagaaaaaaaccacgggcgccagccagcaaaatatcttcactatatctgaggtgaggttacatcgccgcatggcggcttacaagaggtatatatatggtggaaccctaaaagggatgacgatccatatcgttccgctacggcagaagctggcctttattaagtgcaaatgaatttggatcacaactcaacagaaactatcccttttaaaaaataaggttcatacagagaaacgaaactatcccttttgaaaaaaggaatgctagtaggtgaaatgaagaaggttgtacggtcttgtgaattagattatcagtctcttcctcggtacagcacggcccaacaatcagaagaagggagcgaaaataggcttattccagccattagacacggtccaaagagatgagataggtaaaataggcttatttcagctatataagacacaactcaagagaagcaaaatagactttgtcagtgatatgggcccgggggtatcatgtttagagggaggaggctgccccccaatgccacgtggccctcccccgaggggagtcaggcccgaggtggggtggcggccactcctacatagactagtcggaggaggctgccccccaatgccacgtggccctcccccaaggggagtcaggcccgaggtggggtggtggccactcctacatagactagtcggaggaggctgccctccaatgccatgtggctctcccccgagggggatcgggcccgaggtagggcggcggccactccttggccgagactagagggagaaggctgccccaggcaccacgtgatccttccccgaggggggatcgggcccgaggtcgggcggcgaccgccccctcccgtgactaggggtcgggctcccccgaccccctctttaggtcaccacgtacggtgggttaggtgtccgcctccaggtgcccacctacccgcattaatggtgacccgagcggtcgcgccacgcacgcatttaatgcggtgtgcagtgcactcaacaggtctgtgaccggtcgaatgactgatgggatccagaatgtcaggcgcaccatcgcgtgtgtcaggcgacgtgcagcccgacatatcccatcaaataataatggtgagaggttctcatcctcttattccagtcggagtcggtcctcctgctctggtcaaagcaaggctcccgtttcctggtgtaataggagcccagaagtcttcacccattaaatggtgactgacaggggcaccccccgtgtcaggcggcaagatttgacaggccccatcatcaagacgacgtgcgcttggcttcccaagtcaagagacaagacatgcatttaatgcaaagattataatacttctccaccggagctaggttgggttgttgggcctatgtggtatccccttgagctataaaagaaggaccctgcccactgagatagggggacgactcccagaaaacccgaactcgagaagagaaggagcaggtgcgctctctggggaagaaacccttataaaactcatccataatcccaaacacaggagtagggtgttacgctcgatagcggcccgaacctgtataaaccccttttgtctcatcgtctttgggggattgaaccccctcaagatcacacagcttcgctcaccgaatcctcgaatctcacccgctgctcctggccgaactcacaaaggggggcctcacgattccctggtggagaagttcattctccgacagacttatttaaggacgagcacgtgaaccgattatgcattcagaccagcacggcatgacctgagccttattggactgtaggtgtagcttgtggaccggcacgacatgacaagtcggaccgactactctcgggtggttccggcccgactactcttgggtcataccttggtcatggtgggcggcctatttaatttggccatctataggatgcccatttccaacacaaggccgcgcgcaccaccacctgtgtcatctcctgcgtcatcgccgccaccacctaggagcccatcctcgcgtcaatcgctcatttccggtcgcgacctcgatcaatctccgatgcgtgatgaactgatgatgaacgatgatgggaggcagctaggatgtcaacgtgcttgcctcactcctgatcgagcggctcatcatgctcttctcatgtggcttctccatgctaataaagattgagctcgatatagatagccataaggtctgaggtccgacggcccggcccaaggcacgatcatttggcccggcccaagcacggcaccgtccgattggtgtcgggcccgtaccggtatgacccaacagttgggccatgcctgggccgatgccttggcacggtgggctggcccggcatggaacgatcgaagaaaaatagtagaggatccaaaatagacttaatcagccatataaaacaacatccaaagagaagaggaatacaaaatagacttattttctagccatatggacacagcccaaatagttgagggagaaaaaatatacttattctgtggagagtacgataggctgtctgacctttgggtcggctcggcacggccccaacttattgggccgtgcgtatagcccgtgggctggcacggtatggcactacgtgtagatcgggccgtgccggcccaactgccctcggcctaggcccggcgatgccggcggcccatttggccatctgtagagctcgagggcattggatcaaggggaagagagaagataacttagagagagaggggaagtgaaaagtaaatgaaggaagaatacaatgataattttgttaaaaatttctaaaatgaattgcagtcatatctttaatatttattaaattgtaatggtacggtttgaatttcacgagttgtaatactttgttttcaaaacggataaatttatattggtatgaatctagttaactcgactagatatgggtatttcaactttcggagttaagtagttttttcaacatttaacaagtacatttctacaacttgttttcaacatttgacagcaacaaaaatataagatattttgtgttatctcctgccgctgctgtttcgaacttcggcaagttgcagtacaaagtcaaccttggcgcgcagcgcgctggtggtttgtgaccaaaccgtgatttgttcctttttactacattcccatagtccttaattttttaataaaataaataatcaaataaacgttcaaaaatgaataataccgtatatttaaaaataaaatgagtattacattctagcgtctctcgtcggtttcagtggtgctagagtctattcttcaagaagaccatctctagtcatttgctggcggcctggcgctgctgcttttaggggtttgctgggagtttagtggggttccgcctcctccaccctccctcgatataggagttttttttctctcttttaagtagtggagtagttccttaactttcggtggtctttttttttcagttttttcttttttttcctatgctccattaatagccttttattcatttatgttgtataactattcttttaatcacgtgtaatatttttgcatgttcaataaaagaaattacatagtagcgtcattgatcagctaaaactgctacgtagtcgattttggctttggaccagtggaaaaaaaactaaaagctaataattgagttactaatgtcactgtctgataaaattaactctgcatgctgaaggtcttgtgagcttctgttctctactttattcaattacagggtctcctgaaataaaaataaaaagataaagaagatcgaggtggggacatctctaatcagggagcatgaaacctaaaagtcttggccttatcttttcggtatatttatacttatcagtcaaatttaaatttttaatcttaaatttaaagttgattttaaggtttttccatcgaaatttattttttagcttttacttttagatcgctacgaacacgtatatcaaaaattttgttcacaaattacttttggttataaatatgctgcatgaataagccaaacaatgggaccgactgaagctgacccgttgaatttttttttatgtggtcagcaacgagccaacgactcaacattggtagtaaatcagctcatcatcgctggtgagtcaattattaagaaactggcattgcagcggagataaccggaaacaacaatacggaatgtggacaaattcagcggcgtatttccacaagaagggaccactggaattgaattggaagcaacggtctgtgctgaattcttcgatatgatcaactctcgcgtcagtgtaccaatttcggcaagtaggggccgactcaggattagcccaaagcacagacctcacctatggtaggccttgcacggtaattactcacttaataaggcgtacatgaatattcaactatttaaacatctgacaactaattattttattataggttaaatttatttgataaaaaataatatcattggagtgacatttgaatttactttcatatgataaaatttttttagcgtaaacgttgtaatatatgagaaatttaaagagaaacataatttttgaataccatgccaagttcaacagctccttattcagtgggacggagggagtacgtcgtaggctaagttcagcattcaactttcccaacttatatataataccttgttttccttgcacatgttttccatactgttaaataatatatatttttttaaaaaaagtttctataggaaagttattttaaaaaaacatattaatctatttttaaatttattttaattaatatttaattaatcatgtgctaatgaattatctcgtttcacgtgtggggaggtggacttcccaacctccacctccaaacatagccctaataggtctccaataaatccaaggcctcgggccacgtcctgggtggcccgaggcttgggtctacccctgtcggcaaatgtatattgctcactatggcatgtcccctcatgtggcaagcgaccactgctgccacaaccgacgatgacaacctcgagctgatggcgttcgtgacacgtgcgttaatgttaatggctcaccgccaccgccggtggctttggagtagacgtggggaaccgatttgttcccgtgtgctagtggcgccacgtgatgtatgggcccctggttctctgccggctgtcatgtcgcctctgcttgccttaaagcacggataatagtggactataagttagttataagcttatgtggaggagagataaaaaaataaggagtattggctcttatgtaagaactaactctagacatgtcctaaaataaatgcattaaggctgtgttcccaacctccctctctcgcttaccactcgcacgcttttcaaactgttaaactgtgcatgttttgtaaaaattttctatacaaaagttgctttaaaaaaattatattaatctatttttaaagtttttttaagctaataattaattaatcacgtattaatctattgcttcgtttttcgtgtaggaggcacctagctaagaacacagcctaaatacataagtgaaaaaaagatagagggaaaaaaataaacacaaccttatagccactcaattgtacttgttagttctaatataagcttatagtcagtagttcgtgacttcgttctactatttaaacttgatcatatatcctgtagttatggttagacctctcgatacgttaattcagtaaaaaaaaatcgaatcaactgagactgaattactctatcttaaccaagactaaattcggatttgctagttatcaggtgactgagattttctccaaatctaacttaccttcttcttgggagccacaacctccagcaaggactactatggaaagaaagaaaaggacgagaggtgtaacctgactaacttcagagggatggtggctttgagtggcagctggacagatgatggtggttcgcggcagggcgaaaccaacaggtggttaagaatttaggggacggatccgacggcgagcggagacgaggaagcattccctgtgaactttgattcgaagtcgtgatttgacccttaccggacttgttgtcattgacaaaggaagaatggaagcaaagacaatgttaccgcctcgctggaaaggcgcccttgaccgtgaaatgcctccgcgcaagccttgttttcaaagaaagatctcgtgattgtacacacgaaattttcatggcgcaatacatctgtgattcttgagaactatccctgttcgtgaatcctttatagtatttatatttgtcaccgttaactattacggttgcaactttaaccactaatattttgttttcaataattagattatgatgaacaaaaatatagtttaatacttttgtttaagtaaataatacactttgatagcatggctattaaagtatttagaatctttttttaaaaagaaaaattatcaaagtttaaatacgaatagtgcttggtgacagatacaaaggaatagatggaatagtatttaacttgttcaacaagatgttgaagtgtttgatgaaatttcgtaccaaaaattcatagaaaaatcattggggattaattttacgtgccaataacatttgcaacccttatttacaaaatacatttgagggacggctttatgataggcgagcccaaaaattccaaatgtcgcgatggtccgaatatattcaatattggacttgtcattttatatttcaaataaaaaataatggttcaaacggatttgaaatacaatacatgattccaaatttctaggctgttctagcggtagtccttgttgatggctgctaattagtactctgattggattgattatctctagcaactgtgggcacacgaccaatacatgcatcttgacaatttaaattaacgcgtgattagcggcggggtttgctgacacggttgagagcatgttgaatagcatactataaaccagctatacacattttttaagcagataaaagatgagagataaaaatagcggactacagatttgtagccagctatagcacggactccaagacacattttatatatgatagatgagatcatatattaattgtgtagtatatatttatagataattattatatgaattagctattaagttaactataaacgatttggaccaaaagttagctatactattaaacttgctctgagagtcatgtggcatgtgctggtcacggtgaatattatgtcgcgcgtacagacaaatattgggaggaatcgggagaaggctttatagctagtgatggcgcatagcggcactgtgcagaactgcagatgcgcagccctgcactgcacacatgtacatccagatcaatatagttgccaaagtaatcgtcaaaaggagtatgcttcatcgtcgctggtgcaacaccgaactaatcattcgtcttccgtcgagtcgcgcttcatcaacatgatttctccgtcaacctatttatcatcaacaacacaacagcatcacggtgctgtgcgcatatttgcatatatagcccggtattatcagagggatcaaatatacgctatagtgctgtgaggtcgcgaaacctgaccgacagaaaagtaaagtagagcacatatgaatatatcatggatacgttgtgaacttgttgtcatggatacgttgtgaacttgttgtcatggatttaagtatcccagcgacagtaaacacatgcacacgtcatctttattaatcgattaacatgagctaaaaataaatacaaggctagtatgaccctcacgagcgttggaccgtctaacttatcaaatatcagagctggatatttatttgtataaatttgggaggagtttgagccttattgacaatagaccaaccatgatttatgcatatttatattcttgttcgtgatacaatatcgatgtgaatatctatttgtataaacttgggaggagtttaaggtggtgtttggattcaaggactaaattttaggacctgtc

SEQ ID NO: 61588 - DNA, 11592 bp, Oryza sativa
agatactctatactactacaaggtcgctctgattagcgcgctagctagctagcattcatacacctcttggagcacatatggtactgtacctagaatatcatcatcacttaatttcacatgtcacacttgacaaggtctcaaagtatgaagagtttatataactcggatcaagcaaaagggtgaggtgagggagcacaatggaagagccatagtacataatcatgtcaaaatttatgaaattatcacctccctactgacggtgcatatgtaccaacctatttaactcaaaattttaagctggtgagagaagatgggggagaagatggacaaagagctcccagcagtagcagatccagaagatcgattcgttcatgtgtcataacgtgtttatcggtgtcatagtatgctaattatgcttcgattatgaagttataatatggataaacagtttcgctataggttttaccgaaagtcgttggtgtcgcttgacaccagcccttctactgcaaactgcatacggactagaggaccgactctcttgactctccactcttgtataaacataagaggacgtgaattgattgcataatttgtcctgtaaatttggatgggttcgcgcagaaaattggaaacgcgggccaaatttctctgtagcttgtacctgctctgtactgtataccaaagctatcaaaatcgtgcaataacttttccacagtcggtgttaactatgcattcgtaggactacctccgtcccaaaataagtgcagtaataagtttccgtgtctaattttggtcgtccgtcttattttaaatttttttatgattagtatttttattgttattagattataaaacatgtatagtactttatccgtaactaattttttttagtttttctaaaaaaaattaaataagacgaatgattaaagttggacacgaaaactcatggctgcactatcttgtgacggagggagtattggcttactgtgatttaaaactgtgagtactactgctagttccagctatcttttctgatacgccttctaagctcaactgctgctctaatctgcctatgaagtctgaaagtctgaaaccgaagaagtgatggactgatggtcttccctgcatgcatatagcagaaaatgtcgaaactcattctgttcacttttctaaacgaaaaggaccgtgtaatgactaatgagtcatcccttgagatatattcatatatatacaggcagctgaggaaaaaaataattagataggtgttagcttgattgtaggtaatgctggttccagaaaaatcaaagcgtgttgctgtagtctcgacgtgattgataataacagaacaaaagtgaaagtgcatgttttttttcctttccatgctttgcgacgtaagcatcgtgcgtccggtgcgtcggtttatggaggtgttcagcgcatcagcaaaaactgaatccaagcaatgacgcacagagacaaatactccctccgtttcaaaatatttgacaccgttgactttttaatacatgtttgatcattcgtcttattcaaaaaatttaagtaattatttattcttttcatatcatttgatttattattaaatatactttcatgcacacatatagttttatatatttcacaaaattttttgaataagacaaacggtcaaacatgtgttaaaaagttaacggagggagtattttccaaacggacaagaagaaagaaaacgatgagatatgggagtaagtatgaacagcttgtattactggtctgtcttaagacaattaatctagtagattctatttaccgtttcaacaacttcactaatctaatatgctaaaaaatataaaaaggtgaaaaaaaacccaaattggtcctcttcgggggacaacccgtaaaagaaaaatacagatcggggtgagttctaaacaaaagagaaattaaaaaaaaaagaggaaggaagcttttttttttttaacttgagtcttgacacgaccttggaatgcacgaccggtcgagcaatgggcacacgtcgcgctgccttgccggagtccggtcaggggaggaggacgtggagcgaggcgttcttggtggccgcgcagacggggcacgcgtcggcggcggcctcgcagccgcggcacaggcagaggtgccggcacggcagcagcagcacgcacgcgtccgcctcgccgcaggccctgcacgccctcctcccgttcccgccgccggacacctcggctgcgcctccgtcgggcgcctgcacgaagcagcacgactgcgcgtcctcggcatcgccctcgccctcggcggcggcggcggcggcggcgcagggcgactggaggagctggtcgagcgtggcgcggaggcccgcggcggcggcctcgtggctcttggcgatgcccagccacgcctgcccctccgcgcccatctggcggagcctctcgtcgagctccgcgttccgccccagggcgcgctccagctcggcctccgcggcgtgcagccgccgcgcggcggcgcgatccaccgccgacaccaccgcccgcaggtgccggcgccgcgcctcctccagcccggcgcgcagcctctcattctgtaggtaggtgcagatcgagtcaaacgcccattcgagagaggagagcagacaaaacgacacggagctccagcgcccatggcgataaataaatgcgcgatcggtggcgcgcacctcgaagcggacgagcgcgtcgacctcgacgctctggcggtagagatgcgacaacaggaggccaccaccgcagacagggcggccgctggtggacgccgcgccggagccgacgaccctgctgctactcttgtgcacgtccccgaacgcctgcggcgtcacctgcggcggtggcggcggcaacagcgcgcggtgcccgccgccctccatgacgctgctgctcatcaacagacccgccgccgcctctccctcgccgccaacccgcgcgcgcttccgcggcacgaagccgccgccgaagtcgtcaaagcggcgctggctacaagtaagctcgcttcgcaggtcactgaacaccgccgtgttgttgttgttgccgccgccgcccaccgccgcagcagcaacaacaagctgctgctgtagcagcgccgctgagacggcctcgtccaggaacaacgccgatgcgccgctgctcggcgccgcgttctccagagccggcctgcgaagaaaattgttagccactcgcgcgaggataaataggtggtcggcagcggaagaggaaggaggaggagcgcgaggcgcatgagtgcctagagcgcgcgcgcgggaagggaggcggggccgcgcatgcatgcacgcgcgcggcgcggcgcggggtgacacggacctgatggcgtacgccgcggaggaggaggagcgggaggcgtgggcgacgtactgcgcctgcacggccatcatcaacacaaacaccgcaaaaccaccaaacaccgcgcgatggagaagaggcagcagagcgcgggggttatatatgggaaggggcggtggtaaagacacgttggtgcggggtgggggaagggtggcaataaaagggggacaaagcctgttcgtcttgacgaggtgggactaaactagaacgagaaagatgagaggaggcgggtgtggccttgactgggcgagcaagcaacggatgcgtggggtggcggattgatgggtgccggtgcccggtgatggatgatgcccaccctagcttccttttctctcctcttccctttctttctcctccttttccccgcccgctttaataattttatcgtttagagcacccgcaatggtaaagtaaagtgctctctataaaacatgtataactcagcaatagactagattaatagtaaaccacctcaatagtatgtctacatgtgtatctatagctctctaatgcattgcctcgtttttctctatagactatctccagattagtagatagctttgctctctcttcatttaatatcttccaagtaggaaaatatactgatatggatctcttatagagagcctatagataaccattgcgggtgcccttaccatattcgtcggagcatgcacaacatttcgagcatttcgcccctgctttgcttttcgatgccgcaccgatggcgaggcgacgtgggattcggttcgggggcaacgcaaagactgcagcactgggccagctctatcgcccaagataacgtgaaatttgacaatatggagtatctactaatacacgcgtctttgctgatttatcatctaatcatggcttctaatatatagcactggagccataatttttttatttcataccattttctctttttattccttctcgtgttcacggactattttgcccataggctcacataacatgagaacaaaggtgaagccgtagagggagggagggataagataatacaataatctcccttcagtaaagcctcaatgataacaggggcatcatagcggcaggggcggcggcaaggtgtgtccctgatgttgaagcatagtggtgtcggcgccagagataaggggatcatgacatcggtggcgacaggccaaggaggcgggctagcggtggtggagcagcgttgggatgctgccacatgcactatgatggagggcctggtttgcggcagcgctcgttggaagccgtgactcccatttcttccaatcccctcgctctttcttttccttgtcgtgtgggcctaggggcaaaagagtacatataagtgaggaggagaaataaaaaagaaaagcaaggagaaagtggcatgttaaaaaatcatagtcgcattattgtattttagaagtcatacgaattggataatatatacgcaaatgtgcgcatattagatgttatattgtcaaatttatcgtgaggtaaaggctcgtgttttactcaactgttcagagtctttttccccgtttctttctgttttcgcttgtaagcaaatgaagagtggcttaagcaagttgtgtttggtgacgctggcgtttccgttttgtgggtgaactgttgatgataattcaatactgggtgcagaagatgtatcaataatcccacgaattaaagctaattaaccccctcaccttttccttctttcatgtgcaagcgttttctgatagtacgagagtactactacagcgttattagtggcagtgcttcccttttctaaaaaaagtcatgcgccttggtgacaattcacgcgagatatacgattttcgatcatacgagcagtgaagcgccgtacgcacgtacacgatccgatcgatcccttagcagctttgatcgatcctccacgtgtacggccaccgccacacagctgcccaccacgccgtacgtttcgtcgtcttcttcaggattattaatccgtataggatcgagtacttgcaaagaaaaaaaaaccgaaacaattaaaccacccgtactaattgggagtaagtataattgataatcccatggacgcattcataagtcctgcccggaaaaaccgagcgatttttgaaacggctcgtgaccgcggggcatcaacgcgcgacacgccacgagtattcgctggtcccatgatataacgccaagtatagcactagtacctgacgtgatgtggtagctgggatttgttattggagtaaatttcacactgaaatgattttttttaactaaagttttataacggaacatgcccgacccattgtttgtgcttaacaccaaggacgaagctataatatatttgtggaatgaaatccatgactatattgtataggctatgaagatgacacttgaaatcaagtaacattaataatgcattacgatactgatgagccaattttctagctccgtccaggcttaacaccatgtattcataatttgcactttggactggcccaatagtttggctcggcacgtaggcttcagcccatgcacacgatcaggcagttgttgccccttttctcttttctcctcgcacaggcacccatgagggccatggcccggccgccgctacaggtgaagagcgcaacacatctagtggcaccgatggcgtgggaggagggaaacctgtggctagcccgcgcagggccaggtggtgagtcaccgttgccaagcttgcacagaaggcagcagctccgacattcacaatgaaagcatgtcatcgttgcaaagcttgtcaaaacaaagcagctccgacttcaccacatacttgtgtccttgttaccgagctcatcacaaacgaccaagcagctccaacttctcatggcggacatcaaccaaagccaccgtaccacctcttcctgcctattgctggcaccagcatgtacacttagaaagagactgcaacatgttatcattgccgagcttcgtctcaccccaacaacaaagcagcttcgactccacctagcaaaaatcaaacaaggatattggccacctgccacaaagcaagaagcggatccaacaaggagaaggtctcgctgaacattttcgccttgttgagtgttggtgtggaagtaggaagccccggagctaacgtcaaaatcataactagacatgtgcatgaaaaggttctccaaagcggcacccccaatagggacgagatgtgaatcgccgctgccgcttgcccattaaccggggcaagactttcacctggagcacaatgatggaagaagagggaacacgtcttaacaatgcctccgagaatggaaacggcgccgaaggcgttgccagagccagaaggcatggcaaggctttcgcgtatggttccctgtgctcctacacacctaaccaatccgcagacacgactatcgcaagaatgccgcattggcctcgactcaccgacctccggcgaccaagcaccccggagctccccatgggcacgacctcaccgacggccgcaaccaacgaacaacctccaccacatataacagcacaaagcgtccccgcgggcaccgcgtcaacgccgcacggccgcccaagcttctcgaccaacgctgccaccaccaagctcgccggcgtagcacggccgccctggctcttcgctcgacgccgtccaagcacgccggcggcgcccagtcggccggtgtcgtcagccgctgccacctgcgtcccgcctgccagccgcgccgtcgcccgcgtctcccacgccatatgccgttgtctttcctgccaaacaccatcgtcctcgcgccacccaccgccgttgcccacgccgtcatcagcttaccagccagatccgatgacgacgggccggatccagcaacggaagggccggatccggtgacggtggcggtgccggatccgcagccacgcgccgcgccgccgcgaggcctcccccgcacgccgtgccacttcctcgcatcggagacagctcgccaccggggtttttgtccccgctgccgtcatcctagttcctacgtggttttcggtggcggcgaggcggtgagaggaggggagggtggcggcggccaggggctagggtttgcccctggtcacccgtgtgtggacgaccgaaggcgcgtggagctgattccccctcataggggttgtttggttgatggctaagttcgccacatctcactttgccacaagtatgctatgctacaccaaatgatactaacaatttgttgaccataagcgtggctaaattttataaaaatttaagtctacgatgcgtaggcccaaagattagtaaaatgaggcatgacacagatgtgacaaccaaccaaaaactatactaccaaattgtgtcatgcctaatatttggcatggtaatatttgggagctacctaaatagccccataatttttggagcgggtgcaacaatgctactaggagatttgaaaaactaagttgtggtaagtattatgtgttgccacagtacgtcatgaagttcatgtaaagtgtatatctattataatgtgagcaaaataaatctattagcttaaagaaacacttgtgtcacagtcactacgtatcaagttaagtgtatatattaactctactggtgagctaggatttgttagtggcgtggttggcgcctgcccgctgggtcttctaggcagagctttggatgtgagaccgagtggcaatgcaaggcaaatgattaagatggaaccgagaaagaagcaagtgctattatacaaagaccagcagcgactttttttttctttcgaaacacatccctttaattacatacatgcatacactacctctataattagctctgacaaactgtaccgacatatcttgaaatttagggttgttgaaatgctgggccaaaaaaaaaacaaagagctgcactgcctgttacttgaaaggagcaagtatcagaaatacaaacagtagcctttaggagctgaagtaccagaaatttaggagctggaactaacaaaatgtctgtcttgcactgagatttatgccaccaaaaaccttacagatcaactaaaagagggggggggggggggggggcgcagaagtagtctcatttcttaagtgcattcatcctgtcccgcaggtaatacaactttgctctcctgactttcttcctgtccaagactttgatttctttgatgtttggagagtaactgagcacaaaagaaaggttgcatcaagaaagactgaaagtcaaaacaaaatgaatcatgtgtaaagatatctttcatatttgactccagcaacttatgataattttgtatgaaaaatttagatgaactacagaacaaggggaagagagaacaagaaatagtaagtaaatatatatgaaaacatcctattgcattacttccattctagaaatatacccacaacaccacagtggtgaaggaacatgtgtttctagtggtgaaaattgcagtttcgtccgagctgaacgtgcatatttatggaactacattctacaagctccatgtgcaatagagctcaaacacacacaggagtttattgcacatctgttctatcaagtactatcgatatcaaatctcggcattcactttcttaggaatttgttaacaaggtatttatcaatatatgattatgaaagttatacttggatttacagaatgcaaacaacgaaggtagtgctagcatgccactgttatcatcagcctattagggatatcaagaaggctaaggatacccaagaaacaaaaacaccaaacttgaatgagcatttctaaatttgcaagcagataactacacttctaatgcaaaataacacgcctatagttctatgttcacttgtagccatatggaaccgaaagtatgtttacgcacaatcaaagaaaacaatcctgtctaccaagcaaaaaaatagtgagaatagcctgctcaaaccttaaagtattaagtactgtatgatgcacagttctcacatttgaatgaacaattagtcactcatgagaccaagaggtgattcgatatctctatatgcatttcttttaagaaaaaaaaagatgaggcggcaaaagggaagcaaatatttggtgtcacttaacagtggaaagacagactcgactccaacaccagctactaatctacgcagtctgaaagttgtattgatcccagcattgcgtcttgctatgacaatgcctttcaacgtagactcgcgccgcttcttctcaggaacttgctgttttttacacacataatcagaacggcagaaatgaccgagcagacaaaataccagtaaactgaggatgcagatgctttaccagtctcatttggagaatacatccaggctgcacatcaggaatctctctttccccaagtaccttgtcagctgcctccatgttcaagatctgaaacacaaaataacaaatatgtcctgcttcttttaagtgctcattttgacacaactgtaagtttcttggatatgtcatttgcacaatactaggcttacattcgtaagagcaaggctaataatacagccaattatttactatataaatttttatagtctatttttttactcactcatatagtgattagctcttcactataagtctactgtctgtctcacagattttattgatttttgtgcctaagccggttgtaaacttacagcctgtttctcatctctttcctctcctctctcatccacctcagcatttagccatcttagagcaagtttaatagtatagcccactactagctccaattcatatatagtcaatctaatagccaattcatacaatagttgcttactatactattaatatatggtcccatctgtcatacacaccgcgtcttagagttcgtgctaaagctggctacagatctgtagcccgctgctcttctatctcatcttttatctcattaaaatatgtttatagctggctaatagtctgctattgtacctgctcttacagttacagctctctattatacttgctctagcgtgcatagccgtcttgtcaggcctcttgagagcaagtttaatagtatagccaactgttggctccaattcatctgtagtcaacttaatggccaattcatacaatagttacctataaacatatactacataattaatatctggtcccacctatcatataacatgcatcttagagtctgtgctgcagctggctataaatctgtagctcgctgcacttctctctcctcttttattttcttaaaatatgtttatagttggcttatagcctactattatacctgctctgaacttaatgcacggaggatggtctgcagaaacctcagcactccccactgtcgatagacccctcattgacatggtattcacgcagaacccaccgggatgaacgctgtcaccggaaatgattggattctgtacgcatcaagaaaccgaagcgacaggcatgaccaaaaattagcaggatcacagacagcggaaaggaaacaaacacaactgatatcccggatgcaaaccacgcaccccgaatggacgaatccagctgcagcagggcctcaggtgttcgatggacagcgcaggttagagcaacaagctcactttctactattaacctatcttgaaaccaacgtatataatatattatctataagattgattatactttttttctcctacctctatctctcacttatacatttaatacatttgtcttgaaacttgtgataagttagctcttatataagagcaagttcaatagtataacctactactaactccaattcagttatagccaatctaatagctaattcatacaatagttgcttactatactattaatatatggtcctatttgttatacacacactgtgttttggagtctatgctgcagctggctacagatctgtagcccgctgctcttctctctcatcttcaatctcattaaaatatgtttatagctggttaatagtgtgctattgtacctgctctaagagccaacacccttaatttttcactacctcttttcttcacctaaatttatagtaagcttatatagctcactattatacttactcttagcgcccgactgcgcgatttcagaggctgcagagctcaacagtttcgcggcggagccatggcttccggcaagatggacacgccgcagcagagattgcatcttccgaaaagcaaggactactgccaagg

SEQ ID NO: 61589 - DNA, 12922 bp, Oryza sativa
atagtctatagagcaaaaacgagacaatgcatgagagagttatagatactcatgtagccatactattgtggtggtttactattaatctagtctattgctaagatgtatatgttttatagatagcaccttactttaccattgcgggtgctcttaaggtaggagacgacgagcacattcgtgagagcggagaaccccagcctcgccatgggttttgtcgattcgctagccgctcaaactcctccccctagacactgtcgtctccctggtgccgccatgggctcgcatcgccccgacatgaggaaatgatactagagtgtggagaaagcaagagaaaggaaagagagagggagaaaagaagagaggacactaacacatggacccatatgttgactcggtcgattggaccaggtcatgcaatgtaacgttggtgagaaccaccatcaatattgtcgatagagtcatttcgcaccggttttaatagttggagagtcggtacatatggttttgcggttgagagatataaattacatctgatctatataattttgagggagtcaactcagactttttccataagtgtactgaagctgaaaagatgcaagcttttgttgtgcatgaactcgtcgagtcgtcgtcatagtctcgtagatgagcctggattgctggacacagaaggccagcccaatcccagcagcctaaccagtcccgttagtttgttggattattgggcctttggctatcattaaaggaaatgttggattgcgtcaagcccaacagacatgaattgaacaagacgacaacctcttgatcgccaccggataattgaccctaaaacaaaaaaagaaagggacaattgcatctatcccctcactttcaaatctaattattattttatccttattttttagggtttgcagttttacctgggtgtgctaacgggcgatcgatccccacgccccctgtacacacctctccttccttcctcctcttcttctcttcctactacactataaatttaaaaaattaaaaaaataaagttaaaataaatttatgtatatatatatatatgtgtgtgtgtgtgtgtgtgacactcatatgggggcaccatggtgcccgggcaccatggtgcccgggcaccatagtatctaatgcacaaaatcactcaaatttttaaaaatttttaaattatgagtatataccatttcacaatccatgattacatacataactaattatatgtatggatgctatatacctagaatcaaaatctaataaaaacaagttcaaattcagtacaaacatgctttgaactagttagtaaagtagttaatgttaatacctaagtaattgaaaaagtttcatactcatttgaattgggtatatactcaatttcaacaatggtgcccgggtaccatggagcaccaaacaaatttaatatatatatatatatatatatatatatatatatatatgtatatatttgaattcaaattcaaatttgaatcgggtatgtaaacttttggcttataaactttgggtctataaactttaggtatataaactttagatgtatagacatactatatatagaaaatatttgaattcaaattaaaatttgaatcagatataattcaaattcaaatttgaatcaggtatgtaaacttttgacttataaactttagttctataaactttaggtgtataaactttagatgcataaaaatactatatatagaaaatatttgaattcaaattcaaatttgaatcagatataattcaaattcaaatttgaaacgggtatgtaaacttttgacttgtaaactttgggtctataaattttagatgtatagaaatactatatatatatatatataattgaattgaaattcaaatttgaatcagatatataaacttttgacttataaactttgggtctctaacttttagatgtgtaaacttgaggtgtataaactttaggtgtataaattactaaaataagaaagtaatacggtgccaaaaaaaaaaagaaaccaagtggagagagggagagacccgatccgatcgcccctggcgatcaatctcccaataggagcctgctttttaatctgaaccaaccgtctgcccctacttctaacagccggtttaacggtgttagttgtagagaaaaatggtatttatacccttagtggttattgtatttttgcccctatttttttttccagattgtgtgattctgtacctattgactattgtgtgaccgtgactgtgagaggaggaagctaagccagattcgggcgcttcttctatgtgtgcctgtgtggtgagagaggccgaggctcccgatgcaacggcatggctgagaggcggtggatcggaggtcttgctggcagccgccgggatggaggagttgctcttcgtcgccgtccgcatgtcttcacgctgcctcaccagatctggcggcaacacgaaccggcgccaccggatcctctctatgctccaaccatgccatatctgcatggcggcaatacgagggagaggacggagacggcggcgccagaggtcttgccgggggcggtagggatggaggatgcgccgccgctggatccccttctcttttctctcgacatgcgctttggctctttgccaccgcgtgaaagccctgcagccgccgcccccaccgcgtggaagccccgccggagcgccgcgcacgcccgcccgtccttgctgccgctggcgcgcgcgcctacatgtcctcaacggcgctgccgcgccgcgtgcccgccctcgccgccgctgccctgccacgcgccgccgataggttaggatttcaggttgggaggagagggattcaatccctatccattcacttagggtacaagggtaaattaatattttataaaacctttttttaatttttttatttctttaacacaaaacgtgggacccactaaacggctgttagaagtgggggtaaacgacttgttcagatttaaaaagtgtgaataaaactgtaaaccctaaaatttacgggtaaaacagtagttaggtttaaaagtaagggcatagatgtaattgttcaaaaagaaaaatgaaaacgaaaatgaatcaacttgtgatgggccagacacaggtgctacttctacccatgaggccatgacgaaatgacgattgacatgatgaacaacctttggttactccaaggggctactactagatcttccaggaattctaggtagcaatggggtgtgtcccccagccccactacttgagaattgatatttgcaatctggttgttattaaaatcgggattaaaaatcaaactaattggactgtaaatcaacagaattgatcgatgccacgcataattgaagaccacgatgcacggctcgatcctagccattaatgaatatagaaaatgctagaatgacttatattgtaaaacggaggaagtatattatatatatcttccatatcctatagtttcttatttccttcatttcacaatgtaagttattatagcattttttatatttatatttgatgttaatgaatctattctggaacggatggagtactattttgttatactggtacttagcatgctattgggttcaaatatcattccgctagggatctaatcagctactagaacgcatatatatccttttcctaaccattcatatccatcactgcacgccggttatataagctatcagttgctagattactccagatgatgtgcacattatctttttcataactaccactagcaagatatttatattgctagctagaataatctgccaccgataatgataagaacgtacgtgcagtacatccagctagctgaagtggaccaaggccttgaagtggactgaggccgagttttgtttcgaacttttaacttttttatcacatcaaaatttttctacacacataaacttctaacttttttcttcaaactttcaattttaacgtgaaactaaacacaccctaagttttcataaccaaatggaataagtgcgtacacatcacgaattctaggtgcagatggcacgtcgctgtagtacgtatagtatgtcgacatggccggcccgacacgtcggccccgctacgtacgtgggtccccccgagctcccccgcgcggcgccgtatctgaccgctgggcctatatggccagtgtttaggttaggcaatggcaatgttttttctttgcgacaatgttaataggggctgtttagttccaaaaacttttcccaaaaatatcacatcgaatctttgaacatagataaaaaaaaaattaattgtacagtttacagtaaatcgcgagacgaatctcttgagcctaattcgttgtcggtatgtgggtggtgttatattttttccttttttcctggttacgaccctccagggttataatcttagtaattttttcctgctttatcaatagaacttcgtgcgagtcgttaaaaaaattagtctataattagccataagtgctatagtaacccatatgtgctaataacggcttaattaggctcaaaagatttgtctcacggtttccaggcgagttatgaaattagttttttttattcgtatccgaaaacccattccgacatccggtcaaatgttcgatgtgacacccaaaaatttccagtttactaactaaacaggcctaaacagtcttaataatctgcagttaccatttacacgagactctgtcccactgagctagatgtaattttgtgggcttataaacaagttacacgaatattataatgtaattataattaaaattaaaattgatggatttttttataaaatacgatcaaatgatacatagccagtccgactaatctaactagagttcgtatcaagggaagatctaaccctgacagtggcatccactgattgggcaatttggtttgtggagccctaccaaaaagttctaaaaatctttgggtggcactccaaatttgattgggcaaattgctactccgtactacactactacctaagagatggtgttggtaaatattggcaccaatccaaatatctagaaatactattgaaaattggtaagggattagtaagacacaatttggcaccaagttatctttgcaaagatagcctaagaactctcccgagtatgcacgttagtgcgtacgtagtaatgtagcaattttatcggaggattcatgaaggcgtcgacgtttcgacggcgatggctgccgaaaacaacagacagaaatgggtaacatgggtcacttgttcatgtgcaatggccattacgtatttacgtgtgctcggacgtttacctttaatttgcaccatcaaagatgtgtggatcgatcaagacgtacacagactcgtggacgttttctgtgtaacatctgtgcgcatggatggagttttaccgaacagtggcatctggtttaggatagagtgcccaactagctagagaggatggtattcatggatttgctccgtatgcataaaaaatttggtagctctggtttccatgaaaaaaattgtcatgtgtttgattatctgttctatgaaaaaggtaaattacctaacaattaccggacccctgcagctgaagaacggattaatcagggtaacgctcgatcgtgatctagatctaaggaataaaacatggatgggtccaaatccaaacagcacagggtggacctaccagcgcaagatagtcgcgaagtccgtgagtgagatcatctgcaccttagctagccgccattgatgtttatccacaattgattttggtttctagctcccaatcatgtccgtctccttatcacgccaatccaaatggtgagtggtcatggaccactcactcttacctgatcagtattcctcatggtaatttacaaatgaatcacactgttcctcaccccaataaccactagtagctcggagagtctcggacgcaatggctacgactcgatagatagatgatgatgcatcatgtattttgtccgttcacctgactgagtagtatctgacacggacgagggagaggtttcacacattgttaaataataaagcaattaggtttaaaagatttatctcacaatttacatgtaatatatgtaattagtttttttatatttaatactctgtgcatatgtctaaatattcaatgtgattagcatgagaacgatgaggtttcagtccagtacaccaccacaagtttacagcgcggcgcgaggtggttataacggagaggcccgagaagtcgcgggttctggaagctgtcagcttccgtcgaccgaacgaccaagcagccgccgcggctggcggctgccactcgctttgtgacgtgcaagagatttcggcgtgcgtggcggcgatccaccggaccagtccaaacgccaagctagcatacgggcggatatctttgcttgcacttggacgagtacaagtatttggatccttgctagcatacgaccggctcccggtgcgccacacacgtctcaaatacggtaatgcaagagtactctatctccgttttaaaaaaaaaaactctatctcgatatgtttggttgatttccacactaataactactctactagttatacttttcatttaaatggatccacttatcattgattcagttttgtagctaagccaaattcaagcgtggctaacgttttacgagccacaacttaactactactaagtgatggtgtggcaaatttagccatcatttaaacctagtttgctgtgatagaagggaaacaccggtgatgtgccgggaggcacgtgtgctccctcgttgatgggggcaatcggacacgtaatataccactgccggtgtgcactgtggagccgcatcaaccaacgacgggacacaccccagcctagctggaagcaacggattcggtcatattttttcgcaaaccgccactaccccacggttggtaagcccatcaccaccccccgccgcacacagaattagcctcccgtcccgccccccgtcccccggtggtggcccgcgccgtgggcacacccagcgcgcgcgggacgccacacccgcacggtgaatattcaaatatggagcaccgcacaataacgttatccagcctagtacagtcccgcgtgtagctctccccgccctctcgccgcgcgcaggcgcagctaggccgctctctcagcgtgtgcgcgtcgcacgcagcagtggccggttgggactgggcgcgaaagggaatcccgggcaggggggaggggaatgggcagcctgccctgcccgcggggcagcttagcgctcctccactataaaacgggcgccaaggtcaggattacgcagttttgccgccccgtttcttctcttcttccatcttcgtcatcttcctcctcgactcctcgttatattaggtatataaaatagcctttcttttcttatcctttttagttttacggagtaattgatttgcaactcttcacctgaaactctcttgataaatgggattttgatactggcagtactagtaaatggaattgaattctttgttagtactactactggtagtactttgtactgctcgctttgggtaaccgccaattcaatccaccatggattggctggcttgaacgggaagctgaagaattaattcatggcggaatcatgttttgattgctctgcgtttagagaagagatctctgacgttactgaccccaagattaaactcattgattttatgtttatgtacgcatttattgtattcgtaccactaccagcttgcgcctatagaagctctgcgaattcttgatcgaggcctcatcttcttctctttgtcgcagctctcgcagatcagatcggagacgaagaagatggcgtccaactacgtcgacaccaccggcgacgagggcaggttccacggccaccacagcaccaacaccacgccgacgggcgccgcggcgtcgtcgccgaggacgatgcgccggagcttctccaacgcctcctccggcagccacggcggcggcggcggcgccaagtgcgtgtgcgcgccggcgacgcacgccgggtcgttcaagtgccgcctccaccgcaccaactcccagggccacggccacggccacccgcacccctcccctcccacctccccggccgccggcggcgcctccgccgcgccccggccgtcctccgcctcctcccgcaccgtcgaggcccagtgacccctgacctccccggccgcaccaagaaaccaaccaaccaagaagaggaggagaatcagagtgggggagaagagagtaaaaaagagcatcgcgtatcatatcatcggaagggagtttatttttgatttccctcgttgtgatctccatgttcttggaagatttttcttccatttttccttttctttttcttcttcttcttcttccttcttttggctttatgggatctctcctactacatggccaaaccttcctcttcaccatgatgagaaactccaaatcatcccctgctcgaatcagctccactggctagtagctgctacttctcctccctctattattataatctattggatgatgataagctgataaatggaaagataagggttacccttctgctctactatgtaattactagtaccattttaccatcctattgataatccaatccccacctggttgattgagttcttgtctgaattttagtgatgttcttgaaagtactcctaatttgttggttaacagaataccagtgtgggtagattcaagagcggtatctgcaattgtcatcactgcattttttatgttttgggtgaagaggtcgtcagctgtgatttgcaaggaattgtcgcaatctagatagtactagatactatcttcgtttttgtgggtggcgagtagccattggtgatggagaaggacgatcgtgaccgttttggtgcgtttgttgctgggtcatttctagccgaattcccggttcttgcctgggcagatatatatgggtttggggactagggagtgtgtgttgttgtgttcgtcaaccgttatagttttgtgttttttgttgatatttctttctcatccaggtttctcctgggtaaggtaattcaggatgctgacaacagtggccaaaatgagatcagaatcatcagatagatagatagatattcctcagtgggtgaaaaaacttgaaaggtgaagccaaaggcagatctttaccactactacgcggtaaaaacacatgggcacacatgaccggcaacatcctcaattcttgcatcgcaccaccgtgctgtgatgatgatgatgatgatcacgacaaggaccgagggagacggacgtagtggttggcctggctgctggttgccatgccactgccatacataagcataggcatatgacctattctgttgcagtctacttccgttccacacaaaataacctagaagagcacataccctatttagattcgttgtgttaggcgatgtcttatccatttatagataagtttttcttctaggtaagtttttcctagaacggaggaagacagtagtttcgagactacaagaatcagattctctaccttgctactctttgattttaagtgaccgatatatatagacttcacaacttatggataggcatatcaatgacccacgttacacaatagtatgtcaaaggagttttctttgcaaaagatgggtctctatcatcatcaacaacatcggctcatcgtcatgtggcggtggttacgatggggattgatcattggcccgtcttcttttctttgcatcgactcgacaagctgtttgctgctgatcgaatgttgtgtacgcgcggtggcgtttattgagcagatattttgcacctaaccggagatttggacgttgcggtagggccgggtgggtgaactgctcggagcaggatgataattgataagaggaggtacaatagcaggctataaaccagctataaacatattttaaagagataaaaagaagaaagaagagcagtgggcaacagatttgtagccagctacagcacggactccaagacataatgtgtgtatgataggtgggaccagatatctattatattattaaggaaaaagtacgaattacgccctcccccgaactttcgcggtcgtccgaattaccccctcgaaccacaaaaccggatattcttcatccccaactatgcataccggacgaaatacccctctcgactcaatccgcggtggttttggtatacgtggcgtacacgtggcagtccagtcaacattctatttaaaaaaatttgtgggaccctgcatgtcatacactactctctctcacttctcactctcactcttcctctctctctctatcaccgtctcatggcgagagaggcagggggcgagcgagatggaggcggcgcgcgggggcgggcggtgggcggcggcgcgcggaggcgggcggtgagcggcggcgcgagacgaggcgggcggtgggcgacgcgcgagcgaggcggaggcagcgcgcggggcgggcaatggggcgggcggcgcgcgggggatgggtgggcggcgcgcggggagggcgggcgatgggtgggcggcgcaagaggaggcggcggcgcgagcgaggcggcgatgcgagacgaggcggatgcagcgcgcggaggcaggcggtgggcggcggcgcgagacgaggcggatgcggaccggtggaccagcacgacagcgtcggcgactagcgcgacgcgtacactgccgccgacactccgtgtcccccctgcctctccgccgccctgccccgccggagagggaggccgacgccgacgagctccgcgcgcgcgccgagcggctccggcgctgcaaccgccggagagagaggccgacgccgacgccgaagagctccgcgcgcgcgtcgggcggctccggcgctgcaaccgccggagagggaggccgacgccgacgcagacgagctccgcgcgcgcgccgggtggctccggcgctgcaaccgttggagagggaggccgacgtgctgcgcgcgcgccaacgcacacctccgcgccgatgccgccgcccccgcgtcaccgtccgccgctgtcgtcgtcgtcctcctgctgtagcgcgcaggcatgggcatcgtcgttggcggcgatgttggcgcgcacgaggcagccgagctccatcttggcgcggggccggagcgccggggcgtgggtgaccagcacggcggcgccgcagctccgcgccgaggccgccgccctcagccgtcgcccccgcgtcaccgtcccccgcctgccgctgaccagagtgagagagagagaagagagaggaagagtgagagagagagaggaagagtggaggatgagtatgacatgtgggtcccacaaacttttttaaatagaatgctgattggactgccacgtgtacgccacgtacgccaaaaccaccgcggattggattgaggggggtatttcgtccggtatgcacagttgggggtgaaaaatatccggttttgtggttcggggggggggggtaattcggacgaccgcaaaagttcgggggtggggtaattcgtattttttcctattattaaaggaatagaaaaaagagcctctacgttcgctttcatggcctagaaattccgataatgctcttcgtcggtcgaccgacgggggagcaaaaagatcgggcgctcccccgcggccccgcccccgcgcgcagtgatattgttaggccccaccacattacctgcccccacctgcaacaaatcaaacacatattttgtaaaccctctattaagggaatttggtttattttttgttgcaccaaaaatgtttcacctaatgtactcacaatgtttcactatgtatagatctaatgttgcagtgaacgaaacattccattgcaacaaaataacccacatattttggaaccccctattaaggaaatttggtttattttttgttccaccgaaaaatgtttcacctagtgtactcacaatgtttcactatgtatatatctaatgttgtagtgaactgaaatattatttcgctatttgctgaaatattgtttttatataaggtgaaacaacacctgatttaaccgagtgaaacattttcgatctacttagtgaaacaattccggtatacctggtgtaacatcgtgaaacatttaaaaataattcaataataagttaaaaaaaattccgtcagaatatatccatgtgtggtcttgttttgaagatttaattgcaacgaatttaatggtacaatcggatcatgatttggataagtaatttaagagaaaaatcagtttaaaatagttttgcacgtaaatcgggcgctgatgtcatgctgacgtcagcgcctgatttcccctgctctccatcgggcgaccgacgtgtagtcgcgtcctagaaattctcacattaatcggagaaaaagaaaaagcagagtccatatagaaatacaatttagaaatagttgaaattcggaattaaaaataaggaatattagaagaagagactagagtccatatagaaatacaatttagaaataattgaaattgggaattaaaaaataagaaatattagaagagcatactagagtccatatagaaatacaattaggaaataattgaaattcggaattaaaaataaggaataaggaatattagaagtagagtatagagtccatatagaaatacaattaggaaataatagaaattacaattaggaaataatagaaattcggaattaaaaataaggaatattagaagtagattatagagcccatatagaaatacaattatgaaaaaaaatagaaattcggaattaaaaaataatgaatattagaagtatagtatagagtccatataggaatttaaaactaactaaaattcggaataaacataataaaattaaaagtagagtttcgagtccgtataaaaatacaatt

SEQ ID NO: 61590 - DNA, 8300 bp, Oryza sativa
tatagtatttgaagtacaatttatatcttatacattcgtataaaatttttgaataaaacaaatgattatatatgtgtttaaaagtcaatgacatcatatattaataaaacggatctattaataaaacggagggagtattactacagtcaatagagtgagcagtagaatggactggcagcgtgcacaaattgatgacctaaaatcggttcccgccaatctttgctcatctatcggttcccgccaacttttgctcaggtagtcaggtggtggattatttacaggtcgattaacagtttaacaccaacataactcaggtgagttcacgtggaatttggacgctttttcaaggtggttgaacaatctaaggagacaacagaaaaaacacgcacaaattggagtcgttttacgtgacgtgttgatgtgcccaagccataaatacttttttagtttcaataattagtaagtgactttaaaaatctcatttgcacaagtaatatctatgatctacataaattttgaacggatggaagtgtaatggaccttaaaagtactacttttagaacttaaataacattcttgatacaccatttttgtggatatattatactccatttcgctcattatggaatttattactagttcaaaatatttgataaaaaagttcagccttaagccatattgctccgtcaattaacatgtcatcccaaaccactctattagggtggtcaaggatgaaaagttaacggttctatattttacatactcatgacaagccagtaaaaatctcgtgtcagatttaaaaattgagcatgtaatctcaaatgtgactaccactatatccatttcactagtacacggggaaatcagggtctacatcttgtgcccaggactgcaagccaccgattatgtcctttgcagaaagaaaccccttctcccgtagaagctgaacggctatttgcgagtcattgcctcttcggcaaacaacataaagggaaggcggtttgtctgatgaggaggcgtccgtcgtgtccttcaacgaggtctcgagcatctgaagcttctcctccaactcggagagcgggatgttcagagattgagaaacagaagcaatttggaagtgatgtgcaggtcgtacatccaacagaagatggcgttcaccattatcaacaagccttttgtattctttacaagtgacacgggcacttcctggaagtatgtccaaacttggagctgactgcatagaacgcaacagcaagtgaaatggcataaaactttaatgtttttctttctttcagataacttaaaatttatgcactccattccagaacatgaattttagatgttatattgaaattcattcactttttaccccattccaatctcctaattgcataatccgaatcaggctgtagagaggtgttagtggtatccactaaaatggcctcgctccatatttctgtattagactaacgattagctaaattttcctagtagggaaactcactttatttacattacaacatacaatatccaaaggacttgctaaccagacaggtagtatttaagttcagctgttgatcagattagacagacagcattcctttttcaattcagtgatacatacagaatgctaatgataaataatataaattgtgaagtcaatgatctggagacataccttatcagacattggagactgcgtgaagttctcataatcaaacttctgaaaatcatcttgagtaaaagctgaattttctccacaaaccgtgcaaacagtcgagcttcctcgaatcttgacctgcagaaatatgtaagtttcagtaatgaacttcatgaagagagtgaaggaaacagaattaactttgtattttgtgcagaagaaaaacagaaacagagaatataaaaaaagcatagataagttattcccagtaaattggtcctaaagcaaaggtttcaacatcattagtacttaaaatgctgacaaaaatacaaggagttagcaaaattagtaaaactatcttaatgttcataatccatttccgtaacaaaccatctgcactaaccaaaaatccagtttttctatgttataaattgggtacagataacaaaatctgaactgcatgaacacaaccaagacagactattccctgaactgagtgatgctgagaatgatcttgttacaacatataccacagatattacatattattttgaaggccattttcaagattggagtcagagaacacaggttgccatatgaggttaacccacttggtatattgtaattacagctagtagactgctgctaagataaaagatacgagagagactacgtgcgcccattgactgtgatgcactcatgcacagttgctaaaatagctaatacatgcattgacatgtcatgtttaaactatggtatgatgtagcatgatgaatgagcaggcaggtcacagtgcgaggtacattgtcgaatttcatcaagataacatgaagatatgcaatttctcgttaaactgcctaatgtgtgaatatctgttcaagtagcaaccaaatgatgcatggtataatagtgtagtacaggaaatagaaagcaacacaagacatatctggagtcaagtggcatacaattctgatacgagcagatagagcgtcaaagagtagcattcttccacttaggggttcaccaacatcagtagcaacctttatagcctctagagcttgcaggcagccaatcactccgggaactgtaggtcaacaaagagtagttagtttactagtgcaaaattatctacagaaaagatggaatcaagggatgaagtttatgccatcttattcagtacaatgtcttcatactcacagtatgatatgcatattctacctataacagaaacaatatttgtagccagccaacctaggctgtacggagaagtaggttcaggtgcataggtgggaatgaccaaaatttcaatttgtatactatgagcaagtaattcatgtttttacaatttaccaaaggataagaaaatgtatgcacttaagtaaagtttacaaatattctaactgatgtttcacttcctataaagtgattgttcatttgtatggtcagaagcatcagtaactatgaaaacaaagaagcttgtgtatgtggttcaagccttgaacaaaatttaaaataaatattctaacttatgtttccccttctgggaagttattgttatgaccaagaagcactcgttaatattttactcagtacttaccaaccccaagaactccactgtctgagcatctctggcaggctgccactggtggtggatttgggaaaaggcatcgatagcatggacttccattatgatgataaacagtcaactgttagagaagtcagtgcatgaataaaaaaagaataaagtgaactacaagaatgaagattatcaggagtaatgagatttacctgtccttccaaacctaaggctgcaccagatataagaggctgcacataatttattaaaaagatcagtatttcatcaatgaaaccatggtaagtgaaataaacataagttattttagttgttagtacacaacagctcagtatcttgactgaaactcactaaattacatgctaagatgaaaattggtattcccctgatgaacatttgaagtattgactgcattatttacctcggaagcaagaatttaccttattcagcaacacacaacagtcactgatcatgtatcgagtaggaagattgtccgtggcatctacaactatatcatatctgtgattgatccatcagtggaaaaaaaaattcagtaaactctaaaaggcacaatatattgtctcaagacacttaatgtttcgatagcatactttctcacgatttccaaagcattggaaggtttcaaagtatgatggtactccatcacgttgatagacgaattaatcctgaacagaaatagcatattgacattacagaagcagtagcctcaatatgaaagatcttctttgaaccataaatatttcaatggatggactatataacgacaatctgttaaaaatacagatgcttactcacggcaggcgtcagccgctgacttcacctttgatttcccaacaaatgcttctttgtggattatctgagaggacattcaaggggaaaaaaaaaacagagaacgacatgccacgtgaattttcgagaacaaaatgacccactgttgagtgattatgaagttgctagctagaaagtgaatacaaattatgttcctacggttatcaatcagtaatcaaacatcattcaaataattcagaagggaaaataatgaaagtattagagaacagaagatacatggacaaaatacacgccaaattatctgtacctgtcggtgaaggttattaagctcaacatcatctccatcaacaatgcccaagcaacctaggaagacagaaggttgcaagaaagcaatgaattacctactccaagaaagtcaaggaccatcacaagtaatccatctaatcccaccgtcagctagctatacaaacatgattagttcttctcaacaaggagaataattggagcacattgaaattcagaacaatctaactgcttccttataaaactaaaaccaattagccaagaacagcttcagtaacaaccaacaagaagtaacattaccaacaccacaagctgctaggtacagtgccacgggcgagcccaatcctccagcgcccaccaccaaaatcgatgactgcgagagcttacgctggcctgcgacatagctaacaaaaagtcactagagtctccactacgctgaggctacgataacgcgccatgtgtgagcagctgagcttaaccttcgaccccgaagtccgggaggaggaggtggcggctgtaccggtagatcatatcggccgggaggccatcggcggcggcgaacccattcccacggcggcgtatggggcacgcggtggcgccgccaccgccgcctccgcctcctgcccctgtccccgccgcgtcgccctctcccgcgggcgtagggctagccccgagctgcgactctagcaggcgtatgcggctatcgagctcttccctctccgcccgcagcctctccagctcaccggccatcgcctccatcctctccctccgccgccgccgccgccgtcgaggttagtgttggagggatgaatagagtggaagaaatttgcaaatagcaccctgaaatatattcgtatcttggtttgggctgtgggcctatccttgggccttggagagtgcttacttggactctttgggcctgcttagcaactctagtactccaaatcttttacttgtacttgctaatagaattgcacctgtaatttcttgaggtactgcacacaatatcgagcgaaaataaaatgctgctagctccttttttccttcgaaagacagtacaagtgcactcacaacacatatgagcacttctaaaagactgaggaggtatattttgataaagtcgacacatcattgtcgagagatacgccatctaccgctaaaaaataattagccgtaaatagagtatcgatgtcaaatctaaaatttgtaacttggtgggcttgttccatcataaaaaacctaatcagttgacttacattcacttcgtgctgctagctcttttttttcctacaaggaacaaaatcatgttgttttcattgtcaaattgttggttcccgacgtgtatttgatactatatgtttgttccattgtatctaaaaaaaggcacgtaccagagcatgaataatagttcggacaaccttagaaagcgccagtagtgtagtgatgaagtccttggtgctcataaatatcacgtatatgtggatgtttttaataggattgtcagagatgttgctagtcattgtttctttctttaagagtttattaggaggcaatttcgcgactatttaaagttatgtggcatgtacagtgcgcacacatatttttttttgaaaatagtaagaaaagatgtcacataatcttttcatgttatatttagacaatatataatcaactcacacagcaacaatcttctatctccgttgtctctttctctagttaaaagtatcgtgtgatatcttctttcagatgctgacatctgccctaaggtactatacagtagtagtagatttgttgtcacttgggtaagtaattccgtcatgatatagaactaaatattactttcatggtgtgtttcagcatatagcgtaaatggtactttcttgaagtaactttagtgtaaaatatatataccgtactggcaaatgcggactcgttgataatgactttcgatttgaaatcatctttggtcccttatctgagggtcaagtttggatcacattcctcaagtataaaatcaggtataacacattcctctatttccaaaactaggacaaataatctcaaggcaattttggatagcgatttcggcggacgtggcacccaagtggtgcactgacttggtattcatctgatgtggtatctacgtggcataacaattagaaaaaaatatataaaaaatagcaaaacccacaatcagtcccaagaaaagaaataaaaaccagggcccacgtgtcgatctccttctgcagcctcggcttctcctcctcctgccagtctagctagcctcagccttgacctcggttggttggtccagatggtagtgcagtgacgaagagaagtaggcacgctagcggcgagcagctccttacttgtcagggagggtccaaatgcgacccgtcctcctcgccattggcaacctcgatgcagcttcctcctcctccgattcagccgcccctactccgaggcctccactaccaccttccttatcctccacaagcttcgcctggcttcctccttctcaactgcttcctcgtcaacgtgtgcactatcaacagcttgaaacccattatgtggaataagggagcaatcctcgtcaacgcgtcaatgcctcaaggagatggtccacgtcaacagcttgaaaaccatcatgtggaatagcggcaaggagaacattgtcaccacggccgaccgtggcggcttgccatttcaactttgatggcactagccgctagaggagcagcgccatcgagccttcacgatttgaaggaaaggggagaaggatttggggggagacattggagcgtcaacattgatgaggacgcttgctcgcttgagtctagtgcaagcttgacctcggtgacaaggtggcgcaacccgagcttgacgatgaggcggcccaacccgtccctctccctcgcctccaacctatcctcctcaatcgacacggacagccgtggccccctcctcgctggttccctcgccttgaagagctcactggctccctcatctcgcctccaaccgaccaacggagcctcctcctcgccaaccgctcaccgtagccaccgccggccaccaccactgccatgccgccatgcgcgccaaagggagagggaggagttgtgtcgaaggtagtcgatagtgatgacgcttgagctcgacatctgccgctggccacatctgggaagggagagggaagaaaggaaaggtagtgtcaccagctggagcctggaggagagagggggaggtggaggaggtgtggcccactacttttgttctatctttttgtttgactagggcccacatattttgttttatttttttaatgttgcttctagtgccacgtcaatggcacgtgtggcgaggaccaaatcaaatgagccacgtagatgtcatatctaatgaaactgccatccaaattgccttaggatattggttgtactggttttgagagttgagcttcttacctaaaatgaacttgttcgtttcgcatttcggcatgtcctccacccctttattctttatacttcttgtttaattataagacgtttaacgtttccttactgaacaaaagtaaacatgaaatggagaaaagcttatactccatccctttttaatagataataccgttaacttttagaaacacgtttgatcattcgttttatttaaaaattgtatgtatgagatataaattatgtttaaagtacttttgtgataaaacaactcgcaacaaaaaaatgataattaaataattttttagatatgacgagtgatcaaacgtgtattcaaaagttaatgctgctatctattaaaaaaggaaaaggatgtagtaaatgtctacagtgaattttggatttaagttgggttagaacacacagacacagtgccgtaaaataatgaacctttgccatattcaagtccagatactgctacaat

SEQ ID NO: 61591 - DNA, 9174 bp, Oryza sativa
ggcccgacgatgccttatgttttccgtatcaaatcctattccaaatcgcacaaatacctgtttgcggtttggttcagatgctgtgctgctttcatttcgcagcgaagattcctttccggtgtcaatccaagcgtcaactgctgcagacagaaggccatggttctccactcgccatgattcagattttgagcctaacgaaaacggaggacacgcctgattgatccacccgaataataataataattctgcgaggctgccacatcatccatgaccgcatcttaagcattaatcaaagccctaacagcggatggggacaagaaacagcaaacccttgatgctggcaaccggataagatcgagttggatggagagagagagagagagagagagagagagagagagagagagagagagagagaagcagcagtggtagtacttgcttcctgtatcccacaagaaacaaagcatcagattcctgaaagaaaaacatactactactactattacccagtcaatttcatatttttgtggaaaaatttcttcatgacactatggttatgtttagttctacactaaaattgaaagtttgaagaaattggaataatatgacggaaaagttggaagtttgtgtgtgtaaaaaagttcgatttgacggaaaagttaaaaatttaaagaaaaatgttggaatttaaacatggaagttgctataagattcggattttatcttcatttctgttagcatatttttcaaattactagacggtgtgttctgtaaaaaaacattctatatataagttgctttgaaatatcaaatatatctatttatcaaattattataattaaaacttaattaatcatgcgtcaacacctttctcattttacgtgcgcgaacctaacctttctcattctacatgagccaacttaatcatcaacttcatcggtttcaaacaccacggtgtacaaattgcaaattagacacctgatatttgtgagtatgacacgtgggacccaggtccattaaccagtggcacgtgtactgcccattttctccgcatcgctaggtgggtccggtggttcagcatcaatggttaattaactgtcaccgctttcttaccgtcactagctataggacaagtggctaagctaacctaagcacgacaataattaactagatttttcacaatttggagcttttaaaatactttttttttgcaaataaacccctgaaaaaacttgtcctaaaaattgtctatttggacgccagagtcgctggtgccgtcctcttgtcccccacccctcctagaaaaattttaattagtgtagaggagagagatgtacaacttttttttatctttttgatatatttttacacttaggagcacataacaaccaaccatagaaaatagacgaaatatgtaacttgtagaattttttaaagctctgtcgaaaagtttctcgcctcgaaaacacaatcttacaagcggaatttggagattataatttcatcgaacacggatgtaactttttctgtagatgtccgtggttatattattttcctgattctgagtatgaaaaaattgcgcctgttttaagaaatgacacccaaatataactaataaaatacaaaccctaacttttttataggatgtaaaagatgtaaaaaaaaggctcaagagtgttcgaaatctaatctaccttttttttactatatgaaaaaccaaaacgaagagcagggagagagcgcggggagtgggggggggacttttcagcagagctttgtaaaattctacaagtcacatattttatccatttaagtttaatttttctatggttggttcttgtgtgctcctaagtgtgaaaaaaaaatatcaaaagaaaatgagagaaagaaaattggggtgggggaggggggcggcgccaaccacattggcgcgctccccctgccacctcagcgccgccccgccacagtggaaggaggctggcgccagtgactctggcgtcaaaaaatgattattttttggataagtttttttagtgactatttgcgaaataagttttttaaaaggactaaattgtgaaaaatccagcaataattaatggagaaggggtcctatatatttcggtgcagctttgttcaaccctgccctctctgctgtgcttgcctccaaataattttttcccctccgcttttgctgcctcgtcttctctagatcttaattaccacgaaattgcaatgagctagctcgtgtttgcgagtataggtagctaggtagctaggcgtaggggaggttgccggagaggcagggatcgatggaggtgttcatccacgaggagtacgtgcacaagcggagggagcagcggcggcggcggggacggcggccggcggcggtagcgctgcagctgctgcaggtacagtcgtcgtcgacgacgacgaagccggagaagaaggcggcggcggcggcggcggcaggaggaaggcggccgctggctccacttgcaacggagcttcaggatagcccgtgggacctaccggccggcagcggcggcggcgcgtcaccgtccgacgccgctgggtctccggcggcggcggcggcggctaccgtctccttcgcggaccatctcctcggctacctctaggtgaagtacagagatcggttgattaattagctagctatatatgcgtgtttccatcgtctgcctgtaattaagttggatcaggtaataataaatccgttggcatgattttattcttgtccgagctagctagtgtgctagtgtgttcgatttttctgctttttgtaagcatgaaattctctcgtgctgctcaacgtgagagtcccttgtaggaggcaccaatatttttggagttgatcaagtggaattaatagtggattatgctgcgtgattaattaagctaagtagattaagatgggctcgtgacttggttaatcctaaatgcacataggaaatggtaaaatactcaccgcccaaaacaggaatgcacataggaaattgctgaaaatcctaaatgggagaatcagcagatcagaacgacaagatccactttcccgtgatttctgtgtcacagtaatgtcatgatctcacactacaggtttcccagatgcgcctaggaattaacagatgggcaaaatttgaagcaagagagaagagagacatgagaagttgagagctgacgtgcatctcaccaaacaggtccaatttcaaccggaaataaaaatcctctattcaaccagaaataaaaattctaagtgcggtatccaatgcaaataattaaactttaaaagtgtttattccttacagattaaatttttatcgtgttcatgagctaaaactacatgtccgtagtgttgtacatcaaaagctaccatattattattattttttaaacatagtttttgcctgttggactctgaaacagatacatgaaattgacaaaacaagcgatttaaacagccttccatggtcacaaaactgatcttgaaaaaaaaaaggtctattcattcactaggaatgtgtccatttcaatgtttgtcccgacctctttctttgtgacagccttccccacgaggacatgcccccccccccacccccacggggatgcacgcacggaccagaaaattggtgtttcactcaggtaagcgcctgtttacttcgtgaaaagaaaatttttgggtgtcacgtcgaatatttgaccggatatcagaagggtttttcggacatgaatgaaaaaactaatttcataactcgcttggaaaccgcgagacgaatcttttgagcctaattaacccgtcattaacacatgtgggttactgtaacacttatggctaatcatggactaattagactcaaaagattcgtgtcacgatttcctctctaactgtgcaattagttttttcatttacctatatttaatgcttcatgcatgtgtccaaagattcgatgtgatgtttttgggaaaaaaatttggggaactaaacagggcctaaagattactcttatacgttaggccgtgtttagttctaaagtttttttccaaacttccaacttttttatcacatcaaaactttcctacacacataatttttcaacttttccatcacatcgtcccaattttaaccaaatttccaatttcagtgtgaactaaacacagccgttggtttataatttttttctgtaactttttatttttattcttcgaacagcacctttaaaatgtagattaattaaaaaacatactactttctatccaaatggaaaaattactccagatcaccttttactgaaacagtggaaagtatttgaaacatctcaagttcacttcattacaaggatgaaagtatttttttctcgtattttctcttttttttacgattacacggcatatgcacgcgcaacgccacattacactcacatcctcatgactacatcccctagcacacattcaagaaacaaaaatccaacacatcactaatctcattaaaattttgttgaaagctcaccttattttgtccgtgaccttggtaacaataggtggtgtgacaaaagagtgcatcaactttataacattttttaagatgtcagtaaatcatggacaaatagtaacactctcaactatactccatccataaccataaaaaaaaactaataccggatgtgacacatcctagtactgcaaatctaaagcgtctcacccagatttgtagtactaagatgtatcatatcttgtactgggtttgtttttattgaacggagggaaaatgtggcataagtccataataaaatcaaatttcccatgcaatatgggacacaccaaagcaccactacctaatctgcattttcttttccttttatttaagagaaaattccttgtgtgcccttcaaaactcacccaattccttctgtaccctgaaatttactcaatcctttctatgtcctccaattttttttatcccttatgtacccctaccattaggtttccttcaatggactggttagtttgtttgcaaatgttcattgtgccgttgagaatggaggagttgctggaagctgagtgcctggttggcagagaatttgataaagtttgaaatattcatgagtgaatcataggtgtgttttatgagactaaaataatcagtgcgttgaaaatttaaaataattttcttcaaacaaatttaatgcattgaacttttgctatatcatgtactagggcaatggatcctaaaagggtactatgaaaattttaaaaatgactggacattatgatcccatccatagaaaacactgttaatgcataattaacgaattacttcataccatgcgtacaacacattaccatttccatacacaaaagcgcaattaacaaactaaataaacaagataggaactgtttatatcatgagcatcattgccacaacagtagtcaccccaatagcaagcaatcctgggcattacggtgctatggtagcaaaaatcctgagcgggcttttctacgctgaattgttttcttgaagttcccaaattatctcctttattttctacatgcacattttttcaactaccaaacagtgcgtattgtgtaaaaaaaatatacaaaagttactttgattatttttcagaaaaaaaataatacttaattaataatatactaataaatcgttctagctgcgcgtagttcccaacagcaagtatcgaactcagcctctgtggtggtctccattgctctgcctgcacgtgccaattgcagcataccaagttaaagcgaaagccgaaacaagcttggatatgaaacaaatttaggcaccatgcttttaatctggaagctgaaacaaaactttttttatgttgttgacctctttgctctcaggacacataaatttcagtgcttgtcaacttttgtttatatttggaataagttcatctaaggtcccttaacttgtcaacgaatccgattttcgtccctcaaccggaaaaccagatacaacgggtccctcaactatcaaaaccggtgcaaattaggtctctcggcggttttgatggcggttttggctgacgtgacgcctacgtggctaatttgacttggtcttcatctgatgtggcattgatgtggcgcttacgtggcaatttgatccggaaaaataataaacttcgcgggacccacatattagtttcacacataaattaataaagaaatggtggggcccacgtgggcccccctccttcgtcctctttccccacctcccctctcttcatctctcccctctcctcggacatgcgggaggcagcggcggagaccggcaatgccgacggggcgacggcggcacgaagccgacggggcggagtggggcagcggcgggcggacgcgcgcgccaagaggtggtgggcttctcttttgactttattagtgttaggaataagttcatctgcaggtagtaatcctgaccctgcatagatcgatcgtgtgctgatcaattacttctgcttctgatactgtaatcctgcggcggatcaattatttcttctcctgatctgagcaatttgcgccacggatcgtcgtcgtgagcctgtatcgatcgatccattgtgtgcttgtgtagtttttcactgggttatattcgttttagggttggagcgtgcggtgcaagagctgcctgcgccggcttctgtagtcgctgccaaatccgaagctgctcctgaccaagctgacgacgacgatgatgcccaaactgacgacgaggagtagacgtgcggcaggaggacgccggcgcacagcggcgcgaagccagcggagcggggcggtggcggcgcgcgaagccagcggggagagggcaagagatgataaaattcacgaaatttcattaaattcaacgaagcgtgcgtggagggtggtggcgcgctggaagacgacgacgacgaggctggcgctcaccgcttggctccgccgccccgccggcttcgggcgccgccactccgtccgcgcgtccgcccgccgctgcaccactctgccccctcggctgcgccgccgccgcgggcgtagcgccggctgccggacctccccggcgcctggagagaggagaacggagagagatgaagagaggggaggtggagaaagaggcggaaggaggaggccgagaatgacatgtggggcccacgtgggcaccaccatttctttattattttatgtgtgaaactgatatgtgggtcccgcgaagtttattatttttccggatcatattgtcacgtaagcgccacgtcaatgccacatcagatgaagaccaagtcaaattagccacgtagacgccacgtcagccaaaaccgccatcaaaaccgttgagggacctaatctacaccggttttgatagttgagggacccgttatatctggttttccggttgagggacaaaaatcggattcgttgacaagttaagggaccttagatgaacttattcttttatatttacagaaaaagaaaatttcagttcccttccccaaacccaacctgccgagcccacataaggaaaaagtacaccgatggtccctcaacttgtcatcgagttactaaatcgtcatctaactacaaaaccagatatccaacgtcccttaactaatcgaaaccggttacgataggtcattaggtggttttgactctggttttatcctacgtggcagctgagttagcgtgggacccacgtgggccccacctgtcagcgtggccacatcagcctcctctctcttttcccctcttctctctctttctcatctctctcccttctctgccaccgtcgactgtcccaccagcatgaaggacggctggagggcgcaccagcgcgtcgcgtacgacggcgaggccaagaaccttaccgtcgcgctctcctacggcgacgcggcggcggcccgacggatcccgtgctctggtacgccgtcgatctgatggagtacctccccgatgccgtcgccgtcggcttcttcgccgctacgggcgaggccgccgagctgcagcaagtgtagtactgggagttcaccaccagcatcgaccccaaggacgtgtgggtggtgttgggactctacagcttgcttcttgtgctcgtcgccataggggtgctctggttcgtgtcacaatggaggaaagccggagagctcgccgatggtgacatctttgacgagatggtgtacgacgagcttgccgacgaggagttcttcgtggagagcgggccgaggcggttccggtacagcgacgcgcgtccgcatccaacgcgcgcgccggccgccgccaggtcaccgccacaccttcctcctcccccgcgcgccggtcaccgccacaccttcctcctcccctccgtctcgccgccgcccgaaacggcgtcggctggggcacccggcgcccatggtggaggcggctagatccggattcgccgtagcctctcagccatcgacggtggccggcggcggcgcagtgctcgcgctcgtcctcctcctcgtcctcctcgccgcggctgagtggtggcggcggcggagcccgagccctagtggtggtggtggtggcagcggccgcagacctcgccgatggcgaagaggctacggcaaatccgaggcggcggcgccatgctcgcgctcgtcctcctcctcgttctcctcgccgtcgcggcacggcgcgggcgagggccatcggctgccgcctcgggcgcagcaggagtacgacgtcacctccgccaccgccacggggccttgcgacgcctacctcgtgttccgctgctccccaccgctctacgcctccgccatctccatctccaacgtcctcaacatcaccgccaccgccgtcaccgaatccaacgccgtcgacccggtcacccctgtcgccgccgaccccctcgtcctcgcgcccgttgtcggcgacctcatccccacccgccggctagcttgcccgagaggagagggagagagagaggaggaagggagaggaggggaaagagacggagggggatgaagtggcattctgacacgtgggtctcacactgactcagctgtctcatgttgcgtttaggggacgattttgtaactcgatgacaagtagaggacctcggtatactttttcccccacataatgctgggcccttccttagatagcccagggcaagcccggcccataagcccaggccag

SEQ ID NO: 61592 - DNA, 19601 bp, Oryza sativa
tggactaattcgcgagacaaatctattgtgcataattaatccatgattagcccatataatgctacagcaagcatgttctaattatggattaatcaggcttaaaaaatttgtcacgtaaattagctctcatttaatacttctaattaatgtccaaacatccaatatgatagggactaaaatttagtacctgaatccaaacaccacctaagccttattggcgtcagattgttgacagaaaacacgtggcctgggagatctgcttaactccagtgcaggtccaaaactcgccttcggatgtattagcgtgacagttgatttgatcctgtaatcaacaagaaatagaaacaaagaaaccgtagttaaatctataaatgatagccgatcggctagatgccgatgacatatcatttatctttgggccgatgtcatccatgtatcgatcggcagtcataaataagtaaagaagaactaaatctactcgatcggctatagatattaacgatatatactccttatatcgatgtatacttaaatcaagtgattgggatagattggtcatcatgccgagacagtataaatcacttagatcgaaatatatgtcaataataagactatatatgtttatagcatagacgatcagatagatctagcatgtatcggctaatactccgatactactctatatcaagatattaaagcaagtataatatattgagcaaaagcctaacatacttagatacaacaatatcttaacataaagggcagatttaacatgtcaataaggcatatagaacaaatgaagttaaatcagatacgatcggctgaaactccgatgctattctaatcggcaactagaaggcaggctagagatcgatattctaagcacgacttaatagatcaaactcaactgatgcagcattaagtatgaaaagaagaacaatttctagacaatcaagccgctagaagtttcatagaatggtagatatctcatataatctagatcaatatcaaaatctaacctaatcggctgccctctgcatacagatgttagccgatagtagattaggtggcgatattgctagagattatgtaaggtatatgataactcgatgaattatataaataagatgagagtatcataaagatggaagcactaatcctaagaacacaatccgtcataacgaattttacctcttgttgatgatcgaaatcgatgcagctcaacccgaaagcaagaactcgtcgaaactaaagcaaaaagggtggcgatgcgccgagattgtattgaacgtgtgtgttaaaaattacatagggctcggggtctatttatacccgaggattacaagatatgcctataccggacatgaccactatctctaacaaactctaagataccacaagtctttgcggcagacttttgcccacacttatctataagaaatttacataaaatatcctaattaatagatacaattgccttcccaggactccatccatacgtgacaatcatcttgaagtacattaacttgaacccgatgtcgcgtacaagtcatattgtcggaatcggctatatcggcttatttagctcgactcagactcagccgatcccaaccgtagccgatccgggcatcagccgattcctgctttgtttccgaactcgatcttctcttccgactttgcttcgatctaatcttctctccgaggctgatgttaccaaatttggttgttaacacagaccaacaaggctcaaactgaatttattaaaaaaatgcagtttgttgagaatgatgaccgaaattaacttaaagaaatagggactgtctagtattgtcaactaaaaaaatcatttaattttttgaactgattgtacaagattcatgcggaaacacgcaacaaccttaacctcaccctttttttcccttttccttttcccgtgttcacttaggctccgttcataagtcctagttcctaacttcctccgcctcattttccgcgcgtacgtttcccaaactgctaatggtaccttttttttaaaaaaaaatttatacgaaagttgtataaaaaatcatattaattatttttgaaaaaaaaaactaatacgtaattaatcacattctaatgcattgctccgttttcccattccagcgaacacagccggagctagtcctgcgcatccgcatcttggaagaagaaacgagcaaaatacaacacgcaaaagagtgtttccctatgctgacggctcacgtcttctttttcttttttcgaacgactcacattggatggtgcgaagttctattgataaaacaggaaaaaattaaaagattacaatctgtaaggtcgtaaccaggaaaaacaaggcttaaagtcttcaagataagtttttaaaacgagtccaagccgccgggcagactgcgaatttgcaaacccgtcgaatgccagccagtgcacccacaacttgttacttggcttgaatcaaactacacagtggcaagtgctccttccagctatatattaatcacatcataaccttcaatttgccttaagagatatagcagaaaagaaaggaccaaccaacagcggcagcaatggtgttgatccaccatacccatgaccatgagcttctcttgctcgccatcatcatcttcctttcgtgctctaacaatggccatgcctcccggcctcaccttcttcatccaccaccaccaacgtcaccgaccgccttgcgctcatgtcattcaggtcgctcataaggagtgacccaacccaggcactcgcatcctggggcaaccaatccatcccgatgtgccaatggcgtggtgtggcgtgtgggctgagtggacgccgcacaggccgtgtggtggcgctggacctcaccaagctcaaccttgtaggcgccatctcacctttgctcggcaacctcacatacctgaggcggctccatctccacaagaatcgcctccatggcgagataccgtcggagctcggccatctccgagacctgagacacctcaaccgcagctacaactccatccaagggccgatcccagcgacgctttcaacctgcagaggaatggagaacatttggctctacagcaacaagctgcagggccaaataccaagtgagtttggatccctgcaaaatcttcaggcacttgttcttggggaaaatagacttactggaagcatcccttcattcattggaagcctcgcgaatctgaaatttctaatcctagaagaaaacaactttacaggagaaattccatcagacataggcagactggccaatctcactgttctaggactaggttctaatcaactctcaggaccaattcctgcctcaataggaaatctctcggcactacaatttcttagtgtcttctctaataacctggtaggaagcatcccaccgatgcaacgcttgtcctctctcgaattctttgaactagggaagaacaatatcgaaggaagcatcccaacttggctgggaaacctctcatcattacttactgtgaaacttggaggcaatagactagatgggaacatccctgaatcactggggaaactgaagttgcttacatctcttgatctatcaagtaataatctagtgggcccagtacctgatactattggaaacctatattccattaagcagtttcatgtagaaaataatgagctagaaggttctttaccttcttcaatattcaatctttcctctcttgaagaactcaacttacaaaccaacaacctaaatgggaccattccacttgacttaggcaaccgcctgccaaagctccagttattcctaatatctgaaaaccagtttcatggctcaattccaccctccctgtgcaatatttctacgcttagatggatccaaacagtaaacaattctttgtcaggaaccatcccccaatgcataggaatcaaccaaaagagcttatattccgtaacttttgcagtgaatcagtttgaaacgagtaataaatatggttggagcttcatgtctagtttaactaactgcagcaatttgcgactacttgatgtgggtgacaacaagcttacaggtgagctaccaaattcaattggcaatctttccacacgtcttgagtattttgtcaccaactacaacagtatgactggcaaaatacctgaagggctagggaatctggtcagcttgaagttcatcgagatgaacaataacttctacgagggcacaataccagactctcttggcaaactcaagaacctgaatagactatatctcactaacaacaacctttcaggatccattccatcaagtatcggcaaccttcgtatgctaacattattatctgttgcaggcaatgcacttagtggagaaataccccccagtctcagcaattgccctttggaacagttgaaactctcatacaataatcttactgggttgattccaaaagaacttttcgccatctctgtcttgtctacttctttgattttggatcataattttataactgggcctctgccctctgaagtgggtaatctaacaaaccttgcattacttgatttctctagcaatttgatttctggagagatcccgtcctccattggtgagtgccagagtctacaatatctcaatacatctggaaacttactccaagggcaaattccaccatcactagatcaaccaaagggcctcctgttgcttgatctttctcataataatttatccggaagcatccctaagttccttgggaccatgacagggcttgctagtttgaatctttcattcaacaactttgagggtgatgtcccaaaagatggaatctttagcaatgcgactcctgctttaattgagggaaataatggcctatgtaatggaatccctcaactgaagttgccaccctgctctcatcagacaacaaaacacaagaagcaaacatggaaaattgccatggcaatttctatatgcagcacagttctatttatggcagtagtagccacatctttcgtgttccacaaacgggccaagaagacaaatgcaaaccgacaaacatcacttattaaagagcagcatatgagagtttcttacactgaattggctgaagcaacaaaaggttttacttctgagaacctcattggagcagggagcttcggctctgtgtacaagggaagaatgaaaatcaatgaccaacaagtagctgttgctgtgaaagtgttcaacctcaagcagcgtggttcatctaagagttttgcagcagaatgtgagactttaagatgtgttcgacatcggaaccttgtaaaggtactgaccgtatgctcaagtatcgattttcagggccgtgatttcaaggccattgtatacaagttcctaccgaatagaaatttagatcaatggctacaccaaaatatcatggaagatggtgaacacaaggcattagatctcatcacgcgactagaaatcgcaattgatgtggcatcctcacttgaatatcttcaccaatataaggcatcgccaatcattcactgtgatcttaagccaagcaatgttctcctcgacgatgagatggttgcacatgttggtgattttggccttgcaagatttcttcaccaggacccagagcaatcaagtggttgggcatcaatgagaggcacaactggttatgctgctccaggtaagctcctaattgttgtagcttttttttatcatatttcatattatatgtatcctactatgctggattcagccaaaatggagtaagacttattggtacttcattttactacatagacaagttttgatgaaactcttatttccctaggaatttgaaaggggaaaaatgaacaagtatatggtagcaaaatgttgtatcctgtaaatggatttcgcacaaacataaataggcttgtggagttattttctcataagccatttcttatttttagagtatggactgggcaacgaagtctcaatccatggcgatgtatatagctatggtatattgttgctggagatgtttagcgggaagagaccaacagacagcgaatttggagaatcccttggcctccataattatgtcaatatggcattgccagacaggacggctagtgtcatagaccttagcttactagaagagacagtggatggcgaagcaaagacatcaaaatctaaccagacaagagaaatgagaattgcttgcattacctcaattctgcatgttggagtttcctgttcagtggagacaccaacagatcgcatgccaatcggagatgccctgaaagagctgcagagaataagagacaagttccacagggagttgcaaggagcaggagcgacaaaccatcaagacattcaaatctgttgatgcgcagcaaccaaccggatcaataaaggcgtaaagagctgcaagatttctgctactccttgccatctaggctagccaaaataaaatcataatgttgcaaattacaaagtttggcattctgtttgatccttgccatgaagatcttgtacatactatgaaccaaccacatcttggcaaatcacattattatatgcttttcctttgttgatatttcttcctcacaaaaccatatatgcctttctattccccttttgtaagtgacacagtaaacctagtcgcagtgaatctctaaaaaaaaaaaaacactatacgcttgcatcttagtttaactacccgcaggattccatccatccaggtgagttccccttcctttgtttccattaggtaatcacagaatcacagtagatcactacatatatatgaacgaaagtggggaagagggcgttccttcacctccggggtagcgaacgcgtcacgctagaaggagaagaggcgtgtcgcgggcgcgggccgggagctccgctgccggcgccggggttgcggcttcacggcgagcttcgcctggatgcggggccagtggcgctcgccgccgacggcgtcggatctccggtgggccgtggggcgccgcgtggcggagagagaaatgggagtgagggagagaacccaccgaagcaaaaggggagagtagatttgggctttgggctttgcttaatgggctattccccctaaggccgacacgcatgtggatccatgaattttggagggtttttggaaaaagtacaccgaaggtccctcaacttgtcatcgaattacaaaatcgtactccaaccacaaaaccagatacaatacaggagatccttaacccttaacttacaaaaccatttacttcagttccttcggtggttttaacttaggtggcggctgagtcagcgtgggacccacgtgggccccacatgtcagtgtgtacagtcagcacctctctccttccactgttttctcaccctcctctctctcactcgggcagggcagcggcaggtggggaggaggccggcgggtcggcggggcgaggcaggagaggaggtgcggcagctggcggcggcagcgggagcatggggaggcccagctgcccgtctgccccgacgccgccgcggcgcgccgtcgtggttgcgggagaggctgtcgacgatgaggaagagctgggcagcgacggtggggaggtgggcgtgggcggttgccggcggaggaagagatgggcggcggcgacagtgggcgaggagctgggccgtagaggcgatgtgtccggcctgtactttgatcgtctcaggggcagtactatcacaatttcaagttcacctgtctcttttgttcttgagagaagttcagttgtttccaacgaaagtcaacgctttgctcctctctcaaggcctcgatacaggattttttgtttgaaaaggaggattttcggtattgattccaagtcaatggtactagttttgctcaagtaaacaaaagcacaaaacacacatacatgtcgagttctaacatgttgctagtggatgaaaaacgcctcagcttttacagttagtgtcatgaagatctgctagatttttttcttatgtcctgatgcacttgtttcctgtcaaatttctatgaaaatcacgcagaattcatacgattttagacagccccaacattacacacacaaacacaaatgcatataccatgctcaatgtcctgcttgaatctcttgtattcctacaaaacaatacacatccaatttctctttacaatttacaaatcactttactgatcattctgaaagatgatcagttgagaaatttgaggtagtccttgaggtccgtggggaagcaagggtactactgcctccagaacgcgccgtgcgctcgcagcatcttcaccgccttgtccttggtcgacggcgagctctccacctgcatcagcgccagcagcttcgccacggcgccgcccaccaccatgtcctccagcaccctctcggcgggggtgggggcgcacgccaccagccacagcacgttgacggccagcctcgtggcgagcccggacacccggagcacggcgcgcgccacggcggccaccgccagcccgtgctaggcgaaggccagccgcccctcggggcacttacacaggcgcttcaggaggaggagcgaccgctcggcgacgtggcggttggcgtcgaggaggagcacgtcgtcttgccgtacctgaagaaccaccgctccatgctgcggcggtcgtaggtgacgccggtggccaccgtgacggggtcctccattagctccatcgagatggggcactggaacaggggaggaggctccatggccgtcgtcctggtcgcccggcggccgccgccctcctcctcccaccaccgcgctcgcctccggccccgtgccgttcctcgtcgtcgacagcctctcccgcaaccacgacggcgcgccgcggcggcatcggggcagacggggcagctgggcctccccatgatcccgccgccgccgccgccgccggctgccgcacctcctctcctgcctcgccccgccggcccgccggcctcctccccacctgccgccgccctgcctcgagtgagagagaggagggcaggaggcgagaaaacaggggaaggagagaggtgatggcgtggacagtccgacaggtgggccccacgtgggtcccacgctgactcagccgccacatcagagaaaactgggttcaaaaccattaaaggacataaaataaacggttttgtaagttgagggatgtcgtatatctggttttacggttggaggacgattttgtatttcgatgacaagttgagggacctttggtgtactttttccgagggtttttcatgattggttttagtggattttatcattctttgggctccttgcaatgaaagaaaaatcaaggaattttaaaagatttgaatcatacaatgaaattttctatgagactcttttgggataaaatattgggtctctaaaatttatactccttataaaagggagtaatggcccaccaccaactttcaactttctttaagagaaaaagggacatagtctcacttgttaactactcataccaactctctattttttctgggaatgaaaaatgaaagttttacagagctcgccaacctttatcgccgctactgcctcccacgacaggctcactaggtatgccgcccacctcgagcccactcgtcacttttatcgccgctactgcctcccacgacaggctcactaggtatgccgcccacctcgagcccactcgtcactgacctcccactgccattgctgtctctcacagatgggcctgccgatcgtcaaccttctccctgctggcaagttgttggggaagagaagagaggtgaaagtttacttacatgtggcatccataattttttttctgattagaatgccatgtcagttaaaacaaacatccatactgttttagaagtaacttgaacagtttttgttaagaggaggggtgaaaaattccggttatatggttagggatatcacataaactcgtcgtaaagataaaggacagaaagtggacttattccacctctgtgcactgaccgttgaaggtttgaagaagcccaagagagcccaaagcaaggcccgtttcttcttctgcggcgcccggcgctcggcgctcggatcaatcccgccgacgagcgcctccggccgccgcctcccttcccccgccgcgggaagctcatggcccttccagcgcagccgctcccgtgtcctgaacgaccaaccgccgccgccgcccggccatcgcgtcatcttcatccaccctcgaggcgacctccccggaggtaaaccgctcccccccccccctcctaatgcctgcacgattactaccgattccttctacataactagcaaagtgatccgtaggaacatttcttgcaaaatggttgtagattcagttctaggtcgtcaactcgtccgccttggagaagggaatagatctcatagatcgaatggggtttctactttcttctgaacaattttttttttcgaacaaatgccctagtattcaattttttttagccgcacagcacttacaaatttgcaatcatgtataatatagagcctctctgtaattgatgctagctttacataaacaaaaagctgcagaatccgcagcttccggcaccttatttgtgtgttcaatgacatggagcataatatcatgccatgcgcaaaaatgatcttggaatgcttcattgtcttcattggcttgatgttccttcattggacacatgtttctcaaacttgtctcttattgcttgcaactccttcagagcgtctccgatttgcacgcggtccgttggtgcctcctctgagcaggagattccaatgcgcataaccgaagtgacacaagtaattcttagatccttgccgttgtaagagtttgacttgattgctccgccatcttctgtctctggtagtaactgttgatccagaacattagccgcattgtctggcaatgccatttggacatacttgcgaagcccaaccgcttccccgaattcatcgtctgtgggtctttttctggtgaacatctctagcaacagtatgccatagctatagacatcaccttgaattgagacttcattgccaattccatactctgaaaccaacaaaaggaactgtgaagaagaagaaaaaaatgggtacatttccccattctacataaaagggacttctgtcgaaatatactcatataattaagtgagtcagataacaagaaatcctactttagaaagcagatttcttgagttatatacacagaagagaatacagaattatagcaattagagacttagaggtgcacctggtgcagcataaccgactgttcctctcattgatgcccaaccacttgatttctccgactcctgatgcagaaaccttgcaagcccgaaatcgctaacatgagcaaccatgtcactgtcgaggagaacattgcttggcttaagatcacagtgaatgattggcgatggcttatattggtgaagatattcaagtgaagatgccacatcgattgcaatgcgtagtcttgcagtgagatctaatgccttgtgttcactttgtcccatgatattagggtgtagccattggtctaaatttccatttggtaggtactcatatacaatggccttgaactcattgccctgaaaatcaatactcgagcatacagtcaatatcttcacaaggttccggtgtcgaacacatctcagtgtctcacattctgccatgaaactttgagatgcaccacgttgtgtgaggttgagcaccttcacagcaactacttgttggtcattgtttgtcattcttcccttatagaccgagccaaagcttcctgctcctatgaggttatcagaggcaaaaccatttgttgcattgactaattcagcataagaaaccctcgtatattgctcactaatgagtgatatttgtgggtttggttttgccttcttgttcctatagtagaatgcaaacagcataaatattaatgtgattaatggcattattctgcatatggagattatgatgataagtttcctggatgccttcttggtggtttggttgaagcagggtggcaatttcatctctgggataccgccacacaggtcatcatttccagcgaggaaggtagctgttgcatttagaaaaacgccatctctgggaacttcaccttcaaatttgttgtatgagaggttcaaaatagatagacctctcatgcccccaagaaatgcagggatgcctccagataaattattgtcagaaaggtcaagcaccaggaggccctttagttgcccaagcgacgatggaattatcccttggagggaatttccagatatattgagctgctgcaagctcttacattcaccaatagatgtaggaatctctccagaaatgttgtttgaagaaaaatcaaactctccaagattttttagattacccatttcagctggtaaagcccccgataaaaattatgtcccaaaaacatgttactggacaaagtagaaatgagaaaaagttgtttaggtatcaagccagtgaggctgttatatgaaagatccaatagttctagaggacaactgctaagattggaaggaatggacccattgagtgcatttccttggagttgtagtagatttagtcctgtaagattgccaagagttggtggaatggatccagacaggttattatatggtatagataatttattcagcatcttgagtttgccaagagaagctggaataattccctctaaacggttaatatccatatagagcaattttaagttgatcaagttccctattccttcaggtatttttccttctatattgttgttcgctatgataagatagctcaaatgcgaagaaagattcccaattgaactcggtagctcaccttgaagcttgttgtaacccaaatctaatgcattcaaattgctgcaattcgccaagctggataagaaaacccaatcagcatcatttgttgcttcaagctgattttttgaaagggccacaactgataagctcttctgttgaattccaagacactgaggaattcttcctgacaaaaagttgtatactgtttgcagaacttgaagcatggtggcattacacaaggatggtgggattgttccatgaaattgattgatgtctacaacaaacctttgtagattcggaagcttattgccaatatcaggtggaagagccccgctgaggcgattgctttgtaaaccaagatcatcaagggaggaaaggttgagcagtgaaggaggaaacgaaccttctagtttattataatccagacgaaggctactcaaggcaccaaggtttccaagagaatctggtatggagcctgaaataagattattttgtgaaagatcaaggctagtaagcatctgaagtctacctaatgattcagggatgtgtcctgagagccgattttgctggagactaacaaacactagagatgagaggttccccaaccatgcaggcacagttccttcgagattgttctctcccaattcaaggacaagaagtgatgaaaggttttgcagcgatggtatgctccctgtcaactttgcagaagggatgctaaggtacttgagtgctgaaaggtttccaagtgaggcaggaatggagcctgccagctgattagaaccaagacctagtccaacaaggccagcaagatcacctatctcctctgggattcccccagtgaggttgctgaattgcaggttcagagtcatgaggtttgcaaggtttccaatctctgatgggatgcttccggtgagggtgttcatgccaaggctgagtaccctgaggccgcgcaacgagcagagctccggcggtatctcgccgtggaacctgttgttgtacagagcgaggatctcgaggccggtgcagttggcgagcgacgccgggatctgcccctggaaggcgttgtcactgaggttgaggtgtctgagctcagcgaggccgccgagctccggcgggaggacgccgtgcagccggttgccggcgaggtggagccgcctcaggtatgtgaggttgccgaggtccggtggcaccgtgccacggaggccaagccccggcagctccagcgccacgacgcggccgcggcgccggcctctcgcgccgcacgccacgccgcgccaccggcacacggggacggaccggttcccccacgtcggcggcggcggcgagccactgcccgtcgacatgcgcgccatgaacgccgtcagcgcgaggccgtcgtcgacgtcgaccgccgccgcggcggcggctgctgctagccacgccagtggccataccgcggcgagcaagagacgcttgccggcgagtgccattggtgtcactgtcacgtaagaacggtgtgcaaactgcatggaaattgctatactgatgcgagagttgatcatatctgtgcatataaagcctttttatatgattataggtacccattttatatcggtttctgtttctgtttatattagtatgattttcaaattgctaaatgataaagtctgcgcaaaattctctatagaaattattttacaatattctattttttaagtttgtaataattaaagttcaattaattatgtgttaatggttttgttgttttttttggctaatttcatcttcattttcgatgcatagacagttgctttcaatccaattccagtagtccattcttgtggaaatacatcactgaatttgtccacggtccacatttttggtttctggttatttctgccgcattgccagtttgttatggagttgctacttgctagtcttctgcagagaccatggaccagcttgattgattaaccagcgattgcgaggtaatttactaccatgctgaatcgctggacatacgaaaaaaaatcaagggctacaattatctgaacatgcaaagggaaattcaatgagtcagctctattttttttttttgaaggaagatgagtcagctctataggaaagcaaagcaatggctttcagggttgttgtctgatagtgggataactactggagcttatcctgttgatgcttattgaccagcgcaccaaggttgaccaattgtgctgcaacttgctgatgggcaaagcagcagcggcgcgagataactgaacatttcggcatttttgttgctgttaaatgtcgagagcattatttgtccattgtacgtgttggtgtaggcgagaaggcccccattcttatgtaaaaaggaaaccattatttttcaagtgatctgtctcaaaataatttgattctcaattcatcttagagagaatgaactaagtatagagaacatattttcctttggagcgcacgattatcaaaatacaggcataggaaaaatgcatgagtaaaatgtcatcgcactttaaatcctaaatcctaagtaaataaaacacagaaaaccatttggatggagcacacgaaaaatacacgattttgacaaagagaaaaattccaagaacttggagctcatattaggaatccttcaaaattccaataaaacatttcattccaaaggaatttttttttaaaaaaaactagcatactgcccgtgtatttgcaacgtgattttagttaaagaaaattattattaacatattgtcactatcccttaattgttatacatatttgttactaacatattattgatcatttgaccccccccccactatatctttttgaggcaattgcttattttaaccctgttacgaagtctaactactaattcgaccttatttttttaggtttgcttatttgacctcgtttttcaaaattgaagatgaagactgaccctattttgtgtaggcaagataacggtgttaactgagtgatgatttgtccttttaaccctggctcatttgactctattatatgaaagcatcttgtgtttggacattcttaacatatttataacgaatttgatatagccttgatagatttgtgacaattttgacagatttggtctcaatttattaaatttagtttcagtttgacaattttgactttaatttttttttaaaaaatgacaaaacggttgatatacaaaattatttctcctattttgtccatcccaaattagatacaataataaagcaaaagctcagcagcagtcaaagagattgaactcgatcacagctagggtcaacgtttcgagattgaactcaagaatgtgatgcccagacacagatagcaaccagtagagggcgttggcaacaagtatggcaggtgaaccaaaatggtagatggtggatacaggccctgtgaagatggcatcgccccattcgccggtcgccgatgagtaaacggataccaagatgaggtggggattgggatgggatagggttgattagtattgagggtattttggtcacttcagggttgtaaatttattattttcttttttctaaatgaagtactaacagtggattgaaaacagggtcaaacggaaactttcattttgaaaaacaaggttaaataaacaaacctaaaaaaaaggtcaaattggtatttaggctttaaaacagggtcaaataagcaattatctctacacataaactatcttaaaacttatttccaaatctgtctcgagcttctcgccaaaggttggcgcggccgcaaagatgacagtggcggggcttctcgccaaccggctcgagcagccaggggagtcaccctgggtggtggtggcagcaaccaccagatccataccgcctcggccggatctggcggggtggcggccggcagcgaggaaggcatcgtcaacagcggtggggatggcgacgacgacggcaatgtctcggcggcaagaggcggcggggatggcgacagcgatggggatggtggcagtggcggagaccgtagatccggcggcagggcgcttggatttggcacccccacgccggatccgaccggtggcggcacgagcgtgccggcgcaacctggcaagaggatggcgcagccgtgggtgacggtggcgacgggccggcgcgacgcggcaacgcggccagggagactcgtggcgatggccgcgacagtcggcagccgacgggaggagcggcgcggcccggctggccggccggcgccggcggaggcagtgcgcacacggaggcggcggcgcggcccgagagactcgcggtgacagtgggcagccagcggaaggaggagcggcagatggctggcctactggtggcggtagaggtagcacgcgtggaggtagcgcgcgtggtggcgcagctggcgacggcggaggtcggtgaggtgcggccagtggtggccgcggtgcgtggaggtgaggccgaggtgctggtgcagcacaacgaggcttgttggtgtggagacggtggtcggcgcaacgagtggaggccagctcggtgagacgtgaccagtggcagcgcgtggagactggctggcggggggcactggtgcagtggtgcccacgcgccggcggaggttcagatggcggtggagcaatggtgcatcagtggtagatcggcaggcggtggacgtcgggtgaaaacccagggcgacgatgatgttcgagcgtcattcccatcttgagggcgttgtcgtgttgttccacccctcaagtgtggttgccgagcgaaagcgtagtctcggttctctttgagaccttgatggacggcagcggcggcggtgttttcgtcgcttctttccttggagatgtcgtctaggcaccctcttgccgaaacccccaaagcaattggtgcaagcctggtctagattcatatcctcttgtgtcggcgtcctagcttctgcaagttggccacgttggaggtcctaggggagagaggtgttccattcttctctctgaccctctccctaaatcccaacgacttggatagagtggggttttgcactggttgtaagggtcgggttttgggcgatctcaactgtgttccattgttggcctagcggtggtcggtcacgctaagcggcggccagtcggatgctagccttctcctaggtctgtgattggcgctgtcggtgtgcggatggtggtatacttttttcgttttccttattacaaccttacagagttgtaatcttatatttttttctgctttatcaatagaacttcacgctgtctatcgttaaactttttttccaaatctgcctgcagctattggtgcgacagtgttgtttcagcctgcgagactgggtgacgtgtcacgtgtccaaaagattcaaatttagaaatgacttttggatttatttttaaaatttaaagtttgtaaattcgctggtggtgttcaaaagcagggacgatatgcataatgcatgatgtgtgttgggggtgggggagggggtgatctccctcttctttgtcggagaaagcttacccgagaaagaggagggctcatcggagagacaggagagagctcgcaagaaagccatcgtcgcttgcggtgaagaagacgaagagaggtggagagagagcgccgctagtctagacctgtgggagcagctgggaacgctactccaagggacaaattgtttttatttatttttgaacattttattttttaaaacttttaacaacatttattttcaaatctacactttttttttgtcacattagacatgataaaacaagactattacatcactctgactgatatgataacgttattttgctacgccactctagatgacgtaacagtgctgttttactaaaataagataaaatatcacgtcaactattggtgacgtgacaatattatttcgtcatatcagatgggatggcgtagtaaaaaaaagattcaaattcacaaataagtattgagataatctattattaaaatccaaaaattaaaaagttaaaaaagtaataaaaattcccggtagaccccccttgcttcccaccgtttctgctcttcaggcagctagctaagttcgtcccagttttgttcctactgaattttggagtagaacaaatctgcacgaatttttttttacactcgtcagtcgtcacacaatagaatggaacttaattatccgatcttaaactgatcgatactacttttttttccctctgaaagtgaccaatgcaataattaattaccaaaaggtgattagcacataatatagacgatcgatggacgcctgatcttcaatcgttatcgtgcgggctacctgcataaaataccttacacattggctgtttatctgatcaaatattcaaccacactagagaccttatctgtgagcaattcgagggcctgataattgtcaaagctttacagagtcaaaaagttcaggcgccaattttcctcgtggcgcgtagtgcctagcaacaaccaggctagcatgcgttcctccatgtcagccaaattatcagagcaaatttgataggattactattagcttcaaatcatatattcatatatagctaatctaatagctaattgatacaatagttaactataaatatatattacaccattaatacatgattctacctcttatacacataatatatattacacatcgttttccttctctctcctctcttacctcctttacacgtgttcatagctggcttatagcctgttattatatttcggcaactttgcaaaccattgaccgctagtctcaacagaatctgcaggaacaaatcgacaatctcttcgtcaggttga

SEQ ID NO: 61593 - DNA, 8083 bp, Oryza sativa
  unsure (1)..(8083): unsure at all n locations
agaagaagaagatcgaatttgtttgcatgataaacaaaagaaggattatttgagcgaggggccgcgattcaaattttgcagccttttacaagantaaggaggctcttgccgggcccggccttattgccaccgcgggctccccaagtcctcccattgccacaagccgccgggttcacttgtccgccctcccgccaccccagcgggccacagtccattagccgccgctcgcaccgccgccgactcccctagtcttctcactgccgggccgagctcgccgtaccccgccacgtgtgcctccagccaccgccgttgtggtctcctccgtcttcgtcgcagtggagctcagcccaggtgccgccgcgcctccgcccctcgccaccatctccgcctgccgcgggaaagagagagggaacggcgaggagagagagggaactgagggaggggagagagaagggacacgtgggtcccacaatctattttctgtgtcattgacaaatgggtcccacatatattttttaatctaaatgccaccttaacgccacgtcaacgccacgtgtaaaggagacccggtcaataccgccacgttagcgaaaccgccctccaaaaccgctgagggagtcaaattgcaccggtttccatagtttggggggtcaagatatccggttttgtggtttagggtcacagattagatttcaatcacttttgaggggcaccaagtgaacttattcctgcaagctgggatgagccgtgggccgcggcctgtgtctccatatgatggaccatcaaagagttggtttccaagcgttcggccagaaggctagaaagacgtgaacagagacagccaatggcctactgccgagaggcccaaaagttgctaagattggtcgtagtttttgtcggcccatgtaggatagatatgaggtcccttactttttgacgaatccaatttttatccttcaaccaaaaaaccaaatacagcggtcaaaaccggtgtaaactaactccgaaggcggtttggacggtggacggtggtttcagctgaggtggcgctttgactctatctttatctgacgtggcacatgaagcaaaatctaacaatttaacaaataaacaaaatatgtgagcacgcatgtcagtcaaataataagattgaaaaatagtagaacccacgtatcagtggacctactttctccacctcatccccacttctatgtatcttatcctctcccaagggagtagggtgagcaaagcggcgcggcgcggtggcggaaattcgctggcgacgccgatcttcacagcttcggcgctcccaactcctttcgccgtcatcatcacgccttcttcaccgagctccactactgtcttggtcggcactcctactttcccacctgttttgacgatgacgatggcaacatgttcgaggatgcacacctcatcttcttcttcccagtctcctctgtcttcgcaccaccgtccctcgccatgtcagctgccgccgcatcatacaggcccctcttctccctgctcccacagcatgccacactcccccttttagccgccggacccctctaagcgcagcctttgccacttggtccactccacctccttcctccccttcatttatttcgactccctcgaggacaatgctctccactctgtccccatccttttcagcactctccaacttgctcgtcgtcctcgagccccgtctccgccgtcttacgcgccaccccccgacctcgacggcatcctcgccatgggcagcggctcgccgcgctgtcccctcgccatgggtggagaaaataggaccaccaacatgtgggtaccattatttttctttatcttagtttgactgaccatattttgtgtcaattatttagttttcaattttgtttttttccaaataaaactgtcacgaaaaagccacgtgtaacaaagatcaagttaaattagtcacgtatgtaccgcgtaagccaaaactagagataatagtaccgaagaacttcgtttgcactggttttataagttaagggggtggttgtatctggttttcggtttagggcgtaaatcggatttggtatcaagttaagagatatcaaatgaacttattccaacttagtttcggtcagcccatatgcacaaaactcatggaatcagccgtaccttaattgaaggaaagaaaaagaagaaagaaaagatactgattttctttttagaaaatgaattaaaatccggctacatcgatgtacacagcacagaaaagatactgatcggtaagcagacagccattcgatctcttgagatgagctcaacacgcggggggtgcacgcaacaagatcacaacaaagcttgcgaatgaaattatactactccagtacttaagtatactaagcattgtctcaaatttcaatgctgggtgagcagagcaccaaatgattccggcaaagcacactccagtagtagcaaatcaatcaatcattacaagggagaggggatccaagtttttgaccagctttgacgaatcctcactctcctctctggcacacattcccccaaccaacaaccttactagaacaggataaactaatacttataagcccagatctagcaataaaacccaccaccaattaactaatcaaccggatccatgagctaaaccagtgtcagtgaggcagtgacacaccaatgtagtagaactagtaggaggtattaatcatacggtaaaaaaacaaaaaaaaaagaagaaagaaaaaaaggcatgcatcttaggggcacttggggccgccttccttggtcttccagttgttgtagcaggggcaggcgcccttgttgccgtaggtgccgggcggcacgcacaagcacttggcgcagcacttgttgcagaacgtcaggcacgccttcttgtactgcgtgttggagcacctccccgcgcacttgggcgagcactcccacggcctcaggttcccgccggcggccacccctccgccgccgccgccgccgcgcccgcgccctcctgccatcacctcctgcacgcgagaaacaagaacgaacaagaacgtcaagattaacccaagattcaagatatatagtaatcaggttgaaggagaggttagagagattgtgaggttaccgatgggaaggcgatggaaaggaggaggaggacggcgaggaggaggaaggggatcttggtggaggacgccattggtgggtgcggtggtgtttgggtgggttagggacttagggtggtgtttatatagaggaggaggaggaggggaggacggcgagattggtgtggagccgtggaggagtaaagatttgtgcgtgcaggtgcggtgtttggtgatggggttggggttggggcatgtgacgcgccacagtggacgcgtgaaccggtcgatgggcgcaggcgcgcagctgggccgtagcactggcatagtgggcattggaaacgcaccgctctcgctctgtccattattgcgtcgtgctggtgttggtggtggcgggaacagatgaaaaacatcaaaaaaccactctgcattaatagttccagtacaggtagtagtagaggttttcaccggccgtggtggaccagtacgatactccttttgggtagctttgggcgggcaattcgagtttcgaggtaacgactaagagcaagttcaatagtatagctaactgctagctccaattcatctatagctaatctaatagttcatttatacaatagttacatactacactattaatacctggtcccacctgtcatacacacaccgtgtcttggagtccgtgctacagctagctataaatctgtagctcgctgtccttctctctcctcatttatctccttaaaatatgtttgcagctggcttatagcctgctattgtacctactctaagagccagtttaatagcatagcccattgctagctccaattcatttatagtcaattcatataatagttgtttactatactattaatatctgatcccacctaccataacacagtcttggagtccgtgctacagctggctacaaatctgtagcccgctgctcttctctctcttcctttatctttttaaaatatgtttacagctggcttatagcctgctattgtacctgctctaataccgggaatcaaacgaacccgaggagatgtaagagcaagtttaatattatagcctactactaactacaatttatctatagtcaatttaatagataaatcatacaatagttgtttattattttattaatatatgatcccatctgtcatatacacattgcgttttagagtccgtgctacagctgattacaggtctgtagcccactactcttctctcatattttatctcattaaaatatgtttatagctggctaatagtctgctattgtaactgttcttaacaaaaaaataacacgacgaggtggtgagatgctactccaagtctagattaaatcggtgagtgggtcatatactataagtaatagtactccgtagtttacgtccactagatcggcggcacatgctgatgccctttttccagtgcacctccactagctactagttctggtactccattctactcctggagagggcaccgcacatgcgcggttcgtatccacagcttgcgggcaccgcacatggatgatggatcgttccaggtttgtattcaccacagctcttgcggcacatggactcccccatctctttaccctacagattgtcgtgcactcgtgcagcagttcaattcgccatgtagtagtagtagtaaaaagtaaaaacttgtatatatactcaggtacttgtactatagtagtaaaaaggcgtccctcgtcgtcgcagagctgttcaaaatttcggttgcacggggcacgagggcagccggcaaaatctccctgttttgctgggggcttttcgcacgccaaaagtccaaacgctctctcgacagggtttcatttaccggggtaaaccgcgcggttaccgcggttaccgcgcttaccgcgggggtacggtaaggggtaaaccgcggtaaccgcgtcaaattcaaataaatttgaaaaataatttgaatttttgataaattttgtacggtttgtcgcggttaccgcggttaccgtgcggtaaccgtgcttaccgccggggcgcggtaaccgcggccccggcggtaaatgaaaccctgctctcgatctttccgtttgcaatgcatgccacgcgagcgcgagcctagatccgcggcgcgaccggcggtgtgtgtgctgctgctacgccgccgtcaccggctttccggcatccacgtggtggggggctgcgtacgacggtacgacgacgaacatgcagtgtttcggggcccagacggcggtggtcggcaggcaatggctttgcttttggctggcctgcgactgcgggagggagaggagggtaacatggggagcggcaggtgggcttggggaaagtatttacagctcggcgtatgggacgacgattactggtggccggtggctgctgctgtttactgctactacaactgcaacccttcgttgccttgtcgatttgtcatccgcgcgagagcgctccgggacaaatcgatggtgtcctcactgccgactctctctcaagaagtcttgggccgtgtttggtagggctataaacttcaactcctagctctaaattgctatttcagttggagctagctcctattagagttggagacccatccaaaagtgtttgacaagcttttagctcccgatctaaaaaatattgaaaaaaaggaatccctgctgccggccgtgcgccgcccaagcatcgtctccacgcacgccggcctcgcgctacttcccctgcaccacccatccgcccttgtcagcgtgccgcccgtcacaggctgtgcgccgctcacacgtcgtcctcgcttgcgccgaccgcccccgccggagcaccgttgcccgcgcaccccacccgtgcgccgtcgctgctcgcatcgcccgccgtcaccgcaggagcgtcaccatcggcccgctgcctttgcccacatgtgggagttaagttttggggggggggggggggaaggggagaaggtgagcttgggataattcagtgacatttttatgtgaatgtgttaaaaattaaagggtagtggatcttttgggttggagtggagctgtggagcagaaaaaacccagctctacacctgtagtttattttttaggagtagctctactaacttcactccaaaaacagaaaatatggatcgtttggtacagctccgactctagataagttggagttgaaagttagagccgtgccaacggaccctcgtactccagctgagttcgcaatgttgcaatgcacgggcgacgatcgtcgtccgtggagtgtagattcctatcattttggtgaccttgcaagagggcgttgttgatcgatgatgcgcatttcggccattgcagatcaggtgaatcacgattagcgccctattgtttaggttcccggtcaatatggtcttactactgtatatgcgtctgattaatttcgaattatgtttatttatttcttctccagcatgtgtagtgctccctccgtcctataatatagcaatctagtataagacgagatacttcatagtatagcgaatctggacatgcttcatgtcatgtctaaattcgttgtactataaagtgacccatccggttctaggttgctatattatgggatggacgaagtagtagagtatgggtgtgttcggcactgctggttcctaatcttttccatctcgttttccgcgcgcacgcttttcaaactaataaacggtgttttttttaaaaaagtttctatatgaaagttgcttaaaaaatcatattgatccttttttaaaaaaaattagctaacactttattaatcacacgctaatggaccgctccgtttttcgcacgcactgttcccggctgggaacctccagtagcgaatacacccatatgtgtggtagagatctggatcctctgccttaggaaaaaagcagaggtgcacgataaaatgagtctactactatggtagaaaacagtgatttgcagttttcactgtagcaacagtacaaaacagtgaaaaatactgtgcgcaattactatagtgatcgatctcgtccatttcgtgtgaaccagacaactgaaaataccccaaagtcacggtactgttttacctctgactttaaccccgggaccttaatccgtgtggtagtagataatatgctatgcacatctcccgtgaggcaaagcgtaaccttgtggattgtcctccccgtgcgtaaaaaaaaactaaaatgtattcgatagaaaattaagtttaaaatcttgtatttttcttacctaatgatttgctttgagttccgtgctctgatgacccaagctcttattctacagttgaccccttctcctttagttctggtgaccccctacaaacagtaatggagctagtgtttagggtcctcgattatggctaggggtaaggccgtaagggtgggggagggggaagagagggaagatcgctggatttagaaggatggtcatgggaggcggcggctcggtgttgggtcgtggacatgagcaggcggtgaggcgctcatggcgacgtcgaagccatgagaatagaggaggatgatgagccatcgttaatgacgggagcaaagcaaacttgtggtgaggggcggatcaactgtgttaggtgtggtgtcacctgacaccaatagattcttgtttaatctaagagcaggtttaatagtatagccccactattggctccaattcatttatagacaatctaatagccaattcatacaatagttgctaactatacttgttggcggatggcatgaggcccttcgaccaaatttgccgaaacccgtggcgaaggctatgaaccaaagatgaggcgaggcgaagggtcgcgtgagtacctgacgaagaaggatgacttcgccatagccagttcgccctggcatccagcgaagaaggacggcttcgccatgtccagttcgcccccgcaagggccgaagaagccttttgggcactgcagctgaggttctacgcc

SEQ ID NO: 61594 - DNA, 3073 bp, Oryza sativa
  unsure (1)..(3073): unsure at all n locations
agagattgatgagaagggaagatggcgccatctccgatgtggtatccagctgtgccgatgccacccagctgctgctcctccgccctgcagctgaacagtagcaccgccacgggcgtgacgccgccgcgcaagccaacaaaaaaggggttagcgcgatgccaagctagagcttacagccaagcatggcgtcgtggtccaacacaaagctcgtcgcaagacgacacgcactgctacaacactacagtacctagtagtaaagacgtgtgacggatggtggtgcatcggcggcgacggcggcggcagcagcgactgcaagcggcgaggacgacgacgacgacgacgacgacgaagatgaagaacaatggcgacagcgacagcagcgtacgcttgcagccgcgctttatagcaaggatatgaatattgtggattcatcagacgatgcaagaagagagggaaaagatatcatgatccggacgtgtcgatcggtgcatgtcagagatcgatcgatcagtgcagtcgcagaggcgtcaatcagggtcaaatgtcaatcaaccgatggtggtggtgtagtattcgagtgtgcttgcgtactcctacagagctacgcaagcgacgacgacgagagaggccgtgacaggggaaaaagcctggaggaaccttgaactgagcgttgtggattgtggagtaggggaccctgcagcctgtgcaggttttttgatggttcatcttcatcatccctctagtgatgtggtagccatattgttgtttggtccagggtcggaggttggtgttgcaacttcagttgctctttgactagagggtctatacagtaaagctgcgttcgtgtgtgtgatatagggtgagaaagcacctcgttttccgtgcgcacgctttccaaactactaaacgttttttataaaaattttctatagtaaagttactttaaaaagtcatattaatctatttttaaaatttaaaatatttaatactcaattaatcatacgctaatgactcacctcgttttacgtatattcccaatctccccaatccactcctcctcaaacatacctacacctaggtagtactacgtagaggcgtgaccgcgaacaggacaaaagtgcggggggggggggacacttcagatactctaccctcattaattatagagtaggagtagccggttgctcacgggtgctgtgtatggagagcagtgaaaggctcgtttaaaacgcgatgaaaaaaaatacttgagaaatagaaacacatgaagtagtaagattttggcataatagtgagcgtaaaaccaacagttgtaaatcacaggaaaaatatgtaaatggtcatttaattagtcagtagaaattaaatgtgggaaataaacttaaagataattatagctaacttttctttaaaatctctatattattgcctattttatagggattttatagaaaaaaatatgatttaatcctatagttgaaatattcttttaggaaatttttctagacaattaaaatcctccgacagccggcattagcaaccatcgttgccgacagcttaggtatggatatagtacgatctggagtaggaaataatgcccccccccccccccacacacacacaatttgtaagaaacatatagaaaacttggggcatttcaattctataagaagaaaaatactaggatggcttttgaaataaatgattgaattatatctttttattttgtaattcttattgaatggacaatatagatattttagagaaaagttagtacgagattcaacctcttgcaaaattttattgagtctatctcgctcaaccgatttcaacatttttctcccgtggtatattcaaacaatcattcttacgttttcttatatttataatcttctactacctccatctctaaatacaagaatgtagacacgggtattaagaaaataggtagaattaaataagaaaaagttataattatatagtttgaaattgaagataggtggaaaaattgaatgatggaaggttatgattctttgggaagagaagttatattttgagtcaaattctagaaggtaaaaagtttttatattttaggacggatggagtacttacgttgcacttatattcttattaaaatcttacattttatcatctaatagcaataaagtactattcatattttaacatctaataacaaaaaaatactaattataaaaaaatcaaataagatgaacggtcaaacgttgaatatgaatagtacaaaattgtacttattttgagacagaaagagtatcacttaatataattgtctaaaatcaataaaaaaaactaatatgtttcccaagcgagactttgatgaaaacctattgtcctatttgtcagggttatggataccacatacctaatagtagttgactaaatctcggtaggacccaccacataccatgtcttatacgaaaacaaccttcggatataggaggagttccgcataaggaaggatgaatagagttctacgtagaaacgaaaaggactactcggattgtatccatattggtttctctaattctacttggacaaggggatacctatgggtataaatacaaggccccctaggaggagaagggacacggaacaacagaagccacaacatacaagcgaacatacgccaagacaagacgccggatatcgactttagagataggcatggctactcccctacggtgcctatggctactgtcaggagagatatagtgttgtctctgatctcgccggatgcggattcgaggaggaaggctatcctgttgtcaactatgagtcagaccttcagaccgccatgtcgacaacagttagataggctaccccaaatattgtactggtgttattatgatgaataagagcaacgacaggnttgggccaacaggactgccgacgttcatggggatctctagagggnctcgagaggctgtcaaatatcaaccgcggggngnnnnnnngaggatgttgactacgaaaatacnnanntagaaaaagaaagtaaatnnaagacaacgcttctatacatacaagtaatttc

SEQ ID NO: 61595 - DNA, 9516 bp, Oryza sativa
agctgtagtctttgttctgactgacttaacaatgacttcttaaaagggcttatttggaagggacctataaaaattgagcctttctttccaatttccaaaaaataaaaacatagttcagaactttcagatactaaatcacttccatttactggtgagacagcaataataattgctttgaaactgttattttgatgaaattacaacagcaataagtagcattttaaatgaaaaagaagaacgataaaaaaaagttttggctttcaaattagaagtcaagattaatacgaaaacccccaaaatacagatcataacccgtgcatcagatggcatattatcaagtctacttggacagcatgggaaaatgacagcttgtctgcatatgagatgttactgtttgagcaaactctgaatacaaagtaaacgcatgactttctcaatccaatcagcttcaagcttacatatgtgcaccaagactattggcgcaatcatccactgcttagttagcaatttgtcattaagtaaattcagaagaaataaggttactgattcaaatgtcaactgcttacagcatttgcaagaaaaaccaaaagatgatttggtcacacctgcgtttcaccctggatttgtattctgtagtgtgtgaacacttgcatcggcaacttgggctatgacatcaaacatcagttaagtacaaaagttaacaggacttctcttatccctaatgactgtttatgtttgacattgtaactgaatagaataaagaggaaactgtcatgagtccaggtcgtattcataccgaagcatcttttaaacttggcatgttttcatggaaaaaagaacagacgaatcaatccaaaatgagtactatttctgatgaatttggataaaagcaaccagctcatgtttcataggccaggattttgtatgtactgtagcatgcgaagaccagcccattctctgaagattctaggcccatgtttcataggccaggattttgtgcagattttatgtccactgtattaaaatctcaacagctgatgctaacaagaatgtaaattaagttcaaccctgaccatgtagccgtcaaccatggactgaaataactgaggccgtcaaaattttgcaagttgtgacaggtgtgtgatgataaacattcattacattaattaatgagtagtaacttctaatccatctaccaagagagtgataactgataaggaactgattcacatctgatgcattgcattcttggtggatagggctggtatgaattgcaccatatcttgatctgcaatttgcatgatgcataagtgtacaccaatttgcagattaggactggtgcttatgctgtgagaagagcttacagtggcaatacaattatggggtgggcaattatcacggcaattatcaccaaaagcagagaaagaaacagcagcagcactgtacatgctactgaaagtctgcacatgttcagtgcctgtgatagctgcttcagtagttctgacacttctctgagtcatgcaagagaaatccactgtatgtttaattttaaatggtgaatacaacagtatgttgcatgagcatactatgtagtagctgagaagagaagtttgaaagcacaataattcaatgaaagatttctcttttttttctatggctacagaaaatgagagtgcatttacaaactggaaaaggatatagtcaggaaaaggaaaagatttctgatttttttagcaagtccaaacattacttgggaacatgatgaatcaggcaatccaatgctacactgctaactggtacagactagagacacaagaaaacacagaaatgaacaagaaaaaaaaatacagcaaaggcctacacaacctcaattaccgagcatgtttttattactaagcaatttaggtcctccagtttaagtgatgatgaacgtggtctagttatgaccaaaggaggacctattttctccagcgatgtatttacaccaaatgaaagttacatcatgcgctgcaagaaaccaaggaatcctcgtaagttcaattgtccacaattcttggacccatataagttgacccgacaagatgaaaattgtctggtggttcacactcctccagccatgcgtatccatcgtctccaggaaggggctttgaatctcctgttaaaaatgcaatttttataaggttaatcaccaatatttaccttcctgtcaagatgcataaaatgtatcatacagagaacaggacagaggagatgaatttataacaagtgtgagataggagtaaatatataacagctaactaattcagagtacagataatgcggaatattcctgccatataactataaccatttcagtaaataggacacaacaagcttgaatccattcgaatccagagtacagataatgcagaaaattcccgccatagagttatagccatttcagtacaaaggactattaggattatttattaatctataggctgtttatctcctagacctttactctcctagacctttggtcttatgtaactcactagtattgattgtatctcagcactagcattcattgtaattcagctatatatatgagagatcagctccccacattggtgaggcatctattctactttctctacaaggacaatacaaacttgaatggtttggaaaataacaaagattgaacactagctaattcagagtacagataatgtatgagactcctatcatatgatttcaaaggatggataattggatatgcacgaatctatgggtgagcagtttctatgcaagtcaaacagatgaaacttatcctgtgcatgagggcaccaagtgcctgagtgaatgcaatatcaagaaaaggcagaactacaagtacatcaataactgaacctactgcataactatcttagatcaacgaggagaaaattctttctacttaattcaagcaaacacatcctcgtatccgacaagaatagatttgtgaaatagcaattatatataaatgtaaaacctaaaagatacaatgtggaccctatatacaagcagatataactcggttagcaaatagtaccagcagaaggtgcagaggaagagacgttgtagtgctggcagtgcctcccactgccatcgtcatatggtgggccaaggacatcaagaacagcacaagcagtatgtgcggtgaagcagtgcaggttgccaccatcttccggatatagtaccgatgttgcacaaggtgcattcaaggtgccatcaaccttcacctttgctaagcgggctccttgcaactgagcatctatactcaaaacaaaaatgaaaagagaaaccccttggtaaaaattatgtaaggaagtttatatttgccaggaaaatgaacaaagcataccagttgaatcttgtgaggcatcagcccaatcataggacttcacacgcagctcaccaaaaagaagcttactgaacacagtcatgttggggtgattatggagaggaatgacaccccttggaggcaaacaaaagatgccgatctgtaggaacaagtatagacttatgtaccttagcacacaaaaacgacaaattttctagttggtaataatcaagaacaattttagttgctattgcgaataaacataccgagaaagcctcacactcataaaggtgtaagtaagtgattttaggaatgccattggaattaacacgccggaaatatgacatgtttcgagttaggctgacatctgccgctgaaatgctatctgcacggtacaaatgaagggacaaacatcattagaatagaaatatgaatgctgtagtaagtacaatccatagacatttgcaatctctctaggatatgaatacccattggacagagtgcacctgtaatatacgaaggtctaacacatgcagcaagcttggccaacaagataagcacacgatcctacaatatttcagattttcaatcgagagacttatcatgatgactactacagaatatagatagtgctaaataccaacatcgaagaaaagagatgatatcaatcttaattagagcttcgttagttgggtagaaacaacaattgccatatataagcaaaacatgctggactcagcattatacactaaattatcatatagcaggacttgaagggaaggaacacataagaataaggtcttatgcaaaaacacatgattgctgtatgtttgattggtacatctaaagtttcagagcagagtgtagcatttaccccagcttggtagttcaaaggaccatgtagttcaaaggaccatcagatcaaaaggtaagtactgagtcaatattgaaatgcgatcccaatatcccatctccatgaattttcagggtcaatctcattatcaacagctatttccatgagcttgaagttggacacaaatgtcaggcaagtaggcaactataacccataaatcaagaattttgcacatatactacaatctccagggtccagggtgatcaccgtcgaagcacgttacgttaaaagtaatccatatgcatgcatgtaggtggtacaggctcacagtggagttggcacttggcacaacaatcaatcagggtacgtccgacacaaggaaagaaagaaatactatcttagggacaaaacatggtacgacaacagattccaccattaaccttcctcaagaagagttcagcagacctgatcaagttgacctaaactaactatttatggcaactggtggcttttggaacgaattggattaaaaaaaagaaccctaacaccggtccaaaatgagcataatcttggccgtaccccctgcacccccaccctactccacaaaaccagcaaccacgtcatatatataccatgggcagtacatggttttgcttatcttttgctccattgtttatctttcaccaggaacagccagcacaagtcaggacctatgcatttttctgacaatctagcatcactacttgcaagaaaaaacatgctgcagatgatatttgtatcacagattcacaggcacacagcatggtatacattatttaaaaaaaattcacaacatggtaataacatcaaaaaccattttttccaacagcttatcagtttgttattccatcctctaacttatgatttgattacaaaaaccatcttttagggggaaaagaagaaataaattaacttacgcaagaaaaccattgttaatttgagtgtatcaaatgcacctaaagcaattgtacgtactagtcagactcttatttggtagacaccaactaaagaaaatcttgccgttttttctacgaggaactcaccaatatcgaacacttgtttccaccaaactgaaaatcttgatgggacctaaaactaagaagggatgaactgcgccacctaaatctaatgcaattatcacaagatcgaaacacgatgccaccaccccaagtacccaaccaatgatttcgattctctaccaagcgtccgccgtggagaagacaggcaggaatagcatcgaacacaaggcaggcgcgcacatgctgcttcgctctacaccgaacatcgattctttcgagaccccccatcgggtgcaagagacttaacggggggagggattacggattaccaagaacggacttgatcctctcgaccccggcgggcgagggcaccgcgccggcggaggcaccgaagacctcgcggcacgcctcgaagagcccctgcaccgcgggcgacggggctggctgcgccgccgcccccgccgacggcatcgccggcctccgctgctgacgccgccgccgctgccgccgcgcgccggcggggtccctcgcccccgacccaagctccgggaggcccccggcctccacccgcatcaacggcgggggaatgcggcggcttggaaggcgagctggggatcggagaatggccgcgccccgagcttcgcgtcttcttcttcttcgttcttgggttcttcctcgtcggaataatgaggaggatgcgggtgattttttatactcgagatggctagtattttattggcacgaggcttggaacggaggtggtgttttttttttctttttaacaaaaacgtttctcaaactattcaattcaagaattcgtttgtaatttgagatcgccatcatctcaatactaccaccatttagtacccccattgttctgtattacacgacattttaagtttgattaagtctatataaaatacacccttccttttaaaatatactaaaacatactcccttcagaaaaaaaaatgtgagtacgaggttgttttttactaagagagtaactgtttgtgttatttttaaaatctttcaccctaaaaatctctaattttattggacacatgcactatatttattaggatgatctaaataataattatttttttagtctttgggttaaaaatgattgtctttgctttgaaatggagggattatataacatctatagtatgcgtgctcgggtcctattgttgtagttctgcagctacaacactgccaacagctatagcactgaaacaagcgtaccaaagcactagttactgttgatacagctatagccatagcaaaactgtacaaacaaggttaatatcaaattagttacattattaaacttatcactaaatatatttttgtgggtattttatagtgtatttgttttttattaggaagattgatattttttttctataacatgagtaaatttgaaaatgtttgactcaagaaaaacatatataaaacgacttttgatatggaagtacccgatggagtattggctgtattgctcatcgatatctcaaactattattaaaggtaaggtttattagtctaactctccgcctaaataataattatgtatggattgcaaattttacgtgttttgacctcgatgtgacacctcatatgtatccctgctaaattctaattatcctttaggcgtatttattaaagttgctccctataagcacctttgaagtaaatacaaattcagatggatgtctccatttcgtccccaatatcacttaaaaacataaatattaagaaatgacctaatatcaaagaaatagaaagggtgatactttgaacccaaaaacggctaacccaccaccggtggagctagccggaagacccattcgtgttttttcgtccccattatcacttaaaaaaacatgtttatgatttttcatgtacatgttgaacattgtttggacatttaaaatcaccacaatattttggataatctaagtaattcagtatgttcctactaaatccatgtaagcatacatagtgatgacgatacacgctggtataatctataatatatgtcgctttttctctgcttttttatatgtgagaaaatggcattccatcatatcgaaattagcagcagaaaaaagtgagccttccaacaaaaagtttgctttagccgtccacattttgttatcgttgtttaccagtctgcacacaagccaggagaggctggtgcttttgaaaaaggaaaaaaaaatctctatgtttatacttatactaatactactagttagcttaagtgcaagtcagattaaaagaccaaaaaccagggaccatcacatcagcattcctgtgggctgaagcaaacagcctatgaagctttttgcaggaggacccctcctgccctttctactccttggtggcatgcctgatttgtcatttgcaatgtgcacctatgcaagaaccagtctgaatgtttgctgcaaacagagacagatgatgtacaccataggtctaccacctgttgttttgtttctgcagagattccttctggttctgaatatggccatcctgttcatctgatgatgatccgagggatggtgatatttgaagaattttgtgtacatccactcacacatttgaatcgtttatacatttatacacgcctaaggtatgtatgccacaacttgtcaagctttttccgctgaagtgtgacatgcatgtcacaatttttcgtaaagaaatcatgcgccagacaaaccttagaaataaattgtacccatgacagatagagaattaaggtagaattatatggcatgtcaaaggtattgacaacaaaccaagacacttatctaagttcttttttttacaaaacaaggttgattatattaaagtattacaacctcattgttgcacaaaaaaaaataagacatgacctatcaacaaagaacaaagatacctcacatattgaaaaaccgcaagagatacaagcatacaaatgcatccacgatgctgacaaacttcaccacacacaaaggtatttgaacaggtatcaaccataatcttcgctccttttcacaaatcttataagctggcatcaccaaataaattagtgacacccaccctaagctagcgttgctgataggatcatcggcaacccgacaaacaaaaacacttatctaagttgatcaatcctaagttgtcaaacaacagaaccacaagccagacatccttaactacaactcacaacatttcgaatctgtgggcaccttggctgttaacatatcgaagcagatcaaataggagttgaacgcataaataaaggggacccatatgtaccattatctccctccagcctccaggattgcgaagtccaaagcactgacacagcacacagcggtatgatgggttaacacctgcggcgcccacggtaatgcgacgcccagtcttcctccccttgtgcacaccaacgtcttacacaatgtgtttttcctgtcctgcgtgatgccagcatgagcggctccacttggcaaaagatgctactatttgatacagagcttgctcgaaaatatcttccagatgggatgctacctcttttcttctctgcaaatcatagcctctgttagccaaactggagagagcttgttggatggcacatcacagtatcaatggccatcatgccatgggacgctttggccaaaaatagcgtgactttgtcccagttgtagtgatcaaccaaatatttgtctaacaaaccgtgccacgggaaaacttagtccacgagccaagcatgatcatggtcttcttcgtcgctgtcatcctcgtcgttgctgtcatcctcgtcctcgtcctcatcgtcactgtattcttggggcccccagaacctggaaacctccttgctgttgccaggtaaagatacagggacagatgacatgagaaagtctcggtagtgaaccatgtcgacttcggcggagctccccgccatggcgatcctacacccgtccacagccatggctgatagtgtgcttctgtctgccgatttagcaggctcaccgcagctcagtgtgttcgcaaagtggcccgtctgtgtttcccagacatggacctgaccatctgatggtgctccagttatcaccttgtatggatccaagtgaagaaatgtcacgggttcgtctgattctgattgcaattctgccactatatttgggagttcttgagacttgcgtatgtcccacagaagagccctgttcgatacataaaaaaaaagatgatat

SEQ ID NO: 61596 - DNA, 4270 bp, Oryza sativa
  unsure (1)..(4270): unsure at all n locations
aggtttggctgacaancnagctggnacccttaaattattgcattatcgctttatttaaattcccgcgttatcactgttttatttagccatgcctatttacctttgttatgaccatattattattgttattgttattattataccttgttcaccctagattaaacaaaacctcaactagtggacactctactcgtggtatccctagtttaaatttaggtagatgcttcgcaatttaattaggtaacattaggtggttttataactttagacttgggaaatattcatatcacctggacactgtggaattgttggattattgtggaattggcttcacaccgccccctctattcaaaatcccctaaaatggttttaggctgggctcggggtgcatggttttgatggtagcacctcggccatataaggaccggtcttcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatatggaatggttggcctgggttggcttaggacgagctgggacccagggtcgggttgccagttcggtctgaatcatcgtaggccttgggttaaggcaggttcgtgtgggttcacggccttgattaataatattgtttagttctaggatcgtgtttacaaaatagcttgagcaactaaatgtctttaaatgctgtttactgcaaccctaacccctctatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgtcgcccatgtaataaattaactatttacgcttccgcttgttaaactctgaattgtatcaacttttggtgtaccttgcctcctgggacaaggattaatgcacgcacgtaaggaatgcccgttgggttatttccggtcgtgacaggaatcctgcgcctcgatcatcacagtggtggcgatgagggcagccccccgctcctcctccacctttcgtgcgatctccgccagtgccgtcttgcgggcctcaagatctgagacgtgccggcggtgtgccttgcggcccgcttctaccatggcctccaccgagcgcgggccctcctcgacacgcgcccatgcggcgtcgagctccgcacgctccgcctgcagggcctccacttgggcgctgaacccatctagcaccgcggtgtttgcggcggccaaggcctgcagaaggggctcggcgctcagcggggcgacagaagacgaggggaagagctgccttgaagaagacgccgcgcggctcggcccgccaatggacgcgccggcctcatcgcgggccacccccggacctgtttggtcctgggcgtcgcctgaaggggtgggcccaagcgaggcgtccgcggcctcgtcgtgaactgcctcggaagccgccatcgcctcagcccggcgaacccgggcggcctcctcccgagcggcttcttcggcctggcgaacccgggcggcctcctcccgagcggcttcctcggcttggcgggcccgggcggcctcctcccgagcggtatcctctgcatggcgagcccgagcggcttcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctccgattttccttttcccccgggcgtcggtaggacggttgcttcccgagcccccgacgcggggcccataagcacgaccccctcccggggtagattgatccccccggcgggtcccacctgcgccgtcatggcccttaggagcctgctcctctgaggccccgaccgccgtcataatggtcagaatgtaggcgcggtcgggatcgctgcaaagggggaggataccgtgggggatgagggacgcctccacggagttgagatttagcacccgttggaccagtatcttgaagtcctcgggggcccaatcccatctgactccctggtgggtccgcatgtagtcttcggacccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctggctcggaagtcggagatgcgcttcgtcggcgaggggggtgtagaaccagtcgctcttccagtcatcccactttttacggaggacgcaggggatgtagcggttcaacaccggcccccgcggcaggaaatagcagccgccgaccaccgacggtggcgataccgactgcacggtaaagaaccaccggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaaggggagaaagaagacggaccgccccgggtagtctggcgccgggcgtccctcacccagcattactatctcacggccggtggcagattccggcatgaagcggcgcggcaacccggcctgcttctcgctcacaatgcgagaaggcggcagcacgctaccatcaagcagtgcggagccccgtgccatggcgccggacgaagagaagatgaagagcgagcgcgtgtggcgaaagaagggcgcagggaagaaggagttaggacgcaagcggcgaaggcaagggaaatgatggcgaaaggaaggagacaaatctcatcctcagtgcctttatacccttgccaacgctgtgcctggctcctcgtttctcgcgcccattatttcgccccctcgtttctcgcgcccacgcttccactaatcccattcgcccgcttgcggcgcgtgagatggatatgcggttgcggcagtcgagatagatcgtatcgtgcgcgcgttaattacgctcgccgaccgaaacgacattaccgtattttcaggcgaggcaaatcggctcgcccagattcgtgcgccgttcaggtgatgtggcagtcttgaagagaccgcccattatttacagccaaattaccattaccggtgtgcatggtttgagacggctgggtttttgcccaacattgagaccggtcccacctgggaacaaggtttaggagtggggttacgcccggccggtttccataagagggcgaacggcctggcataacgcgcggggctatggtggtgacatgggactgggaagttta

SEQ ID NO: 61597 - DNA, 1416 bp, Oryza sativa
  unsure (1)..(1416): unsure at all n locations
catgcgttgttgatcactaattcattccngccgcccgcaggttttcttttgaggatcccctcggctgaaacaagctcataagaaatggcataagaaatttgacaaaacattgacatctgcaagctttgcagtcaatgaggcagataaatgtgtgtattatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgagattacactcttgcagtcccattatgtggagaagatcttgaatcgctttggctacattgatagtaagccttctccaacaccttatgattctagcttgttgcttcgcaagaataagagaattgctaggaattaactggaatactctcaaatcattggctcgctgatgtacctggctagtgcaactaggcctgatatctcctttgctgtgagcaagttgagccggtttacctctaatccaggagatgatcactggcgtgcgcttcagcgagtaatgcgctatctgaaatgtactatggaattggggctttactattctgggtatcctgcagtattggagggatatagtgattctaattggatctctgatgtggataagatcaaagccactagtggatatgtcttcacactaggtggtggtgctgtttcgtggaggtcttgcaaatagactattttgacgaggtcaaccatggaagcagaactgacggcactggatactgctactgttgaggcagaatggctgcgtgatctattaatggatatgcctattgttgaaaactggtgccggctatccttatgaacagtgacaatcaaacggtaattgtcaaagtgaatagttctaagaataatatgaaatcgtctagacatgtgaaaagacaattgaagtctgttaggaaattgagaaactccggagttataacgttggattacatccaaacagctagaaacctggcagatcctttcacgaagggactatcacgaaatgtgatagataatgcatcgaaggagatgggtttgagacccatgtgagttatactatggtggtaacccagtctatgtgatcggagatcctgtgaattagaacctgggaagaacaaaccattagtaaactagaggagagtaccaatctataccctctctaagtgaagatgcatgtactctcgtgagctacaaggcaggttggctatgccttaatgagttctgttggctttatattagccgaaaggaattgggccctttggtttcccccttttggggccccccaaaaaaagaaagcattcttgaaagaactcacctttg

SEQ ID NO: 61598 - DNA, 6739 bp, Oryza sativa
gaaccagaggaaggtggtgccattgtgtcccaaagtttaacctgtgacacaaaacaccaaaatacattcatttttttacttggatgcaatgaaggaaaataggaaattgtgtagtaccagttgtgcctaatgggccaagaatgggagcaaatggaaaagaaaaggccaagataaaaatcaaacattaccaaccataaggcccccatgtccccccccctatggttgacatataacagcactaactagagactatagtgtctatggctgaacaggagtgatggtcattacaaatttaggtgtagcatacaattctctaagtattcagacaaataaagaaaaatgtttctaaacattccacatacctttgaatctttggagcagctgaccagcagggagggtttgtgcctgacatgcaaggaagaaatattatgtttaaacgagggattgtgctgctgcattgtaacctagataccttatcatggcttgaataacttgtttcattaggttcatgaggaaaatatgcaaaaagtaactgccatgagaatcacttcataagagatttattgctaatttccacatcaactagtagaaattccaaaatttacgaattgttctatagaagaaaatggggctctagaaaggttttcatttataaaggttttctggcaccaaagcatagaggttcaaggcaacaacattgaaaagccacaatgagtttaaaaggatgctcttgtaatttgtaaaaggggaaaatggttaatgaatggcagtgagttttgtttagatggtttgacactatgtacctggcaacagatagaagtgacagtgctttttcatggccatgaaatgttgatattagagggtgatttttgcctcttgtactcatagaccagaggcgaacagtgcagtcttcccctccacttgcaagtagtttaaattcaccatcaccaagcaatttgtcagacagagcagtcacgggccctgaatggcccctaaaacaccgtgagtggccctaaatcacaacattagaaaaccatccataagtttttgcatccaataaagattaggaaaaaaaaacacatgtaagcaatttaaacaggttatacgctaacaaagttctattgttcaatgctatcaagcataccttccaacaaagacggactgtcctatctgcacttgaagtgactaatgccttttcatttgtttgagaatcacctcgaaacaatgggatatcaatcagtgggaataatctgcagacgaacaaaaatcagtgggaataatctgcatagctaacaaaagaacacttcaagattgtgctagtacaaaattgatgttatcacggcgaagcactagaagtttgcctcacaaaattcaaatatgcaatctagcactgaaactgattatagaacaacagtagtttccctaccaaaagaaagcaaagttaaagcaaaagtcagatttagtcagatgtagatctttttgtaacaaaataacaagagaaaagttgtaggcacgaattataccaacacaatacaggcactgcagtatccatggaatttgcagcagatggactcgagtgatatcaaccaataaagtggcaatcatgggaagaaattaactgtagaaagtattgtgttttggggtaatgaactcttttctagctttgcaaatttaccatacattaaaaatctaacatgatcatacattattgctagctaaagtgctaaacaaggagcactggaatagttcacctgagcacaagtgcataacttgtacatcaatacatggcatgtcttacataataatggaaatatcagcgttcatttgagacatcaatacatgacgtgtcttacataataatggaaatatcagtgttcatttgagttttgatattacattggctgtaaagattcatgaagctcaactacagcagcaaatggggataggtcctactgtacggacacacttgtaaagcaagattatggagcatttattgctttttacgacccttgacactgattctcctcacagggcaaaaattaatatatgctgaacattacatatgatgctcaataagaaaatctacaggtgcctgaataaagaacagtggctatgtgtttttgagttacctcatacaagtgatccttgcaccatgagacttgtaggtttccactaattcgatttctggacaatcaaccctcaatcttctgaccattagaccctgtgcagaacaaattgcatgatgataggttgctttgcatagaaatggacttcttatatagaatcaatactgcaacagtgctcaaccaaaaatgcacaactacagacatgctcaaaaaaataaggggcaaatagatcttggtgaatttctacttacttgagataaccatatgtagttcctatccagcattagatggcttggtgtcacttccgtgggatttggataataaaaagccgaaatgggatcaacaaatttcatctgatgtacttcagtgtgcctgcgaatatatagctctcgaagtcccaaagctccacgaggtacttgttgagatggccattggttcctgaatattcaaaatatcatgacagaataaatgtccaattaaaatgtgtgtctctattcaaagactcaaaaggatttggtggtctgcaactagattatgagttactatgataatttctaagttcggacccaggattagatcccttcaatcaactcactagaagatgtggaattgacgggtgaacatcagcgaagacaaataagcatcataaagcgtcatcaggagggataaacatatttcacatttgctgcctgcctttattgtgtcacatgtatcttcacataaaaatttggatgtgcacatacaggaaagcaatttagtgactccaaggacagaacaacttcatacatactaagttacacagctttaatacaccttaacaaaaccaacaatactatcgttgttactctaatctgtctaacttgggagcatggaagatagcaatgctacctctattccctgtcctcaaatcaattttcaaattagttgggggaaaacaataactaaaacacgttaatccaataggggctaaaatcatcattgatacaaaataagatgcagatgtatgaatcacaatcttgtttttttgtttccaacaatcgaaacaagagatgaagttacaaggtatgccttgctgcaatccatggaaaggcagaaccgctcatgtgcaagttttttttcgggaatacgctagaggcgtatttttgtattaagaggagaaaaacagttctttacaaccaaaacaaaaggcagcaggggacaagagagccggaacaaaggagctaaggcctaatctcataacagaatttgcgacctaagggggcctaacactacagacgcagcgccggcaccgcagcgttggccaaacgccaaagcctcgcctcctcagccggtccctctagctacctccgtccagcccctgaacttctggttgaacactctgttgttgcgttctttccaaatcgaccatgccgccaaagcaacaatggtgtcatagcctcgccgaagtggccgtgcaatccgttctctgctctcacacagccaagagtgggcccatgtgcaagttcacacaacttaatcgatgcatcgactgatcttcctgattattgctgtaatgctccatgcttgtctcttcctaaatcctaagaccaactgtcatcacaatggattacagatgttcttccaagcgttaattttgaagtgctcaccattgtcagcatgcaccgatttcactccaatccaatattccaatggttctatcacttcaccaccacaaaagcatcgaattccctaccattaccgaaaaatccctcatccaaaattttgtcaaaatttttaccccggaggctccgcaaattctggtccgtggtcaccaaatcacacctctaaccactcaaacatcactacgccgatcaaacgcattaaaacaaacacacatagctccatactgacaccctcgtatttgcccccctcggaagctagcgcaagaagcgaggatgaaaatcccaacgcataaacccccaatcccccccggaaccacagagacaaggacgagcggtgggatcggttgcaccctacctgaagaggcggtaccagacggcgtcgcagtaggcggaggcgcggagcgggcggcaggccacggcgaggctggcgacgtcgcgggcgacgagggagcgggcgcagtgggccagcacgtctccgtcgaggtcggcgagcgaccgcgctggcggcggcggcgccccggccatccccccgccgccgtacagggaaaccctaggccgttccgcggcggcggcggcggcgcgggaaggggagagccggagagaagaggtggttattagttagttaacgagattactcctcctgttatttttctcctttccttcgaaggtttgtactgtgtatatatatagagatttcaaattgaccaaaaaacaagaagaagaagaatcgccgtgtcatcggccactcagctccacgtcgttgcaacttttggtgtcaaaaaggctaaggcgatattggggtcagtagatttataagggtaaaagaactctatgccatgtaggaaggcaatgcaagtatgcaaccatttaattgaacaagttgtacatgcgatgcgatgagatgacaaaccgtaataaacttccgtcttctggctagtgcaactcaatgtgatgtcttccattcggttgtgatcttgaggagatacaaggtgtcctcatattttagataatacttacttttttaaaaatattgtaacccatgaccagagattcccatacagatccagatccatagtaatagaacatatttcatctatttttatattgttacatattccaggactgaggaagtagcacttgttacattgtatttatgataaaaaatacactagggtggaatctagtgaggacaacggcgctcgcgggaggagctggcaacaacgatggtgctcgcaaacacgaggggcgatggtagcaatggcactctagcaatggatcagtagcggcggctaggggtgcaaacggtatggaaatttcccgaccgtaccgataccgtttccgcaaaactaatataataataatatttttaccgatgttaccgttttcaaaaattaatttttaaaatttttatcagcgtggcattgaagttgacactaaatagatgaattcataaatatgaaaatttcctgaccgtttccgttcgttttcgaaaaaataataaaataatgtaccgtttccgactattttcatccctagcggcggcactcacggacggatccggtggtgacagcaacgacgcttgagtgttcttcaaccttctttcccttttcccatctggcaagatttttcttattccttataggtggtccttacatataaatataatttatccaaagagcatttataaggacttctataacgtataatgtaactccagaggcttaagatatcgtttttggctacattgccatatatttttggtgagatagatggactaaaagttacagcatatggacatcaaataatcaaatggagagtatatcttttcttttattcccatatcaaatggtacaaatattaaactgtctaagaacataactcgaatccgtattaaccaagagtaaagaaacaaataaatacaaacaaaatacgcctcttacaacaacatcatttttcaccagcatgtgttcccctccctattagaagaagcccttcacttcagctcacaagcagcagcttcaagtaacaaaagaaaaaaagctcatcacctcatttgctcagttcatggcaggtcctccttcatgccgcggacgaactcctccgagtgttccttggtgacgcagctggcgagcatccgcgtgccgtcgagcggcagcggcgccttgaggatgacgacggaggcgatgaagtcgttgttgacgagcgggccggcgaacttgggcgggccgaagccgtagtccacctcggcgaacccgagcttgctccagtcggagacgtagatggactcgtagttgaacgtcatctggaacgggtcctgctccgtctcctccttggcgaactggaagaactccaccgccatcctctccttcgcctgccggatcatgtccaccacctccatcaccgacgacgacagcaccgtctcgctcggcgctgacatcttcaccgggaagatggagttgccgtagtaccccctgtccagcttcagcaggtggcgcacgctggcgaagaagcagagcttcacggtggcgccgggctcgaggttgagtgccctggtgcggcattgccacagcttcgccgtcagcacgtcgaagccggagcagaacttgccgctgtgcgccttgtactgcgccttcaggccgtcgatgtagccggtggggaagtcgaggacgatgtagtcgagcgccagcaccggcagccccggcagggggccgggcttgatgctcgggttcgggaacttctccctgtcccacaccggcttcaccctcggctccgggagcccccgcgccatgtcgcccaccgcgttgatgaactgagccgcgcccatgccgtccgccgacgcgtggttgaaccggagccccatcacgaacccgccgcaggtgaatttggtgatctgaagtcatatgcaacttgaggttagctcagctctgaagaattcgatcagtatgatacatt

SEQ ID NO: 61599 - DNA, 7807 bp, Oryza sativa
aagacggaccaggcgtacacagtaaaacccaccgtgcggccgtgccccactagtactggcttgtgttgttgcggagcggcgtggaattcgtgggccgttgctttggtgggctgtgggagccagggacagctgcggcgagagctaccgaagggacctcgccggacgaaggcagcgacgagaggtcaggcactggcaggctgcgcgcgcagccgcaggtgcccaagcaacgggactaatcgatcggttaaggacaagtatttccttagaataaactacttgtatatgcagttaggaaacagcaggatattgcagtacacggtcaaaactagtttttcaggtgttgggctagcgagccgctacagaccaaagatgtgagaaaatctacaatcctttacaggagctctgttaattgtttgcgaaaataaatcttttagacgactagataaagttgaccacatgccataattgattttggggccaaaaacggtgaaaagaaaaaaaatacaaattcgaggaccccaatcccataatctaggctagctagatgaagcataatctagggcttacgggtcgtcagaccccaattaatcccatcgttccatgtcgttcatggcggcggcagcgcgggcgaagagcggaccatgatcccgcagcaagtcggcgaagttagggttctcccagtagttgcacctgtaacgcttcaccatctccagggagtcgtcccactccgccgaccacccctccgggatctcggacaccgccctcttctgccccggcctcgcgaacacggcggcggcggccctctcgtcgacgcccatggcgcgctcggcttccttcagccgccgtagcccgtcccgcagttccggaggatccggcgacatcgggcgccgccgatcccagtactcctcctcctccatctcggccgccacgtccggctgctgctgctgcggcggcggcggcgcctcggccttcgtctgtgttgctgatctgattgatttggcttgcgctactcctgaaagatcagcagcgtcctccatgtttgtgataccgtgtgtacgggtgctcgatcgatcgcgtacgccggtggtaggttacacagtttgatcgatcgatcacgtcgtcggccgcgcgcgctcgtatattcgatcgatgtggtgatatagcctggcttggattagtggcgtcctccggccggccgctgtctcgttatatgcaccgggatatgtccgactcgtcgtacaaccgacgtactggccgggacaaaatgtccgactcgaacttgagcacatagcttgcagccctgctcggttccggcctagcccatggtctcagcctctcagcctttctgttcggcccatgaaattgcaggctgcccatgttgaaaaacttaagataagtgcactgtgataccctcaaatacaggtccactctaattcgtatcccaaccgtaatacagtatatgatatctttaccctctaactattaaaactggtataatttaactcccttaagccttgttcagttaatccccatgagaaagggattggaggggatttattccacacctattatggtgtggaattattccctcttaatcccctccaaaccgaaccaggccttagcagtttcaatggtggtttccactggcgtggcacgttgacttagtccacttgtactaatatggtagtctaatcacaaatttgaagtgcacccacatgtaagagaatagggggaaaaaaattaaaaactatgggctcacttgtcctcctaacttcgcaccaaccgaatcccctcctccctccctcctcccctacaaagctagaaccattggctgtgaatgcggatgacggacctagggaggatgacagttccattccgcacggcgatggcctgaggcggagcggcaacggcgcacccttgagcggtgcagcagtggggtgaccttaaggtggaggggcatctgggtggcctcgacgcgttgtgaccttgaggcaaagcgacggcggcacaggcttgttccgacattcgagctcccctcctcggaacatagtggccgaggtgtgcacgcattagggatcaatctattgcaattgctattttttttcgtcgacggatttttggggagaaaacgtagaattttgaatcgttggttttgttctaagattcgtgtaggaggagatagaaaaaaatagcaacacatcatgggcaacctaggcttcacgcgcacacacctccctaaatggctaataaacgattgctcgcgtccctcctgctcccctcctgctccggtgtctacccccacaatcccctctatgtcaccatcctccttctcgggtggtcatggcaccccacgctgcagcaaagtgagatttgtagaggaagaaggaggtagccacttacatgtgggccccactttttttaaaaaaaatattttgctcactaggataccacattagtgaaaccatccctccatattatcgtgggacttgacttaaacggtcttgtcaagatgagatgtgaagatttctagtattacggtttagggatatctattaaactcaacgtaaagaggaggaacaacaggtgaacttcttccgagccttgttggatcaatgcagagcaagcccagaccacaaaaaaaaggatttattcgaagtcttctagtactaagatattttataaaaagacacgaatattagggaagtgcctaatatcaaataattagaaggggtgatgcttcgaacccaagtccgcccaccgccttgtggagctagccggaagacccctgagcgtttctccctaagacattttattgtaattataatttcgtaatatttttttgaattgttatttaagaaaaacaattgtaggcggtcgtattattgcagccgcctgcaaaaaataagagcaattttactatacaatatattgatggtatatactgacagtataaatgatccaacggtgtagattgattacctacccacttaattagatttgtagtataattccaacaaggatatgttggtctttttgttttatttcatggtggcaatttcgtaaattccagcatacaagccagctccgattccccattcccatcctcccgttcacaccaggcggcggagttgtgccagcagccacacagccgacgctcgccgtgccagccaccacaaacacatcgcaacactaacgctcaaaatcgattaggcatggtgatttagttctctctcagtcccataatataagtgattttaatttttttttcactgtttaaccactcgtcttattcaaaaaaaatttgtgtataaatataaaaaaaagttatgcttaaagtattttggataataaaataagtaaaaaaataaataataattctaattttttttgaataagacaaatggttaaacagtaccaacaaaatatcaaaatcccttatattaggggacagatggaatactaattaattctagggcacagaaccctagctctactggtgacgctccctgtaccattgccatcttaaggtcagattctacagattaaaattgcagagaatatttgcaagaacataacacgagaacataagagtacatatgttaatgcatgcattttcgtgtgcacagatcgcatgagacggtggtgggaggcggcgattggccgcttgaacaggaagcaggcgccggtgaatccagtcaccaaagaggactaatcgcaccgcctggctcgtctctccctcacctgaatcatgcacggcgacgccaaaagatagagattgaacctaagaatagattattaaaatatcatttacaatttttttagcaaatttgtattgtatccttgtaaatactgacagtatatactgccaatacattgtaccgtaaaagtcaagcggtgagcttaatctcgttatctacagaaatcaatagattttcgcatgcatacagtaaaaaaagagctcgatagtgattttctctgatctttggtccgtagcggctagcccagcacctgaaaaactaattttgaccgtgtgcaatatcctgcagtttcgtaaacattgcaactatacggctctaattaaacttggatttaccggaacaagcatatataagtagtttattctaataattacttatccttaacccatcgattagttgctttgcttggtcgcctgcggctgcgcgcgcagcctgcctgacctcccgtcgctgccttcgtccggcgaggtcccttcggtagctctcgctgcagctgctggagcagacggcgatcaagtagccggtgtccgggtcgccgcactgcttgcagctgcccggtctcctcgtcatcaccgggagaagctgctcgtcgccgtcgtcctccaccgggtcgtccaggatctgttccacgtaggggaaccaccactcggaccccgtgcagcgcacgcagtggcgcccgccgcgccgctcgacgcggaggacggcgtcgggcaagctcgggtcgtggtggtggcggtggtggtccgggcacgcggcggcggcgaaggcggtgccgcacaggaggcagaaggcgtcccaggggaggcgcgtggcgtagtcctgcgcggcgaggacgtcctcgacgaagtccgggtgaacccggcagccgtccgggccgtgcgtggcgtagactccccggccggcggcgtcggcggcgacggggaagaccatgtggatggtgggctcgtggtggaaccagcagcagtgggtgcagaaggcgtggaagcagctggcgcagaagcactcccgctggcacgtccccgagaagtcctccacccacagcgcctgcttcccgagcaccaaccattgctcgatctcctccggcaccgccgtcgacgacgacgacgacggcatcggaatttaatttagagagttcgcacgcacgatcagctagcgcgcggatagtatcacataaatgtcgatggactgttatgctgagtacgttcctcccccgtcttgtgtatatagagagagagatggccacatcgacccaacatgcatgtacaaagaatcgagttcggtttgggacccgaacccctgcatggccgagacgaaaaacgtcactagctagtatccaagtataggctgagagtcttctgcctgagaccatgggctaggccggaaccaagcagggctgcaagctatgtgctcgagttcgagtcggacattttgtcccggccagtacgtcggttgtacgacgagtcggacatatcccggtgcatataacgagacagcggccggccggaggacgccactaatccaagcaaggctatcaccacatcgatccaatatatacgagcgcgcgcggccgacgacgtgatcgatcgatcaaaccgtgtaacctatcaccggcatacgtgcatgcatgtacaacgaatcgagttcggtttgggacccgaacctgcacggccgagtcggaaaacgtcactagcagtatacaaaataggattgggagttcgagagtcgagaccggaggaatattacgagttactccctccgtttctaaatatttaatatttaacgccgttgattttttttaaacatgttttactattcgtcttattaaaaaattaagtaattattaattcttttcatatcatttaattcattgttaaatatacttttatgtatacatatagttttacatatttcataaattttttgactaagacgaacggtcaagcgtgtgctaaaaagttaacggtgtcaaacatttagaaacggattgagtattaattagatgcaatacaaggaaaaaaaattctcatgcataagcatgcgcgtatgtatcggggcatccctccttaaattttgacacctatagctgcacgaaacttggagcaactataccttctaaacatcccccgtgtttccacataaacttgattggtcggtcaagcaaccgctactcatacgcgctcgagacgggctcacaagcagctagggtacgcggccggccagcacggcaagctggccggccgccgggtaacatgcacgcagtggtcgtgccccacacgggcgtgcatgcagcgccgcagggagaggaggaggctttgctcgcgcgatcggtcggactgggacgatcgatggagtattaagcaaacaaccggcacggacggacgtgagcgacaagtggttggctggagctggaagtctggaaccagttacatattcgaacgtcatgcatgcgtcttatttgaaaccctgggttttcgtgtccagtttgtccatctgttttatttaaaaaaaatatgaaaaaaattaaaaagatgagtcacgcataaagtattaatcatgttttatcatttaacaacaatgaaaatactaattataaaaaaaatttcatataagacggacagtcaaacgttggacacggaaatccagggtttgtttctttttgggatggagggagtagtctttaaaagagggccattatttcttattattactctatctaacaacaaggtgtcgtcttttgcatgaaccgataaggagaacgaaagctttaatttgacatgctgggccggctcctgtcattctgtcaatgccaaagcggatggcaattcaaactggccactaattttctggtcggtttgcttaattttaatttcaaactgaacgcttgaatactcaactctatatatatgctgatttgctgaattttctgctcggtttcagtacgatcgcaatcgattcttccatcattatagatactcatgtcacgtggacatcacgttagccaaaacagctcataacgctatcgagaaaattcgtttgcatcgattttagaagttgtgggacgacacctgatttcgcggttgagggatgtggcacaaactcaatttgtatagttaagggacataaaatggactttgctattgagcggattgagtacagtgagatcgagagcaccagaagcgaagcagcacgtatcactcaatgatgggccttgaccgaaaacgacgctgtcagactgcgactgggccgagcgctacagtttcctttcagcacgcgcgcaaatcccacccccctggtccccttgcctccctcggcccatcccgccgcgcacgcgagacgtgtcgtcccaatccgccacgtcctcgcccaaagctccacgacagcagccagcagcaggtgaagcagcttggcaatttggcagtggtcgtgggctcgtggctggaaagtggaggaaaccaacctgcaaaacccaaggcggcgtgcgtccgtcggtggaagccgcggacgaatcgccacgcccaccgttcggattggccccgtcgcactcacacaacttgtgtgcagccctgacacacaaccgcatcagatgagagctcccccggaaaaagcaaagccaaaaaaacccccgagattttacagccataccccgcacaccacgccacgcagatcttttctcctcttcctcctcctcccttgactttcccccacggcgaggcgagggcgcgaggcggcgatcaccgcgtccaagccggcgatggagggcgcggaggcggaggagcggaggctggcggcgtcgctgacggcgcggtactcggactgggtggtggaggcgctggacgagctcccggggagcttcatcctcaccgacccggccatgccgggccaccccatcgtctacgcctccagggggctcgcctcgctcacggggtacccgccgcgggaggtgctcggccgcaacgcgaggctcttccagggcgccgacaccgaccgcgccgcggtggccggggtgcgggaggccgtgcgcgggcagcggccgcaccaggtctccatcc

SEQ ID NO: 61600 - DNA, 38354 bp, Oryza sativa
ttgccatgatcaaagattcaaaggtagcttcagtattcaagtaacggttttgctatgatccatcgtttaggcatcccctagctaaaaccacccaaccaattagtacaaactcactctagattacatcctcttgtggcggcatcctaactagtctctacaagctggccatgtcggagggcctaaggggagaggagttccattcttctctctcaccctctctccttaactcctgaatacttggatagagcggggctttgtgttgattgtaagagttgggttttgggcgatcccgaccgtgttttctttgttggcctagcggaggtcggccacggttagtggtggccggtccggtgctagccttctccttgttcagtgttttggcgttgtcggtgtgtgggtggtggtatatttttccctttttcctagttacaacttccagggttgtaatcttataatttttcttctgctctatcaatagaacttcgcaccgtcttatgcgagtcgttcaaaaaatattataacttgtatgtaattataatataatatgtatgtaactttttatgtatttttaatctggtatatttactttaagactctgcaagcgggaaaggaaaaaatcatagcgcaaccacgggtgatgcaatttggtcacgtgtactcctttagtggaaataatgtgttaaacaaattatattatagttatgtgtaagttacactataattatattacaattttaatatttacattggtaatccctttcaataatactttgctatacctggatgagttaacgtttttatgtaatcaattaatttaagtgttaagcagcaggacatgcctaacgcatttcttggctcttaccaacaacatgagaagggttgcgttctgctatagcattctgttagcgtttgcaatgatcaaagccagcttcagtatttcatcaacgctgtttgattacatttccaaacagttgtagtactgatcacttttgctacagatcacactctctatatttcagttactaccttagttttttaaatacttgataccattaactttctgacaaatgtttgaccatttgtcttagttaaattttttatgtaaatataaaaaaatatgccacacttaaaaaacattttagcataaatcaagtcgcaataaaatgaataataattacataaactttttaatatgacaaatgattatacgtatctaaaacaacaacaacattacatattaaaaaagggaggaaatatgtgactagataaattcagtagattcagaaaaccttttgctgcaacgaaaaaaaaaaaagctaggtgcgaattgtggtgggcctatgcccctcgagtcggcttcgggtggcccggccggccggagatagcgaagctggcctgctcgttagcccgcccccaatgcggcccacgtaaatcctgacaatcgcgacagataaccgttttcacgttaactaggtcaaaagttaaacaaaccgttgacaaaccatactttacaataatgtcaaaatgttcaatacaaactcatgattatctgtagtacgctgtacacattagtcgttgttaccttgcgagatcaaccgtcttccaagagttgcctgtgcaaatttgacgtgctcgctagtcgctagttgcccgtccatgtgctaataaaaagagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcataacaaatatttagtaatttattccttattggttttcacaactcaaaaaatttacacataaaacatttctagcttttaacaatataacaaggacaataaagtaatttctacaataactaacggtcaaactaatggtcaactaacggaatgggtatgtaagggatccaaataaaaactcaggggtatataagatatcaaacaaatttcaggggcgtagaagggattgggtgaaattatatgggcatatagggaattggccctaataaaaaagaaattggtgcggtctttggcacgttagctagttagcccgtcccatactgtatacatatgaatatgtacatggattcgtgtatgaatctatcgacaatctaaaacgtcgtataatgtgaaacagatgaagtatttaacagagcttattaataatacttttgttatcgttttccttttagataattttattttcattttatttttttaggaaacacaattttattttctagtgtaacttacagcacatagtatttacctcaagatttacaatatccacatattgtggtgagatttattgtatttgaaaaaaaatgataatagtttccactctaaatttttatttaaaagtataaatgaagcacacaagtaaattggtgtatgattagattaacatgttaaatgtatatgagactgtttagtagaattccaacacataaatttagctttaggagttagatctaaagcagagttgtggaacagcttaaatccagctccacctctatagttcagccttgtttggcaccgtttcagctctggagcccagccaaacaatttaaactctagctaaaatgggagcggagctgggtggagcactctcacaaaatgaactgagaagtggagctaggtttcgactgctccacaactccactctaaacccacattataaagctaaatttaggggttagagctctaccacatacctactccctccgtctaaaaaaaaagacaaaccctgagtttccgtgcccaacgtttgaccatcagtcttatttgaaaaaaattatgaaaaaattaaaaagacaagtcacgcataaagaattaatcatgctttatcttctaacaacaataaaaatattaattataaaaaaattcatataatacagacagtcaaacgttacatgaaaagtcatggtttattttttttcgatggatggagtaaaatactgtattccgctccggttcggcgacactccacgttccagtcgtcgcagtcccggtgcgcggcgcccaaccggccaacccaccgacgcggcaggcagcgagtcagtgtgcgtgcggctgtgcggggggagtgcgagtgcccatccgcccactccactccactccactcccctctcccgcacttccatccccaaccccgcccccgccgcggcgccaccttccccctctcctcttctctctctctctctctcatatggtctcccgcggcgcgccccgctactgtccatcctagcgcggagccgcagcttccccacacgtccatggccgccgccgccgccgccccccggttcttgcccgtccgcccgctctttctcctcctcctcctcctcgtcctggccggcgtcgcaagcggcaagacggtcaagagggacggtacgtagctggctgctccgctcatccttctctgcacttcttttttttttctttcccccccgtgaattgagcgagtgatactggtctcgtgatgcgcgattccgcgacatggaatttgggaaagatttggtttctttggccgttccctgctggagatctgaccatctggtgccttgcattcttttatgctcatggctgtgaattgggcacctgctcgatcggttagctgcctcatttggggtgtgtagcattgggatctgttgttggcttgtgtcttagatgtctaaattactctgtgattgtatacatgtgactatctagttttgccatttcctagctgtatactaattaggctccacactgactgacactgcatcaggtggagaggtttatctcttcatagagacatggatattagtctgacttaacaatgtttggcggccattgagtaatttcatggttcgtagaatgttggaaccgactgaaagaaaacaattttttatgctgcagtgaaagcattgaatgagatcaaatcttcgttaggatggagagttgtctactcatgggttggtgatgacccttgcgggcatggtgatctgcccccctggtctggtgtgacctgttctcagcaaggagattacagagttgtcaccgaactgtaagaaacacgtcttcaatttcttgatcttaaaattttctgctgacatacataaggatctgtaaggatttttagattgttatgtattgccttttctatgtgaaagaatacaaatctgctcgtagattgattgtttccgagtggggaaaaacatttgtcacttatggtctccaaggtcaaaacttttgtcttgcttggctgctccaacatccgaaacactcttttactccctagttaattaaaagtgcaatgatatttcttgcttgctgatttgatgtggaaactagctgattaagtcctttatcttcatgctgtagctgtctgaggaatcttagtaaaaggctcaaagctacacaaaattcataattttaatagtttcttgctgagtcttaaatatgcaacctcaacctgaagaactgtacctgaccacgctttcttgtgtatgccagatataaagctttggtgtatgaggccataaaatggattagaaaatcctcttacatgatgccatttcgttccttaaatttcttttctgtaaatgctttgaaatagttggcaagaataattcttaactgttctaataccaatggctgctgcatatggatctcaactctattaaccgcaaaatcatgcaacttatgttaagctatattatatgtttgttgatgtacaaatctgagtaactatattgcttatcttatttcagtgaagtctatgctgtatcaatagtcggtcctttccctacagcagttacaaaccttttggatttaaaaagattgtaagtatgttttccttgtcaccactgctttgttcccgtattatgtacaattatcttgaggtgcatgtgttggtactttgtaattatttggtgcaacctgagtggagttaatgttattgtctaattagttaccttctttgcaacgataataaattatacgtttctggtcttttagagttttagtacaaccatcagcgaaattacaatagaacacatctgtgcagatgtatgcgctcttgtaaatttatgtttccatgtaataggctgtgtcatgaaaaatggatttagagagaacattagccataatagaagaattaatttattctttaaatcacttcagcttataaaatatggagcttttatattgcttgagttgcagaattctatgtacaaacagtttcttccatttgcatattgcagcggatatatttgagtagtattttattttcccaaaaaaactatacaggaccaattcttctataaaacaagtaccttaaagggtgtaagtatctttgtaatttgaccatatcttgcatatttaagcaatcctttaaaccatgtgaataatgactactccaactacagggatctacacaataacaagttgacagggcccattcccccacagattggacggctgaaacacctcaggatattgtaagtatggattgtctttgtgtatgcagagctagattaagatatgcttgtcatcctgagaatagatactggctctggaaaacattttaatttgtgatgcataaaccatacttgtttatgctctttattcctcagcctcagataatactttattgaatcaatattactatgttggttattggctagatagctgcctgttcttgagtacagattctattcagctaatcaaattgtctcatgttcttaggaacctgaggtggaacaagcttcaggatgtgctcccacctgaaattggtgaactgaagaaactgacacatttgtaagttctttttctttttggaattcttgagtttatatggaaataatacttcattttttgtgcctctaattgccattgaaaatatgcagatatttgagcttcaataacttcaaaggtgaaattcctgtggagcttgcaaacctaccagaactgcgctatctgtatcttcatgagaaccgctttactgggaggatccctcctgaacttggaactctcaagaaccttcgtcacctgtaaacatccatcccagatccttttactgccccccaactattgacatgcttgtctattgagttgtcttactgaatgctgaattccatttttgcagggatgttggtaacaaccacttgataggcaccctcagggatttaattggcaatgggaatggtttcccctccctcagaaatctgtaagcagattttttacaagctaccatatccattccttctctcctgaatggcaaatgctgtcttcctaagcttactgtaaactgtgttctacaggtatcttaacaataatgatttgactggcgttctgccagaccagattgcaaatttgacaaacctcgagatactgtaagttttcttaaactttgctgtcaacactgtatcaagaccctgtaaccatcacgtcattcttttacatatgtatactctgcaggcacttgtctaataataggctgattggatcgatatcaccaaagctagttcatattccaagattgacctatttgtgagctttactgcttcgatttctatatttatgtaaagtgaaatatttgatcagcttgggtctgatatgtcatatgtctcattttacaatggttttacagatacttggacaataacaacttcattgggaggattcctgaaggattatacaaacatccatttttgaaggagctgtaagctggctttagaatttctactctcacgacattattatttcatacttgaatctgctctgttttaggtttacttaggcgcacacttttttttttttttgatgcaggtacattgaaggaaaccaatttagaccaggaagcaaatcaaaaggaacgcacaaggtgcttgaattacctgatgctgacatcttagtttaacaactgtttattctgtgacgatagcagagcggctaccgttctacatctcctcagcatgcaccaacaaaaatgtatgcatgtttttaggatatatacgatatatgtatcagtagtacagacactgtttctcacagcactgttcgaggacaagttcacacacacaaaaggccacttgcaaaccagaaaaagaaaaaaaaattgtaaagtccagagcactgctgctatcctgtcatccaagagtatgttttcattagatgagtgtacaggttgtattgcatttcttgtaacttagtactactgtgtaatggagatgcagttcagctgtattgccagcacatttgcatggcaccgacagtcctggtgtaatgtaaccagtgtgctcaatgatattttttcttataccactggacatgatctggccttttgcaagcaaatttagggccatgactaatcgaaatcataggcatgtggggaggagaatatgccaataataacaggctggatctgcctatacgagggagcactcttattatgagctaatgctcttgaaccctttcaatttcatatctacagaaaaaaaagccagaaaataaatgtttttttaaaaacaattttacaagagattaattatatataaaaaagaattgggccatgcactcatgatgaggaaaaaaaactgaagtgaaatctaggaaaaattgtgtggtgtaggagtacaaactagcagtctagtaccatgtcatctccaggcgcctccagtgcagaaaaaaaaaactgacatgtttataagctcagtttgattggatgagtgttgcagtaaggaatactgtcaagggcacatgcatttcttacaccatttagcatgacacctctgctgggatgagtggtccatactgcatctggtacctctgctccctttcaagctcatactatgatgctttttcaagggttatgtttgttgctagtaaataaaggatatgaaataggtttgatgaaatgtaaaatacttgtcctgattgatgtcaccaatgtagcatggttagattgtgctgccaccctatccaataccttggtacatgatgccaaatatttgctgcattgctggaaccaatgtactgccaatgtaaatctaacactgttattttgtaccctatgaaaagttcctgtcctgttctctgaattgctgtgtgtttagccccggcactcttgatctgtttgccacaagcaaagtttttcttttcttttctcttcagttcttctccccacatgaagtgtcactgtccagtgtccacccccaaaatggtccttgtttgtgctattttgctgttcccatgtaagcaaagcctgtgctatattttgctggatcatatgagctactcccatggagtagtatatttcagacttggagatgtcctagtctcccatgcttccaagcacatctgcacatggagaaacattcaccacctatgattaaaaagggcaagaactcactgaagacaaatgcttcatgagcaaagtgaaattttctgtttcaaaatatgaacaaatagctaagccatgttcataccacagtgccagaggcttgtgacacatcctgcattcttcagatgctgccctcaggcatgtggcccatctaatgactagcggctcaatcatactttgcaggatagtcaattgtgcaggcttttacactggttttgcaagatgttcagtacttgcaaaatgaacagttacttgatgttgcatgattgaatcttgaaagagaaaaatatgtgattatatgattatgtatccatggatcatatctaattgcaaggttcaggaaaatctcttttacataaaatagaaatttagaaaattagggcagtgttgaggtgttaggttcaccgacaccgttagggggtgatgtctgctaagatttttgtgtggttatgttccttccattatagctgtcaattgtcaccttattaaaatctgaagaaacactcccctttctcctcctttgcattttctgaagaagctgagatatgaacaaacatgccgactgaatttcactgaatttctctgctgctacctgcccatctttcatccataaaaaaaatgtaaacagttaaaaatacagtagcactgtacctgttcttgggtgtatgatactaaattactaatatagtataatgattcccattcctgtagcctgaggagcctgtcatttttgccacttgtttttcttttgccctctctgcaaagaatcaatcagagaacacacacatgagtacatggcacaagccaagctgtgcctctgcatgcatgggtcacctggggtgctggagcatgcagatgcagcagctttgccactgtttgtttatttcaccaaaacacaaaccaaaaggcatcaccaaggcaaccaaaccaaaccccatggatggtccaaggctgtgagtgagtgagtcccagcattcatcataattttgattctgctcatccggatgtttctctgaacatgacaaaatgaatgacatttcctttatctagaccatcatccctttatctgaagaactctgctttttttaatccattcttgaggtttggtatggtttgtggagttgttcagagaacagctcaaacctggactctactgatgatgctctttccaaaataataataataataataataaaacctttagagcaaaattaggaggaataatttacataactcaggaaagaatctataaatgagctatatacaaaaagctcatcaatcttccaagtgacctgtgacactgctgctctattctataacaccataagtgctaccaaaccacctatcaccaaaaccacctccaccaaacctaacggccgacctcccctgggacgaagaagaatattgaattcgttccattccatgtcactgaatttgtgaaacactatttttaaggttcattgattatctgtttttttaaaggttcagtgaaagcaatggacccagaatcacttgttcagtactgaaatgtcactacatttggagctcattactcaagtgagcaaaagtagagttgagaccacatcaacttgatgttaaaaattaagaagttttaccaagtaaagaaaattaggaacaggtactgtaactgcatgtggggtgatggtagtattatcatatagtagtagcacaattagcaatgctatagtataacaaagaatccaaaggacactgtattttaggctgcaagcacgtggttagccaaccccaatctgattagctagatctgagtgctcagaagaggaggaacatgcactttgtagtttgcaccaattgagcactgcattatcccaaatataaaatggcaagatatctgcttcagcttctcttccttcttcctttttttctctttctttttttttgtttgctgggagagctcatgagaggatggcatggcagcatgtagatgaagacatgcaagtcacctagatgccacttctttaaaaaggttaggtggtcactaacttggacaccactccttcagtgagcaaaggggagaattaagtaaataatcagcactagaattcactcaattatctcatgtgttcttacttcgtactacacattttgataatattttcagcaagatatgatagaccacctatacttttgtcactgacaaatagccatttgatttttttccccgggaaaaaacttttttttgaaagatcatgaaaagaccattttcaacatttattctggtctcttactacctttgtatttaaatatatgatactgttgattttattcgatatttgatgtgcaaccttgatcactatttttctattagaatataacgataaaacctaataaaattgtaacattataaaagtatttataaaaaaatctagatctttatattttcaaactaaatatcttaagagctactcatggtcaaaatttcaaatatctgaaccgaataaagtcaaccgcgtcacatatttaaatatggatgaagtattatatttcagtacacacacaaaatccttccattagtttagtgatatgggatcgcaacctgtaaatgagcagaacaaaatggcacgctcagcttaggtaagaagttccactcacaagtcaaactctgagctctcacgaaacatacagctccttgatctccagaacaacaaaccaaaaaaaagaaaaaggaaaacaatgactcactctaccccgaaactgtcggtgcaaataatcgccacgcttttcacaacgcattagcagtaacagcaacagcaaaacgtaattaaaccaccaccaattgcaagcttgcactgacccgagtaataatttaaggtcctgagtttaaatttttataagagcagttgtttgcgaggctaaattactaattcaaataggtgtatatattcggttggatgtcgagtcctgttaaaaaaaatacccttctctctctacaaaaaaagctagaagcttaatcactagacggagaccaagagaaaaaaagagaggaaaaaatgaaaaaaaaaagtgaacaagaaagaaagggagaaaaacgaaaacgaaagtacgggcggatgtgccgtgcgtgcgcgtcttggcagcggttgatgaggagtagctgtcggagaggcgagggctctgaaagcttcaacgccttgattgtttagtcccacctgctctgctccttctctctccgtacgttggtttctttcttcttccattgcatctccttccatggacgtcggagacgacgaatctcactcagtgcgtcgtcggagtggaaccgttcaattcaaagatcggtgggtggggattggaaggatcggatcgggagcagtgacgccaagtcgcgcccagtggcgatggccagaacgtcaattgggaacgcgagagtcaatggcttgagctgagttcaaaccaattgggtcagaacgttgctctatagcaagatttttcattaatattaatatataattaattaagtattagttaataaaagttcgaaaaatatactaatatagtttttttaaaaaaactttcatatataattttttaaaaatacgcgtgtgagaaaagcgagagatgacttacgagaaataacaatgttcatctagttggggtttctgaaataatttatatattcaataaagaaatgaaatataaatagaacaacatcatgctatataattacactgaatgcatgtttacaaacacccttttcatctagtctagaaaatgaattatgcaatccattgctatggaataaaaacctcaccaaacaccccgcatcattatgttttgatctttaagcttttgtatggctatttagaatggcaattccacctttatattcaatacatttgctatagcaccaggtttctattacgttagatgctattgccacattcaagatttaagaggtgacttgtgaggaattaccatgtttaatgtttaataaacaaattaaatcatgttaaatattatgctatacataactcaattacatatgtgttcgaattgcttcaattagtcatatagaaaataagttacgctaaccactgttgcagaaaagaaacctcaccaacaacccaatatcaagccaaaacaataaaaccgcctagcgattccgagtcccattggttaccttaataaaccaaagcaaaaactaaaatttgaatttttaaatttaattttgaagttgattttaatatatttataaactatctaaactaaaagtctataaaacaacacctccttaggaaaaaaatatttcaaaaaataaaagaaaaggagggtaaaaacaaactttttttttaaaaaagagctgaagaagaaagaaatgaacaaccaatcgaaatcacctctcttctttttttctctcctcttttttttttctttctcctcgcggccggaagagggaagggggaagcaagcaagaaaaaaaaaagaagaagaaggagaagccatagccgccgccctcctccacactccatccgcttcttcccctcctcaaaaatcccccaatctctcgagctccagaggcgagagcccccaaaatcccccgccaaattagctgttaggcccccgagctaatcccgaattcgctcgcggcgccctgcattattccatttattattgttattattattattcccatctcttttttagtttttttggtgttattttggttgcgtatttagtatcaccacccgtgcgattagcatgtctcagcccaatgccaccgcctcgccgccgtcgccggaaccctaggccgccgccgccgccgtcgccgtcgccggagccggagtcgtcggagctcccgtcgtcggcgggggaggaggaggatgcagctgcggatctcgccgagcatgcgcagcatcaccatctcgagcagcaatggcgtcgtcgactcgatgaaggtgcgggtggcgccgcagccgcccccgccgccgccgccgctcgcgctgcagggggtggtgacgccgggcgcgggccgccgtggcggcgggggagggggaggtggcggtggcggtgggtggtggggggcggggtggtactggcgcgccgtggcgttcccggccgtcgtggcgctcggctgcctcctgcccttcgccttcatcctcgccgcagtgccggcgctcgaggccgacggcagcaagtgctcctccatcggtaagatcggcgtcccgcgatctggggcggcgttttctgggcttggttgcagagggttgttgggttgttgatttggctcgttttggggggcggcgaatctcggatcttagtgctcttgggcgtgcgattttgcgatgtcggtgggaatgtaggtccgtggagatggttccccgacttcctgtctagatttcctgctgaaaacgcgtgattggctctctgatagacttgtttgttgagctggattcgaggtatcaggttatgcgatcttgtttatgggtgatttgaactggaaacatgagagttagacgattcgagtttatggttcagctcttgctggtgagttatttgttggatcccgggcagctgattttctggtattgaccaaaaatgtatgattcgaactcagctaattttcgaacatctggaatgagtgctatcagctgcgatgttgatttggaagtattcttttatcctggttttgcgctgaatcttgcaaaactggagtagaaacactatcctgtgctggaactgcttagagggttagcttacacaaaatcgcaaacaattgggacattggggatggatatgcaagtaatgcaacctagagaaacaatgcaacacccttgatgcacctggctgattgatttgttgaacttataatttgctttgcttctgcgcctatggcagcaacattcttggccacccgactcttacttgataaattactaaatcaggatcacttaacagttctctcctactctcactataaatatgttgtcaccaagcccaagcaaccatgttgtttatgtttgatgcttcagttattgggatttaaaagctgctatcttatgtgctagacttagcagttgtctccttgaatgtagagatttctgtaatataagtttgaatgctgtttatataccttagacaggttatacacctctcaaactgatatttacaattcagttgcttgatgcatcaatttgttctaagtattgcattttttgttttgcagattgcttggggaggcgaatagggcctagtttccttggtaggcaggggggtgattctatggtaatttacttgattcctgtgcttctatttgtaggtaaaacatgatctgtgttttaccatttctattaaagaaaatgcaaaatgtattgacttcttactcaatatgcacagaggctggtgcaagatctgtataggatttttgatcaggttaacaatgaagaatctcctgatgataaaagaataccagaatcattcagggactttcttctggagatgaaggatagccattacgatgctagaacatttgctgttaggttgaaagctacggtatggaactaacaatcaaagttttttttttctttgaaaacttagtggtgcataacttctttcattaaagcagctaacttctaaaaccaaattgattttgtgatgcacattttgtagttgacagtagcatattgtctgaagtctttgtgttcctggacaaattataggaaaataatgcattattaattcatgataaacagctgcatgaggaattagatatttagatcaagtgcctgatatccaattatgcccgctcagccacccagatgggccttaaaattagtttgaaggagagagtgatacaagagtgacctttgcttatgaaccatgactttgtagcaacattttgttttcaaatgtttttggtagggatgatatacttgttgtacccttattttttgaaagaaattatttcgcttgtgttttatagtgggatgtcttgcagctattggtacgtaatttccattacacacatctcacgttttacatttttggtataaaatttccattacacacttctcacgccgaacatttttggagcatgtgattctgctcctaatgtattttgcagttttgctgctggtggtcatttgatactgtcatactggtcgctagaattttgaacttggctttggtggcaccacatagcttattcatgtcttatatactgttaaccctgatgaggcactctgatgtttgcatcctgcatgtgaaatatattgatcactttatgtgcttctttgtagatggaaaacatggataaggaagtaaagaagttaaggctggcagagcaattatataaacattatgctgcaactgctattcccaagggcatacattgcctgtctctgcgtcttactgatgaatattcctcaaatgctcatgctcggaaacagttgccaccacctgaactgttacctttactttctgataattcattccaacattacattctagccagtgataatatccttgctgcttcagttgttgtgagctcaactgtccgatcttcgtcagtacctcataaagtagtatttcatgttattactgataagaaaacgtatccggggatgcattcttggtttgctcttaattctatatcacctgctatagttgaagtgaaaggtgttcaccagtttgattggttgacgagagaaaatgttccagtactagaggctatagaaaaccatcgtggagtcagaaatcactaccatggagatcatgcggcagtttctagtgcaagtgacagtccgagagtgcttgcttcaaagctgcaggctcgaagtcccaaatacatatccctgcttaaccatctccgcatttatttgcctgaggtactttgtcctcaatattctctattgcggtataatagttcatcattatggtccattggaatgtcaatttatttagtattttctatgtttggaggattttgccagtttagacatttcagttttgtgaaaatcccctgctcatgatacacatttacagagtgcattaggttgtgcaaatgtctgcttggaggcatcagatgattaattgagcttggaaatgtcatggtgcaatctttcttacacaggacaaaggaacttagtggaaagtctacagttaaatgagaaaaaaagtggtccttacttggatcaacttgaatgttttgaatatgctttgatttgaaaatattaggttatgcaatcactaagcaaaataaccttgatatctgattaaaccattatttttattttgggctatccatgttatcaataaattagaatgggctgaaactggataatagctgtgttacttttacagctactgacaaatgaaagatatggcctacccatctttctttagctgatgatattatttatttatacagctttttccgaacctcaacaaggtggtctttcttgatgacgacattgttattcagcgtgatttgtctcccctttggaagatcaatctcgaagggaaggtgaatggtgctgtggagacctgcagaggagaagataactgggtgatgtctaagcgcttcaggacatatttcaatttttcccaccctgtgatagctcggagtcttgacccagatgaatgtgcatgggcatatgggatgaatatatttgacttggcagcttggaggaagacaaacatcagagagacataccatttctggttgaaagaggtaaccttttttgtccttacaataatctctctctcattaatcagatgggtgctttgatcactaagcatcagtgctatgaaaaaagtgccttatctgtcttggcataaggtagttgttttgttaagtgctggaagtcttgaactttctttcacctggcttgcttctagttaagattctgtttccaaaatgtatcctctgctgcttttgagatcaacaatactattctggatgtacctattcgacatgtagaattttagaatggttcctcatgtagatgaagtcttatgatcaagaagcttcaaagtaatattgatactgatgaataattaaagttcattccaagtgaaactttcatatgtacagtaggcatgcgcataagacctgatttaagaatatataaggactctgacctccaaaccagaacctccaacaggttaaactgggatttagctgatgtgtctattagagaattttcttgaaagtgacggctaatctaaaatctagatcccataacagagcagtcaatgatattcttcagagtattacgagcttaattgtttggtataacttttgtatatttcttgtacagtttcatctgatgtattacagaatctaggcagccaacattgtattaaaatatttttactggtgtgcttctgacatttttgctgccagtaacacaaacacaccccgccacatatattctcacttatccgtgtatatttattgtgctaaaatgtgtaacaagatcataatggtaataccattactgctaggattctacctggtttatatttgccattatgtgctatatgaaatagacctaagcaattaagctatattaaaagtattgctagccactgacatagagaagattttagtttcatctttgtaaatacctcaggatggtaattttataatgctgaaaagtgaacagtatggcattgtctatgtctttgtttaatttcataataacctctgcttcttttgcagaatctaaaatctggtcttactctctggaaatttggcactttgccgcctgcgctaatagcattcaggggccacctgcatggcatagatccatcttggcacatgcttggcctaggataccaagaaaatacagacattgagggtgttaggagatctgcagtgatccactacaatggccagtgcaagccatggctagacattgcttttaagaacctacaaccattttggacaaagcacgtaaattactccaatgactttattagaaactgccatattttggagccccagtatgataaagagtgacttctgggaaatggggtaggcgcattggagtatatcataccggttgtgattcatttgttcactggagaggctgattgctgttggatggtgggaagattggtcaattcgttaacaaccagaacacaatcagcactgaacatacctgactatgccctggatcgactggcatgcaaatactcgagacttttcatctgtatcatatatggctacacgattcttttcatctgtatcatattggcgcatcattcttttcgacactatgaactgcgaaggatagcttggtgaagtctccctctgtgggattgggctaaatccttgaccgcagaataatgcagcggagggtagcacagattgatcgatcgatcgattaattgatcatggcgaagtaagagaaggcagccactatgaggtcgcgagagtttatatgttttccccctcattttattctttttttccttcttgatatactcgagtccttgaaattttgttctgttagttttgtggttgctttggtaggttggagatgattgtagtagagatgccattgtttgtgagtaacctacaggacattgttacacttgttgacatattgaaaatgtgcagataattctttcaagattatttgtgttgattttcccgattacggaactgaggcactacgaatcattgcccagattttagctcgattcgaacgtcacgtttttttgttcacaaacgcagacgcttatgtacatgtgatgtgcacgcatctctattgacttgtaacatgacacgttattagcctagacagcactgagagtgctgctgctgataattttcggacaaatgtttacgtattcaaagggaaaaaagggctaaacaaaactgagcgaaagttgttcgtcctgcagggtccaaattttaatctccgaccccattgactagttaaaatgaccgaccctttggattcgcgattaaaattcagttccctccttaatcctcgttgattaatctctaaccccaatccaaaacaaaaaataattccaactttagggggttcaaaataaatccagccctgagggtttgttaaaatgacctatctttcgaatcgcgattaaaatgacctaacaatctgacaatctctaacccctcctcgtctcgtttgaaaaataaataaataaataatccggtctgtgttcggagtttcaacctgcgtcccccttgaacgcactaaaaaaaatgggcctgctagcccagcccaatatgatttcggcgtcacggaagcactactagaactagcagattttagtcccacctcgactgccaagcgagaagcgatgacctgggaggtgtacaaataggtggccttggcagtcggtgcagagcatggagctgcgtggtgaacacaaagcgaactattctttcgccttttactaaagaataccgtgtgcgcgccacattaagcagcatacctttatttttggagggtgcttttcctatcaggaaaggccccaacaattccaaacttcaaaaattttgctcacaattcaattgttatttactcaaaatctgtttacattcttgtaatttactcacaatatgtttaaattcttgtaatcgttctatgcattctaaggtaaattcttgtgatccttcttgtattcgaagggttttggtacattcttttacattctaaaggctttgttattcaaaccagaaaacgaacaaatggaacactccattcttttacattctaaaggcttacattccaagggttttgctatttaaaccagaaaagaacaaatggaacattctaagggcgtaatactcaacaagaaggcaagattgatcactcaagaacaggccttggcctcaaacattggaagaactacaaaggcgatcgatgtcggtgccaggtacaccggcgagttgacagcaacgagcgcagggctcatggccggaacgccgccgtcgtccgagagttccagcggtgcgccgttgagcagcatcgtcttgctctggaggtcgccgtccttggccgtcaggtggtactcctccctcctcgcgacgtcgcttgacggcttgcgccccagccatgaaaccgctcttctgaggctgtgtgagaaagaattgtgcttatgaaggctggctgttttgtcaaggctgacattgatgtcattctggagggtgacgttgtatccggtggtattgctcaggttgatcaacaggagggtgattccttgctgcatgttgaaaataagatttgtttcagattcttacatggaagagtggctaatctagacatttacctcacttgaatttaacatgatgtttacatggaaatacggcaattttcggtcatagcaaaacagtcagcggtaacgggaatgccataatttgcgaagtcaagaaaagaaaaaaaaaagtgtgcaatttgtacctgctgtttcctgcaatgagcataagcacgcagtttacgcggcgcattgatatcaactgaaagaacttccctgcccataagccgatgccatagtagagcactggggacaaaagaaggtttaaacagtgaaaactttgtaccgtaaaatgctgcagtaaagtctaaagatgtagccttacctatagtaatcaggatttggcaaaaaagtttgggtgtcaagtagaccatagtggccaccaatcagagtctgcctgcagaatatttttgtattgtacttagatgccattccaagctgatcaagatacctgtttgcattgaaaaaccatcacaaattcttgctgccacaagatgctagagtgtagctgtgaatttattttggtgtctgaccgcatgtaattgtgaaagttcatgagaaaatattgagagctgaccagatgctattgatgaaagtgtttgacacaagttcaccgccattgttgaatacacctccgctttcgctgacccaggcagaagcccatgttccatgcctttgaagggtgagttgcatatccctataagtatcttctgaacgatctaaatactttggatctaatatcttccttataaggtgggcatcattccctgaaaacatggcgtcgccattgatgaattttgcttattaattacaaaaagtggactaataatgataaaataacctggatttccagtgaatcacgcttatatatttctgatcaaattaaaaggactcaaatccaacacaaaagatgttcttaacatgagtaagaaaagaataaaagcctgcaagaaactcatgatttggcatttcagaaagaccataacacaactcatcgcttaacaggacagaacccttttttttgggaaagttagagagaattagtatgattgaaaaatgtgaaacaagtaaaagtcctgcctacaacattcttgatcattccctcaaaacgtcaagctacagaatcgaagcacagaaacgatttttcagatgccactagagcaaaagtagcatatcacatacctccaccaagattataaatatgatgcgtcaaagcactgacaacgccatgaccagaagtctgaagtagctgagtgtaccactgctgatcaaagaatcctccaggggctaacagggatggctgggagagtggtgccttgtacaactgttgaaagatggatttaagttcaattgcatcttttccatacagtgtagcatcgactcttgccccaattccatgcccgctcagttcattacctgacaaaacaacaaatggcactattgaggctcacattcgctcagcttacttcatgttccagaactccgaataaatggtatgcaatattaaatgaccaagtataaaaaaaaataatacaacagattaccatattcccatgagtcaactggatatccctttgagattgtgtattttacaaaattatatgcatttgtagagttccatttgctagcccagaaagaacgacggacattgtacctcccatagagcgcattcagaccaaatgtgataattgcactggagataaatgtttttaacacccattagctagctctgataaacaagtatgagttgcatgattgatgcaaaagaagattttggaacttcatgaagaaaatgaaaaaaaaaatatgcataattttttagggagagttttttatgcataatagtcatgtagttaaatactcaccctgttttttggaatagagcattcagtttgtcccacctatccatgcttagacaaccatctgagaaaccaaataaaccatttgacatgtttgtgaacggggcgcatggactgtttgtacccacatcataaacaactcggtcttgcaaagagcctcccagtctaatcctcaaattatcaaatgctgcagagagaacagagaaagagagaccgtgagacatttagggaatcaattgacttatcattgcaattgaataagcatcctgcaaataaacataattgtatccaccgatatggtgcagccgcagatagtatcatgtcagattttgagtagtatttttttctgctgagaattgatacaacacagatagtaggaaataagatttaagagcttctttggaatatcatctcaaaagagagtatacaaaatctttgcaatggaaaatttatagggatccgactaaaagtagaaattgcattcttgcaaactacaaactaaagtagacgtgcttcctaggctgcaacaatgtttgaatataaaaggacttattgcattagagatgtgtgtttgcaattcctttttgtctttaccgcatcactcacctatatacgaaagttctcctctgataatccagacaaacccagcagaaatgattaatatggaagcagtaatcacctaatgaaatccaacaacataccttgaatggcttgagccaggaagggatgatccaaatcctacatgaaccagttggtggaacaccaaatgagaagtaagcccatgaaccaatgcacaataacagcatataaaagtagtactactccaagggaagagcataacaataccaagtttagaattgacgattggccccatggacactgattatagttacacttctctggtggccaccaatcgattgtagcacatatataatttttattcgtttcagcgatttttgtcgatcccttaactatgaccgtcgcctcctctggctgctgagccgaagccgcccaaagaagagcatgcagacatatgaacactagaagcagcagcctcacctccatgcctgccacctataacaaatcacgatcaaaatttgttctatgcactacaagagtatccattttctggaatattatgaatttcttatataaacttttgcggggattggaagattatgagctgatatgataactgaaaagtatgcataattagccactcagtgactgatgcgaaaatttctaaatttcaccagaactatctgaattcaacaagaagacatgacatactaagcaacggtaactgaattaaccgatcagatatagcaagaataaatacttgtctgtgcccaagaaagatttttttcttttttttttctcacttaacacaaaacatgccatttctaacctggaaaaagacgcggagaccccacacttgcaagctcacatctgcaagacaaagatgccgatttctaagccggcgaagcaagcggagatcccacctgacctggcctggacacctcccctcctccgccgccaatctccgtccctcccggcggcgcgctggctgcgaggagatccggcagttggccgccggcggattcggagctcacgggggggcccaatcaggccgccatttcttggctctcagggtgggtggtactggtagctcggtagctacaaccggaagaagctgcctttcggggatacaggtgatgatgatgctgccggtagagctgcagggcacggcgagctgagctgcttcttggagcaacgtggcaggacaagggaataaacagtaggtatatcttgaggtgcgtgccttctccttctcctactactagtactacttctctgtgctgcagcagagtttgcttgtgtcggtgaattgtgtccgattcaggagatgctgtgtgtgtgagatcagtgactgtcactgtgagaaaacaaatttcagaagaaagttgaataaaataaatccagtaatggaggtcagtgaaccagcttgttgaaacagaggactcttagatctgacttcggtaggagttaatactccctaagtaccataatataatagattttgattttttttattgtattgtatgaccatttgtcttattcaaaaaatttatgtaaatataaaaaacgaaaagttatgtttgaaatactttggataataaagtaagtcacaaataaaataaataataattctaaatttttttaaataagacgaatggtcaaacagtacaaacaaaaagttaaaatcccttatattatgagacggagagagcagtaaactccggtatagggcctgtttgaatccggagggctattaaatagccatccgaaatcttgttatttagaagtattaaacgtatattactgacaaaacccattccataacccctacgtctcgtaaaatagtctaagggttatggaatgggtttttattagtaatctatatttaatacttctaaatagtaaaattttggagagatatttaatagcctgaagatccaaacaggcccatagttgtggtgataagagcagcccgatagtgacagtgcgcccaccgcgaagctttgctcgtgtcatgtgtcaaagcttattctttttttaaacacctccacgtaaccacctacgcctacccgtagcaaccgcaagaaattctgttcaccaatattaagggcatgtttggagacttctaagattagagcaagactaataatatagccagctgctgactgtatagatctttatagcatatctctcagctcacttatataatggttagctcttttctgtaaacatatgttccacctgtctgtctcacaaattttcttgattcctatgcctaagccggttataaacttacagtccgcttctcatctctctcctctcctttctcatccacctcagcattcagccttcttataacccactattattcttgctcttatgagaaacaactactcactccgtccaaaaaaaagacaaaccctagctatgagggagtagttggtagccagcttctaagaatctgtaaaaactgggttttccagcttctgacttctagtttattttctgtattccacaactataactttttaaaatttggataaaaactagactgtttaggagaacttctgattctgagagaagctgcagcagctagaagcttctctaatcaggccttaagtctcctgttgttgcatatacgagcagcgatacggatgcaacagcgaggatttgttgaaggaaagcactagaccaaccaaacggccaggggggagacgcggcctcgtaaagcttactgaagagactaacccgtgctattacgtgctaaaccaccacaaaggcacaacgcggccgcaaggcatgcgactgcgccaccgcatttttgcatgggatcccggccggaacatcgcgtcgcgcgtcgataggcacaggctgcgttcggcacggaaaacggagccataattagcaagtaattaattaagtatttactaattttttttaataaaaatagattaatataatttttttaagccactttcgtatagaaactttttgtaaaaaatacactgtgtagcagtttgaaaaacgtgcatatggaaaatgagaagtcaggaacatttcacggaacacagccacagttggtcacggcacaaaactttggtggtgtttgagaggggagggacttattttagtccttctcacaatataagtcccttctctgtgacttatacttttgtgagacctaaacaccaccttactcactcatatgcggatgcgcctccctatcccgggcaaaagctagattcaccgtgtcatctactccctccgtctcaaaaaaaaaaaagaagcaaaccctagatttccgtgtctaactttgactgtccgttttatatgaaatttttttataattcgtatttttattgttgttaaatgataaaacatgattaatattttatgcgtgacttgtctttttaattttttttcatattttttttaaataagacggacagtcaaacgttggacacggaaatcagggtttgtctttttttaagacggagggagtacatacatccacagatctacccgttgtttgtacgaggaacttgtgtgccaaccaacccaactattcgtcttcgtcgtcgtcttaattaacgtaagcctccaagtccagtctgtaagcatggcgagaagggcggattcaccttttaccgacgttttatcagcattgtcgcgcgcataaaatagaatcggacacaagggttaaggggttggagttttaatctcgtttgggaaaagaaatccgttgaggaacaattttcccagtaaacataggcggacacagtcaaaagaagaaaacatggagcaatgtcaccatatcgtatcacataatcaccacgacaacgtacgctggatggtcatcgccggatcatttacacttctttttttttttacaaaggaacatgtgtaacctaactgttcgtcttcaacataagcccagggtttacattaccatcagcaaccgcggttaccagtcttaccgcggggtacggtaatagaaaaaccacgataaccttcttaaattcaaataaatttagaaaataatttgaatttttgataaattttgcacggtttggtatggtttttcacagttaccgcagtaaccacgcttaccgccggggcgcggtaaccccggccctggcggtttgggaaaccctgcataagcctccactttgtttgctttagcatggcaacagctaaaatgagaactgcttgattcagaatagtgacagcaggttacatatagtggtgtgatgcttcgtttggatctgtacagctactgactgaactacaaactagtgttttctcagggacattattctgctagtagtcagtggctaaattctgcagcatgaacgacctggtcttgccatctggtttcaacccaatgctccgcattttcgtgtatactttcctcgctaatctgatcttgcctcgcagacaaagcccgtgaattaccgtgttgtagaccgaggagtctggagcgacctcctgcaaggttcaaagttcatataaggtgaaacgaatgaaatatgcgattcggtccatttggaagtatcaaaattgcacagagtaatatgtcatgaaagttgaacatcatgtatttaaatgctaccgtgggctaactaggtacgattttacaaacaccaaaaaataggaactgcagaaatttaggcatgctttatccttaatgttagcatgatgaatgggtgaggaaacaagaagctatatgtatactgtatgttttagcatacgtgttattctgaatcatggtaacagaaacattggaaaccggaaaacgtcaaacagacgtagaaaacattagttacggttcgctgggctttcaggacaaaggcagaatcataggaatcacttgccttaaccaatcaaaatattttttcatattggcagcaaaaatataagagcttgtttagtgttttcattttctttgtttctctgcgtggaataatggtactgcaatctacaacatgcttacacctaggaacaggaatttttgccctaaccaagcaggggtcagagtgccactaattctgttaatcatgctttaggtaccagcatggtagactaacgcatgctaagcaatgagaaatcccggggtcagagtgccactaattctgttaatcatgctttaggtaccagcatggtagactaacgcatgctaagcaatgagaaatcccattttttttggccatctgaacagaagtataaagcaaagaaaggaagtagtacctccaatatatcctcaacttcattccaaagagatccccatatgcaagctcttataacagataaatgtgtgaacgtgtctggtgaacaccctcgatgagtcatacgccggtacactttcagagcaacttttggcatcctagcaacttcacaagcacctatcacatgattgtatgaaaccgccgatatttgaagtccacctctttccatcatccataacaattgcaagccatgttcccattgaccaagtctttcacaagacatcaaagctatgttgtacagatggttatttaagagtgctgaatgcttggtcttaattccttgaaaaagatctaggacatcccaacaacgaccagacctatataacgctgacagtaaagcactccatgtatattgatcaggcttaaggcctgaagatgttagcagatgatacatcctaaaggcaagttcatcttcaccggccttaccaagtgagttgattatggaattgaacacaatgatactaggtttcattccagcactcaacattctcctgaatgtggtaagcgcaaactcccatttcccttcttttgtacatgatgcaatgatggccttcagtatatcttcacttggatcaataccacttttgaacatttcctgataagcatcaactgctaactcagactgcccacactggacaaatgtgctaactaacaaatcataagtcatcaaggttccactcaaagaattctcccctagccttctccaaagtctctccacctgcctccagtcttttgctcttccgcacacagatatcaccgtgttgtaaacgatcacatcgacattcttcttatcgctctcttcaatttcatcaaacattttcagggctgcaaagtagccctcagtagtggcaacagccttgagtatcaaggtgtacgaatgcccggttgccattcctttccccttcatgaactcgaataccttcatcgcatcggcgaaagaaccccttcgcacaaaacaagccagaagggagttacaggcatgcgcgctcggctgcaagcctgaggcacgcattgaatcgaacagctcggtggcactcctgaccttgttggactggctgagcttgatcaacctcctggacagcatctcctcatccctctcctccaagaagtgcagcctcgatcccccgacctcagatttgctccccgcggctgacgccgacgccgacgccgcgcttcttgctgcggcgacggggccttcctccacagcagccggcctcaccgggcgccgccgcagcccgtgcctccggtgaccatcagcgaccggcggctcatcgtccatgccccaaaccgccacaccgacctcctccttgccggcgacgtcgggttcaagaacgcatggagccgccgccctgcacacgcgcacgcgccctctggcgaagacaaccacggtccttgcagcttccgcatggcgggtggtggcgtctctgcccgctcctccgctccatggatggattcttgccccatcaccgccccttcttccacgcgggtgtgggggaagttcttggctgaagctcgtgctgcagccgctccacactgcagccatatatgcccgccccgcaaatgcaaacgaaacctgcaaaaatctctcaacaagacaaagggattctggaaatcacgctggaagagggattcggctggctcatgaggggaaaatcggcaggaaatctggtgagaaatttggtccctcgctagaacggataggagggtggagaagaggaagagggagaagagaagaggagaagagagagcagcaatggtgggagcagagcagcggatgaggggattagaagatggagggctcgttaaatgggccgaagtttcctttcatttaagatgggcctaattcttcgtcctgacggcccgtgagatcaagctcttgattattttcttggcccactaatgctttcttatttattttagaaaaatgttctttttaactttttttagtaaattttataaaaccataccaatatggtctaagttacacaaaaccatagtgattttagcacatggaagtattatggtcctgaagtttcacaaaagcacaccattgaccaattttacatattcctatattcaaaatttaaaaagctttacttacatgcacgtgatatttatatgatggataaaaaattcatacatttgagatattattatacaactttaaaatgtggttgatcaaagtcaaaatgtttaatagtgtggtttttgaaactttatagccacaatatttggggttaagtgccatgccaaaatcatgtggttttgtgcaacttgtaccaaaatatttagggttattttttatttatgattcttattgtcgtttactgttcagtcttgtcactagatttttactagtgcggaaaagatgaacaaaaatgcacacacgagaactgatgcttagtggactggcatgtctaatctttcaacctgatagctcctttgcaagaacaaaatattggaaatcagtatcccttctttggacaggatgcagtttaacctttttcctttctagcaacctaggcactcagaataaagtagagtaaaaatctagcatccaactagaatcacagaacagattctgcacttgtgagaaaaagcacattctgtttactttgctcctccaatagggcactgaaaactgaattttgcaagaaacaggtttgaacactgaattgacatctgtaactgattactagctacgtgcagagaacaagaatatttcatattaagagaatgttagacaaaaatgatgctgaattgcactaaggaaaatattccctgaatgtttttttttcaaaatttattaggcaaatagctagctatcttcagacttaagccaagggcaagaagagcaagagaaaagcacagggagaaagaatagcacatgctaagcccaaagaacagaacaaccaaaaggggggtttgattcttgaagatttccatgggttaaagcaatcccatatccattcctcttgcctttctacaatacaaaaaatggcttccttgttctctgcctctcttcaccacctatgaatacaagcaaagcaatatttaaaacgcaggacttcgcttagttctgaagattgttcttccttggagctattcgttctctacaaatacgttgggcgccatggacggcgacttgaagaagctaaggtatgcaaccgcatgaaacatcttgaggtgaatttggtgaaagctttggattttactttgtttcgtcggcaaaagggtaaacttttcaatggcttaattagtttcgtgtcatctcaagactgtagctcatacgagctactagctcataactgtagtttttgtgcccttttgccccttgtgttttgtcgagaacttcaaatttctgcaagaaaatgtgttgtcatctttcctcccttatttacttgttcagttcttctcaagagcagccatgttttatttaagttcctcaatatatagctggatttcacattggcgcccagtgattagtgcagggtagtagcatcagcatcaaattaaaatttcagaacatcgctcttgcgcagggttcgatttcctggattaggaaagggaaacaaaggtggcagacaggctccaacaatactgcaagaagaagacacatctcttcaaagaggtaggtgatcaagatttcatctttcagttttaacgatgacataatcttttatttactgttgatcgctaccagcagtttgccattaaatttctgtcctatagcactatgaacaaatcggttaatcagcattctgcattgtaaaaaagtaatttctgctatcagatgttcagatgtttgaattaaaaagcagatgttgaaaatagataattgtcaaagatatatatatccggtttagtttgtcaaagatgtacttttctagttgagccatttattctgttgaaagaaagaaataaatcaggatagaacacacaaagcaaaatataagaagaaggaaacggaaaacttaataactggcagtgaaacttggcagcaccgatgaatagcagcgatggatatgatgctgcatttgcggccacaattgctgcagcagcatatgcaattgcttcgcaagaagagaagctagcagctcagaagaagcctgtccccattcaggggcaatctactactcctcctgtccagtctccagtaaagagaggtgaaagcatgaaaaaacccacaggaggcagcaagatctcaagatggtttagtggcaaagagcctgctgaagacaatgacgatggaccaggtattctgtaaatatgtaactccatctttattcaattttactgtagcaaaacctgcaaacttcttataacggtgctgaaatgcatttcagccaatgtatctgtaaggaggccacttaaaccagcacaaagaaagcaagaggacatagcttcagatcagaaggtgccacccaagatggttgattcttctctgagcgcgaagaaaggttcgggttcctctagcaaattgcaagacaagaaagggagcaagaagtttgagcaagagcaggtgattcagaagaccccatccaccacaaggccagcaacatcgtatcattctagacggaatggagatggtactgttggattaactgctgttggcccagcagacaccaaaactaatgaatgggagaaggcgaagctcgctagcattacggaagagtaagtacaattgttttgaactatatgcatgactgtttgatgaaagcagaattaactcgctgtcaaaattttaggtataagaacatgatggataccatagctgaatgggagaatgagaagaaggtgaaggctaagcgccaaaaagagcaaaaagaggtttttgtttattattcgtaatttaatagcatattacattgcttgttcaatataccctctttatcttttcctggatataaactctttatgttttgaaatgtcgtgatttatgtagcatgtcaaaaaaatgtttagattgacgatactgaaaactgaacttgctaatttgcagaaagtgttggaccaaaagagagcaaaggcactagaagaatacagccaggaaataacaaggatcaacaaaattgctggaggagcaaggacaatggcagaggaaaggaaatataacgatgagaaaaagatcaaagaaaaggcaaataaaagacggttatcggaaaaggctccccgcgcatgcgcttgcttttaagatatttccatatgatgcaatatttgaatggaatgataggcgattgcaagattgtaccctccaaacaacgatgtattgtgctttataatgtgtattggtttgatgagtgtatagaattttatccagcatgcaaaaagttggcatgctctactaaaaaaggtacagcttttgcataatcaccaagtgctttcaaaacgatgtgttgtgctttcaaaatgaagtagacactataagaaaagagtatatgttcagtacaataatacaaattcaggaacttatcggtgatgtgtctgttacatacaaatacacatcaggataacaaaaaaaaatacttggtaaaagttcttaaaaaaacacttggtgagccagttgtagttctcttctagaaatgaataacggaactgctagctgactgtcgacagttttcatgagtaaaaactttacccaaagtttcatatatgaagcaagttttcaagaaactgctcgagttttagcaaaagctgccttaataaaggggctcccctccggatcacagatatcatccccttcggaaaataaccctctttcagtttttttgcgggtctattgttttgtgatagaccctgtatatatatccgcactgtgaatttactccttctctattgataaaaaagagtttttttacagtccttgagggaaggcagtatcatatcctagccgttgatttcgcgtgatctaacggctggaaaacctcggtaccacgtggtaccgcgtttcctgtgagaggaggtaccgatcagtttttgaggtgggagggtatcatcgtaatttcgcgtcacttctctcgatcgacctaaccgcgagcgccgctccttcaagctcgtcgctgcgcggtggaggcggcgcgacggcgatatgcgacggcgggcgcggcgcgacggcggggcgcgacggcgagatgcgacggacggcgggatgcgacggcagatgcggcagtgagaaggcggcggcctcgatgcgatggcggccacggcgcgacggcgggcgacccaagccgagacgacgacgacgacgagcatgtgagattgatcgatgcggccacgatgcgacggtgggatgcgacggcggcgacgacgggatgcgagggggacggcggcaggaggacggacgcgcggcggctggataggggctggacggcggcgggcggacggacgcgcggcggcggtggcggctggacgcgcggcgacgggggcggctggacgtgcgatggcggcgggcggctggatgcgcgactgcggcggccggctagttgcacgacggcggcagcggcctcgattggcgacgacgacagcgggctggatgggcgacggcggcggccggcgggatgcacggcgacagcgggctggatgggcgacggcggcggccggtgggatgcacgacggcggcggcgacgtcgattggcgacgtcgacggtgggctggatgggcgacgtcggcggccggcgggatgcacgacggcggcggcggcctcgattggcgtcgacggcgacaggctggatgcgacgacgcggcgggctcgacgaagagaggacacctgttagtccgatcatactcctgctaaatcaacggttagattagattggtagctcatggtacattccttatgggaaaaatgcaagagaaaaataaagagtaaagtggctcctgcccttggttgtgagagagagagagagaagtcaaccagaaagtgactacagaaatgcttgtaaacaagctccaagccatcacctctcttatagcatttgcaaatccaattacaagtaaagcacacttggttttataacttctcatttgatttacaatgaaataaacctgacatcactatttacaagtacattgactacttattatactctaaacctgttgagaaaatattacttgttaaagaaatttaatgtacaagctacacaacatcctctgcattaatccagatcagaaaaaaaaataaaaaagaagaagaagaaagctgaaaacatgaccgccaagttggcaatgttaaaaaggcacacatgatctatgcagcttgctcagatgcatttccctcgtcatcatgaaataaatgtggtgaattgccagcatgtggtgtagacgcgggtttgccgtcctggagcaagatcactgtttcaaaagcaccaactaaagcctttaccttgcttttccgggactcgacaagtttacttgcagtttcttctataacattattaaacagcccctgtgcatctttcttctcttgtgtatcttggtgtcgcagtttcacaccaggagattccacatctaggttagaaggtccagcatctattgtgctattcatcttatatattcttctagctgacaggccttcactgcttgaaaattcacttgcacttcttcttctaaatttgagttttcttgggccattactgtctggttggagttcaacaattttacctctcttaaatttcaatttgtaaggtgtggcactatcatcatcctgttcaagcgctgagattctttttggtcgttgtccatcagcctttaaatgatcatagctgtttttattgatcgttggtccttcatcttctgtaccagattcatctaattcacttaactcaaaatcatactcttcgtaaaattcatcctctgatagttcttcaggtgactgttgaaggaaaaaccctggtttcagttcatcctgttcaaaggtgttgccagtactagaaatcactaacccatctgtttgtagagtagaatcacttggttgaatttgcacagactttggctcccccagaagttcaccatctgatgaagtttctgaaattggttggcagtgtgaaggactgttattagtccaaccctcaaatatttcatcagccttgacatcttccactgtatttcctgaggtggaaccaagaaaagatccaggctccttagcatgtttttcaccgagtgccaactgttctatagattcttgaaggccttcatgggcttcctcttcttcattaccttcagcgtcttgagactccatgctagcgttggctttcactccatcagcttcaatttctgaactattttcggttgatagagagtcgcccagaactgcattttccacagctatcgagtttttagatgattggcaaggagaagcatcgtctgtttggttttcttctgcctctaaattgctcagtgcattcttgagttgctgatcatccgatgattgcagcaagcctgttacaatggagctctgcaggggttcttcattccctcctgatgcttcattcttccgattgctttccatcccatcatcccctgacacaggcctaattatttcttctggtgctgatctagattcatcaacacattctgtggtatctgaagacactcctgccagtgtcgactccacatgaagacctcttatgaatgaatcttgcacatcatgttcttgtattacaacagaaacatccatcttcgattctacagagaatgatgatctggccatatgcaagccttccttcccattgatacttggcttgcttgaattcatcgaacttcttccagttttatcactgttacttcgacgcacaccagtaacagttgctggtgaagatgtaagctctccctttacagtacgtttagcttttgaagaaagtagatgactagaaacctgagatggcacgggcacttgcttaatcaagttaagcttagtaggcaatgaagtcggtctcttaattgatgattgcttgaccgttgtgaccttttccatagttctagattcctccagttgtggcatctctgccagcttcaacttggcaggcactatggttcccttaactggcattgctgattttttgtcaaatttaggaactccattggaagatcctgaatcagctgaagtcttctgtgcaactgttagatgcttctttcttccatcaaggttcacgtttttatgatcagctgatgaagaagtgcgtgtaatcaaatgatcagaggatcctttcaaatttgcttgtgttttcttgggagcaatgcggtcagattcacccagagatatactcgacttggctagagaaagatttctctgcctgacatcctttgatctatccaagatagctgatctgtgcaacgtcaaattatttaaatgactaggaagtttctttcttctgcctcctgaagttgaaagcttcttctcttcctcaaaaggatttttgtgtccatatttgcataaattatggc
